United States Patent 10,113,201 (METHODS AND COMPOSITIONS FOR DIAGNOSIS OF GLIOBLASTOMA OR A SUBTYPE THEREOF) - sequence listing, part 11

SEQ ID NO: 163 - DNA, 393804 bp, Homo sapiens
gcgtcggcggggcgcggaggaaccgcggcggcggcggcggcggccgcatccttgccgcccgccccggcccagccgcgtcccggagccgtcgggcatggagccgtggaagcagtgcgcgcagtggctcatccattgcaaggtgctgcccaccaaccaccgggtgacctgggactcggctcaggtgttcgaccttgcgcagaccctccgcgatggagtcctgctctgccagctgcttaacaacctccgggcgcactccatcaacctgaaggagatcaacctgaggccgcagatgtcccaggtgaggaggccggcacgggcgccccgcctccagccggcagctcccattaatcatgcggctaatttctttgtgtaaatgcaaacgtctaggtgcgctgagcttgccctgcttcccagccttctgctttgggaccacttcggcaccactttggcgtttcctaccttggcttgaaatggtttagctcctcaagctgaatgcgaaagctttgcgtccggagatggtgtgaggatttcgtaaaggctttctgtgaggcgggaaagaaataagttgtcttagggtgcccttcacctactctgcgtgtgtgtggcgcgacaaagggaatttgatcaagctcttctataataacgaaggggagggacgaaacgaggtgatggggtaatttgcctttagtctcttcttttgctttgcgtcttgtactcatgttttcctaaaagaggaaccatgacatacatgaggactcgaggaagtgaagggcgtttggtcccgttatctgtccaggagtgacattggtcaaagggaagaacagggagcagaacccggaggccgcccccagggcccctgagctggtggccagccggcaagctcccgtttacagctcttcctaagccatgtgagaaggagcgagtccagcctctctcagcagcgacaggaaatgagaagtttcactagagattccgctttccttcctgcagtgccctgctcaggtgctgtggtgccggtcggctcctggggctggagctgcctctttgagggttaagccagacacctctggaaggttgggtgcaccctagagtcagctcaaaagtcacagttcagtggaagagtagtttatttgtcctgtcggaaaatttttgtacagaaggatgttaaactcggttcagagcctctttctctttcagaatgttaaaacaaaacaaaaaaccaaactgctttcaacttaaaagggagaggacagagccctctccctgacacatttcagcactaatcctctatgacgcagagcctcagctacttagcaaccagagcagcgccttttaagaaggaacggactttatatgatttaataagtatgtatttaaagttagagcacacacagtcatctgtgattcttggtgtcagtgtttcatcagggtcccctgcacttcagattctgcattccttgcctgtttgccttcaacctgctggtgggcagtccctaagaaagaacaggcatggaagtggggagagccatacgtatttaaaagtgaggtaaattattttatacccccataaacatgcatggtgattgctacctctcggtaccccttcagagttgtctcaactctggaaattcctttgaggggtttggcagacttttctattatggtgggagctgcagttagctactctcacacatccccattttccactttgcctgtagcctcaggaggcagcgtgggtcaggatgccttggcccaccagtagggagtacagtactgtgcacatttcctggaacttgtttcctggaactctcagcagttgctctcaataatcacgttttctggacagctgaagacctttttaaacctcgaagcctttatttgaatgctaacaatggatgagaatcgttttgaatgtgtttcactcttctcctcttatgttagatgtaatttaatctttctgatgaccaaagattgtcattataagcatcattaatgaaaattgagcacatacaatgctctaagagttctgttccctagtgggggtagcaaaatgagcacaccaggatacttgccctaaaggaattattacactatgctatcagatggtaaatcactgggttataataaggtaagtaggacagctaatgaccttctttgtgccgttgcacttttgagttcttaagtctgttcaaccttgaggtttctggttccaaattaagtacagtttctcctgtaatgtcctatgagagggtgcttccctcaaatgtgaatcctagaaggctagtacctgagcctggtgatgtctgtttttgctttcctcatggttcttggcctcattgcagagaggcaaggctgctgaacaagtggatgctaggccgatgagtttgtatcatgcaggttgtcattaaatcctttaatgagacttatgaaatgattttatgaaacaacttgacgtatttaacatgcttatagtgcctagcacatgtacttaataaatgtttactattagcaaaattatgaaaaacattttttctgctattgttatattaagagtaataggttccaatagaaattttaaaacaattgtagaggcctaccggttcctttgggctgataaccctagacattttgccgctaactactcatctctttcttgggaaaggttctagctgtagtgaatacactattaacctggtacaaccctgtcatgtcccagcagaatgtattcccctggagttagagatgtcattactagtacttgtggcgttttggtatgtctgagagtcgttctgtctacttagattctgttgaagatattaatttgaaatagactattttttatagcacatgatctcctaacctgagaaataactggaagctgtcacttctgacttttgtgacatattgagactgtaaagagcagatgttgacaaaagaaattttaatttattgatgttttgtttgtagcctgtttagctttcctgaaagaggctataaaatgaccagccttttaaaatgagtgtttattccagtgagtgggatgcctttctattctctgttagccttctgccttgtttgcatttaaaaaaataaataactgcaaataatgactgctcaattataggtttgaatcttggaatcttaataagttagttgattatctttcaaaataaaagcatggatgggatcccagttttcttacttattgttctttctggctgttgacatcagtttgtttttgatcttgccatcttggtaagaggatgatcttcagttcaaaaataagtatattttttcatgctgatttagtgtttgtttttatttatgataggttaaagaggtaaacattaatcatatttagttatacatttaacatgttcctcttattatataatacagttaaataaaatgcagttggccagtgaatatctaagaaatttggtgtctgtatatgttagattttagtgtctatatttgagatttatttttcatctgaaacagtattctagccaggacacaaagcatgtgaatgattctggaagagaagagcctactggtgatagctgtactgggtgggcggcacatgctggggttggggctgggggtgtgcctgtggaagggcatgagttattggcttgatgtcacttttagtggttaagaagatcttcatgaatgcctataaccacccctagatctatcatgaatgagagtaccttagtcttagtttgaaacttaaaattttgctttatactatgctttatagtaggggtaatacagtcaatgagtttagtggccactatggacagtgtatgtaaactttgaattgtttaaatgaataattcagacttcaaggattccttcaatgaatatttacttggtcctactatgttccaggcgctgttttagacactgtcttggacaaactcaacaaagtccctgccctaaaggggtttggattttagtagagttgaaccataaataaatgactgtataatttatttatatatttatatttttacatacaatttattgtatataattatttatatatttatctataatgtgctatgaacccatttgaagctgagttaggaactagagagaaatgtaatacaattttatagaaggtagtcaagaaagtcctctccaagggagtgacaattaggtgggacctgaagcgagtgaaggaacacaggaatgtcaatgtttggaaaaaagaatattcctggtggagggaataccaagtgcaaagctcctgaggtcattaagtggcaggcatactggaggaacagcagggtcagtgtggttggaggagagtgagtgtgggaaagagtgggaaacgtgaagtcagagagaaaatggaagctcgatttttaggacttgtgggccactttaaggactttggatttcactttgagtgaaatgagaggtcaacagagggatgaggagaggagtgacatggcctgatttacctttcttttcttttctttttttttttgagacggagtcttactgtgtagcccaagttggcgtgcagtggcctgatctcagctcactgcaacctccgcctcccaggctcaagagtttctcgttcctgagcctccagagtagctgggactacaggcacgtgccactactcccggctacttttttgtattttagtagagggggtttcaccatgttgcctagagtggtctccaactcctgagctcaggcagtccacccgccttggcctcccaaagtgttaggattacaggcatgagctgccacgcccagccctgatttacctttcctacagttactttggctactgcattgagaacagactggagagcagcaaggatagaagtggccaggctaatacatcattcaggcaagagatgatggcggcttttaccaaagcaatagcagggcagatggtgggaagaataggctctgaatatattctgaagatggagccagcaggggtttattgatggactagattagggatatgagaagagaggagtcaagtatgtctccagaatttttgccctgagaaactggatgatgaagttcccatttactgaaatggagaggactagaggaagtatggtgttggggtgtatgtggggagaggggaaggaatatctggagctagttatgattgaagtgcctagtagacatctagatgggtacgccgagcaagttggaggagttggagatgtaggtataaagtttggagtcatcaaggtgaagatggtatttaaaatcatgagactgggtgataccacacagggagtagtgaagaaagaagaaaaagtctgatgagccattggagcatgcctgttctcgagggcagagagatggggagaacctgtgaaggagttgagaggcaatggccatgaggtaggagggaaaccaagtgaacagagtatttttgggaggagcgatgacatgtcaaatgctgctgatcaagtgaaataaggactgaggatagaagatttaaacaatataagtttccttggtgaccttgacaaaaacagatttggtgatgtggtgggcaaacacctgatagtaggagagggttgagacagcaagtatagacagctctttagggagtaattttgctgcaaagagaacagaaaaatgggatagtggctactaggggaaaagaaatcaatatatgggttaattaattaattaattaatttatttattttttagacagagtcttgctccgtcacccaggctggagtgcagtggtgagatcttggctcactgcaacctctgcctcctgggttcaaccaattctcctgccttagcctcccaggtagctaggattacaggtgtgtgctaccacgcctggctaatttttgtattttagtagagacggggttttaccttgttggccaatctggtctcaaacttcagacctcaggtcatcaggccgccttggcctcccgaaagtactgggattacagctgtaagccactgtgcccggcctagatatagtttattttcttatgacacaattcttattttatacctattgaaagagctctttagatggacagattttctcatatggtactcttgtgtatatgtatttgtatgtgaaaagatatatctatatatgaagaatgagaacatatgggcacagggaggggaacatcacacaccggggcctgtcgggggttggagggcaaggggagggataacattatgagaaatacctaacgtagatgacgggttgatgggtgcaggaaaccaccatggcacatgtatacctatgtaacaaacctgcacttgcttcacatgtatcccagaacttaaagtataatgataaaaaaaaataagtaaaatttaaagtgttttaaaatcttctttttgttcagattgtgactattctgaataccacttgaacttagagtcattgattgccatgtgttttcatacagtgttgccctttgaacatctagtgttggtgatgcagcattcctaaaataattcatcactattgtctgtgagatttccttctaagctgagttttgatgctgctgttattattttaaagagttagtttctgctgtacacaaccatacattgtttttaaaaactatgatttagttttagcattgaggcatgaattccaaatacatgtctacacactccctcctcccatacaaggtggtgtgacttacagatttttgggttatacaaaagggaaggaggaagaactgttatttcccaaaaagaatggtgtgcctagtaacatttttagtcagttcattcagaataatatcattccttagtcttctcagaagtcattaacctctttgccatttgttaggttattctcttggataatctgccagcataattttaaactcaataccaatcaggatcttttcatgtaaagtagttgtggcatctttaggcatcttaagcacttgttctgtctgcgtgattggtggcttaacctaggttctctggaaagcagagcctggggtaaggcactgaagtactgaaaccctcttggtgaggtacaatcccatggcttgccagagtgaggaaatgagatcgtgtctttttttttttttaagatggagaaaattataccatgtttgcaatacaaatggggttgatctagtatagatcaccacatattttctaattttcaaatacagtggattgtttttattatttttctcgaatcccctgtagcaattgatgttactgatcatccccttctcctaaaactctctcttccctttactctcaccacaccatattctcctgattctcttgtacctcttattattccttctcagtttttgtttgtttgtttgctggcttctctttattgaaacatatcttaaacattttagagttttctctttagttgtgttttgatttcatattcgcttccctgtagcatctcatgacatctgtggtgttacctaccttgctggatcccaaattcatactgacagcctcagtctgcctgttttacacccctgcctctataattacagtggctccataggtatgaagcctgatcattgtagaaagttcactcacaatagagaggggtggattggatgggacaaaactaggcgtgagcaggactggtactgaagtcattcaacagaagataaggccagagaaaggaggtgaatagagggatagagaggaacaaaaaagattaaagtgataattatgagttgggatggctgggactttgcaaccttttagatacagagaaagagtggaaagtatctaggttgagacccaggtttcagcatcaggtgacagaagtgtcataaagaaggggcacattttagtgagaaagggaacacattctgtcttggactctgagttggaagttattaccagttaccctctctcttctcagtttcatgcatcccactctcttaatacccctttcttttgggtttgttctactaatacctaaaacccaacaatcctttgaactcattgcttctaccacctcttaacttcctgattcagttttcatttccttcctacttagcttaaatactatagccattataattccttgacgtccctcgatttgtcctgcttgtttggataaacaaaaccctggtaaaattcaacttgttacttattccctgcttacaactgagctgctgaatgtaatggaggaaaacccgcaccgtgctgactgctctcactttaagttcatgatccctaacctcaagtgggcaccttgggccatccagtcatctgattatatttctttaatgttctcaaagtatggtctggaactactggcagtccctgaagtgcttttacgggtcctacaatttcaaaactctctttatggttttatttataatcgaataataatagattatttgccctcattctcattttctaatgtgtatatagaggaattttccaaaggctgtgtgatagtgcctataccgttgctgtggctgactgtagcatatatgcttgtgtacgtttcaaaggcttatcagtttagaattctagtatgttaaacattaatagctgtgaaaccccaaacaaaagctgctgaggattctcaatcacgttttaagagtggaaaggggtcctgaggaaaaaaaagtttgagaactgcccgagaccatttactttttgactctccagatcactctgtactaccttttcttctttccttaaacttaacttaatcacccgtttctcccttctttctctcaactcgtaatcttacttcctgttccactgagagaaaagacaaaattggaggagagcttcctcaggctcccaccttcctgcatctgtgctcatagatgatgccttctctcctgcactatgagtgagttaacagtgctcctggccaaggccagtttctccttcactcttaccccgatgctcttctgcatcatcagttctcacttggatctttcccatttgcatgcatgtatgccgttgttcccttcatttgatgtgagatatattttcagagtagagatagaaacatgtggatgaacattgggtgtgatggagagcgactaaggatgcctagggtttgatctgagctactagggcagatgatcagacaacctccttataactttagtggttcctgatggaccatgggataaaatccaacctccttagtatgcaagagctcatggtcttgtgctgcttcatctctcaaagctcttctccactttgtactcctgaccttcttgcagtttcttgaagactatgctgttaaatgtctctgtgctgttgcatatacctttttgtctgcttgaagttccctttttcatttgtctacttgtagattcagttcaagagtcatctttgtattgtcttccctgacttttctcccaggtgtggctgagcacatgctgctttgtgccacagtgtctggtagaatgcagcatttcttgctgttttgcagttttttttccttatccgtctcccttccaggctttggcttgattgaggatgccataggctagttcctttatatatggcactagaaatggacacagggagtcatacctaataggcatacataaataggcatagattaaattcatcaatgggatgaaaatggtgactctttactaccttttcaaacatctacaaattaaaaaaaaaacatagccagcactgactgtcattaaaaaccaaaaatacttaagtgccattactaataatagcaggtaacattacttcaccacttaccgagtgactctcagaaagtgactaaacctgtctatctgtctgttctttagcttcctcatctctaaaatagaccaaataaaagaacctacctcctagggttcttgtgagggctagctgaattaattaatgtgactggcttataacaagtgcccaatagatgttaactattttttactataatgattatcactgcttctgtggaaacatacaaggcagttactaaagctttccatgcattatctcatctaattgtccaacaccgtgaggcaggcactgttatttatccccatgtggtggatactctctgaagctaagaggggtttagtaacttacaccaacaagtggtttgtggtagagccaaacttagaataagaacattaagagcgaactgaattcttgtcagcgaggctatcggcctatctgaatgtgaactgcgatgaggactgcaatgaatttccccccctcccatggtattttcctgttgtgtggggctcccttggaggagtgttctgattggccttatggctgttgttaatagcacctccttactagtcagatattgagttaaaattttgcctcaggacaggagaatagcttgaacctgggaggtggaggttgcagtgatccaagatcatgccactgcactccagcctgggcaacagagcaagacttcatctcaaaaaaaaaaaaaaaaaaatttgcctcaggatactgaatctggatgatttcatacacatttatcacactattcagtataaaatgggtgttagacttttgacaggtatataatgggaaaaggaaaggaaatcaggaaaactaaggaaagttaatgaggggaagagagaaagtgagtgtagctgttcctttttagccttttaatactgtgccttgtgacagctggtctcaagcacatggtttaatgctctgttctggagtcaggagtgcctacatttctctgggaagcaggaacactgttgtttaaaatgatgtgctttgatagggcattttttttctattataaatattctttttgtaaattcacagacaacctattgttagctattatttggagcattattttatcatgtttttcatcctctgttaacatagacccttcatggtgttaaagccagtcacaagttgacattctggttttccttaatcttgggcatttagtggatagaaccatgaacagcaaagtagttccttttgatttccatgtaaaattatttttaaattgtattttgtgctgctgtctgaatgtgctttcaaaatctgtgttacaagaagtgtattcagtttttgagttgcttgcttaacaggaagccagcagcacatgctactcacatgagagttctttaaagggtcaattaatatggaatatttaatgatacacttgatactcaccttccatggttttcagagtgcctgtcttaaaatagatctgtaacagctggtctgaataaacaagcgtcgtgcttccctatgccttttcctgggagcatgggggcagcatggtttaatgggaacacttaaggtcaggagtcaggagacctgggttctagtcccagatctgtctctgacaggctgtgtggccttcatgtttccttctctttgcctctggcttctgtacttatagcaatagcagcggatacttacatgtgcaataatatactaaatagcaactaaaatgttttacacatatcaaggcagcattatggtttcatgatcagggatcaggcagaaatgattgaatcccagctctggcacttaacaacactgaccctgggaaagttactttacttattgaatctgttttctcatctgataggcaagaaattgtggaatttctttgcaggattatggtgagaatgaaaatatttaaatgcctggtacatggtgggtacttggtaagattatttccttccttctccccactgcctccccaatcctcatgtctatgagacaggaagaataagatcttatcactgctctacagaggaggaaatggatatgtgccctggctaaagggcttttctcaaggtcacacagacaggaagtggtgaagacaggacttgagtccaactgtcctaattccagattcggtgaagtttcccgttcctgctgccaaattcagtggatagatggcaaattgcatgaggaaatgactggaaaagtgctttcaaaaaacaaggcaggccctagaaatgtaaaatgagattgtattattttgaactgaaagttgttctatttaaaatgaaacatctaaaacaacgaaatttctgttattttttagtctgattagtttgtggattatttgctttttggtaattttatagcccctctactttctgtttgcttctgttttcatggaaatttgtgcaagtgaagcaattatttaaatcatcacattgtctgctcaatgttggactttgtagtagatgctgggtattcaaatgtgaatgaaactcaatccctgaccctgtgttgcttttagtctatacagtacgggttttacttcatattttcccttataaaacagtggatgggaagggagccgtttgggttagagtgaatgggcatggctaaagtttggtaggtgggtaatgcttttctggatacatagttaattttgctcatgtgtacattataccactaatgtcacaaaatggatttatttatgtgtgtgcatggctcaaggtatttctctcctgtctttctttttttaggttgaatttatgtgtgtatatatatatatatataaagttttgttataagttcggggcacatgtgcaggtttgttacataggtaaacgtgtgtcatgggggtttattgtgcagattatttcatcacccaggtattaagcctagtacccattagtgatttttcttgatcctttccctcttctcatcctgcactgtctgataggccccagtgtgtgtggttcccctccgtgtgcccatgtgatctcatcatttagccctcacttataagtgagaacatgtggcatttggttttctgttcctgcgttagtttgctaaggataatggcctccagcgctatccatgtctctgcaaaagacatgatctcattctgcatagtattccacagtgtatatgtaccacattttctgtatccagtctatcactgatggacatttaggttgattccatgcctttgctattgtgaatagtgctgtagtgaacatatgtgtacgtgtgtctttatactagaacagtttatattcctttgggtgtatatcctgcaatgggattgctgggtcaaatggtatttctgtctttaggtctttgaggcatcaccacactgtcttccacaaatgttgaactaatttacactcccaccaacagtgtataagtgtttctttttctccataatcttgtcagcatgtttttttttttgactttttgataatagccattctgactgatatgagatagtatctcattatggttttgatttgcatttctctgaagatcagtaatgttgagctttttttcatatgcttgttgactgcatgtatgtcttcttttgagaattgtctactcatgttttttgcccactttttaatggtgtttgtgtttttcttgtacatttgtttaagttccttatagatgctggatattaggcctttgtcagatgcatagtttgcaaaaattttcttccattctgtaggttgtctctttactctgttgagagtttcttttgctgtgcagaagctctttagttaattagatcccatttgtcaatttttgcttttgtatttctctctatagacatttgtacagggcacaaaggcatagagataaatcatatgaagttcccacttttagggggcgaagagaaaatggagttgatctgggagtcaggcttttgcaagaatgcagaaataaagttattggatgttataagactggtgcaaaagtacatgcagctgggtgagagagatgagaccaagaagaggacagagacatgaatggttactacagaggaagaaggtttgagaaataaaactgagtagagagagagttatgtgagatgaagaatgtgcaaagacattgagatctcagtgatgtctctaacaaaaatctattctgaacgatgatgtaggacccttaataacattagtactggaaatttggccataccatttgcatttgtcaggaaagacattgaagtacctatctttggtggataggctggagcatgagatgatggtctattctcttgaatatcttgaaagttcagggagcaaaaactatagaatcaaaatacttaatggacatctaaagtactgaaagtaaagaggcttgctctctctcctctctctaacctctagacttgctacttctccctccctcacatctactaagccattatcctccctgtgctctttagttgactgatatctcctcctttcctggtccatctggtcttgactgtgtactctcgagtcctgtcagaatttatgatcagcctttccatttttactccaattcccttcaccttctgtaacatgagatatgccagtcacctgactcctagagcaccctccttctcaggctttgctgcccttgcccgtgagcagcagagagctgttggagaaagtggcttaccaccttgcttttactgtctgtgttcactgcaacttgcccctgctttcattcacctctttgcagtgcctcataacaacaccctcttggctttctgtcattcccctggtcatgttccaacgctccaaatcccagacaccctgaatccctaactctcgcttagtaccagcaagctcaactagtcctcatcattaccacccagtcctcctgaaccctgacttgtcctcagtctgtcccattccacacactacaatggtgactattattattgttactagaagtaacagtagcaactgtgccaaactttacaagttacatttatatgcacatttttgccttctgattcccagagagagttttgggtcttgaagtagatgtttataaaattagaatctcagagagaaccaggtgctgtgagaactttgattctgagaagttggacactatacagtagaagtactttttttttgttttgtggtttccagaatccaggggtgtgcttggagagcgttatcgatgaaccagaagctctcaagtcacgtttttcagttcccagcagcacccaggctgtttgtcccctcttgcaaccagctcacagcatctgcttatttttgcaagcctgttttcagtaatgttatgattcagtagtacaactttcttttaatcatataggcaatacctgatagaaaaagttggtctagagtaattctgtcacttatcaatactccacaatgtaggtttagcagaaaactttcaaatatgagaaagcatttgttggctaaggaaagttagtaaacttagttcagtcagccacacaagaaatgcataagttgagattattatgacaaatagaactgtgtgtgtacatgtactttgggattctgtaaaatatagcaattaattcatcctcactaaggaggaagcaggaactgagagctctggagctcagaatgagtggtaacacaaaagatttgggtacttccagagacactgtttaagatgataatgttcaggcctataatcccagcattttgggaggctaaggtgggaggattgtttgggcccaggaattgaagaccagccttggcaacatagagcttatctctacaattatttttttaattagctgggcactgtagcacatgcctgtactcccagcaacttgggaggctgacgtggaaggatctcttgagcccgcagggtcaagtctgcagtgagccatgatcatgccactgcactccagcctggacagcaaagcaagaccctgtctcaaaacaaacaaacaaacaaaaataaacaaaaagaaaaaagattgttcataagtaattgttgaaaaataaatgaattatatgtaaaaaaaaccagaatgtgacataaaatgtttcttaaactacatataaatgcaacaagctaaacttcatttatgcaaatatttggagagtttctagattctgactttgagcctaagggcttttaattaatacactattctaataagcttgtgaggcagcatggtataatagaaattgtagtttccattccttttcattaagcctgtttaagtctaaggggatataggttgtaagttaaaatgggaatgaagcatagttgaaagttaaatttgcagtagtaaacactgtaaaacatggattcagtaattaaaaaaccatattaatcttggactagaatggtcctatttgaatgaaccattgtggcaattcagtttattgtttttgtttgtttgtttattttttttttgagatggagtctctcttgcccaggctggagtgcagtggcatgatctcagctcaccgcaacctccacttcctgggtttaagcaattcttctgcctcagcctcctcctgagtagctgggattacaggcacataccaccacgcctagctaattttgtatttttagtagagatgggatttcgccatgttggctaggctggtcttgaactgctgacctcaggtgatctgcccacctcggcctcccaaagtgttgagattacaggcatgagccactgcgcctggccagctttattgttgaaagagttatatacaattatagtgctgaaaaaattgttacagataattctagttcagcaacttggttttaaaaatgagcagtccaggtcctctgatatgtatacaatggtttgaccaaggtcacttggtttgccagaaccagtctaaatgcaggttttcattacagaacactaatgaccctcaagagaagtttaaatcatgtttattctcttacaatttttttttttacaatatcaggaagtacttcagaatttctcatgtgaagcacttactatgaagaccttattttctctcattcatgtatgtttttcattttttggatgcagtagtttaggggaatccgtaaaggtgagggtacagagtctcagactttggagcttagaatgttctgggagaattgaaaaagcattgaaaaatgattaatgaaaattataaaatcaaagatctgatgcttaaaggagtaaatccacagctatccaaaacttagccattcagcattactcagttcctaggagagcagttttgctattttaagccaggtaacaaaaatgtgtcccaaattcccaacggtatgagtattcatgtatgtttaggcgtcaccataagttattactcctaggttgtgagttccatgaaattagggaccatttgtttgtcagtttcctgttcttggctcagtacctggcacagggtgactgctcccatgaatggtcattgagtgattatttaatgaatccttcacattggccttaatgttggttagatgagaatgctagatattttttaatcctaggatgaaaaaattataatattctgccagtagttctgcagtgggaggcagcatgttatattgaaagaatatggactttagcattggccagacctcggttcaactcatgcaccattaggtgaatggctgtgggcaaattccttaatctctcagcatattaattttctttcttatggagtggggataattcctactgcagagtattgtgaagagtaagtgaactcagatgggcaagatacctagcacagcaccagagatgtagtggacagttggtaatcatgtgagattctttcccttctcctgtcccacaccatcctctgatcttctcatggtatagggctttcctcacagttcttttggaactcttagaactctataacttcgcttgtctatggcaaacttttcttctctgttgtagtcatctttgtgcagatgttttatttagattcattgaatataagacttggaatattgtggctttcaaaaatgatataattggcacatttgaatctgtcgatttgtctgttggcaatttcatatgtgtaacactctacccagaattgggagacctgcattccacatgactccattgctgataaactcagtgatctctaagtctccattttctctgtgatcaccagtgggtggcattttatagcaaaaaggttataggctctagagttcaaattttggatctgctgctaattagctggatgatctagggcaggctcttttccctctgggttcccttggcttcctctggaggacaccactgtctgtgctgtaggctgctgtcatgatttgataagataaagtatgacaaattcctgcctcagagctttgaatgttgtaaactcttaataaaagagtggcaaaacaccttccactaaatactattatggttggtgttattaatgtctatttcccttgggtagttgagggatccagtaatagaacataactattatagctgaagaattttagaagacactgagcaatttcttcaaggtcacataggaagtgataatggaatagcatgtagttgtgaaaatgaggaatagtccatcttattaatatgctccttatttgtggaatcagttatttggattattttcagtccttctcttttatggatagcatgactgtccatgtccttgtgcagattattttccccctttggattttttccttcagctttgttttccaatgcgaaatttctaggtcaatggtcataaacatttttgtagctcctgttaacatattgccagatagtgtgcagagaaacagttctagtggacaaaaagcacagatttccaaagtcttggttaaaaacaaagacttgagtggcatgtagattttattccaatctcagtcacttatttgtgaaatgactttgtacggattacttaacccctctcaatctattttctcatctgtaaaatgggataaaagtagctacctcatgatactggtcaagctattattgcagggtgtttatagtgctcagccttcattatcttgaatccatgtctgctcctctccactctccatctttcacttggaccactgcctcctaattagtctccctatgtgtattctacctcatgccaatccattatcccatctacattgtcagtaatcttgataaatagccaaaacattaatcttatcgagtgaacccctttgtaacccttagaatgcttccccatgcttggagtatggaccctgctgccctccccagcctcaactccctcctctcgctcattccataaacagccattcccagaatttatcacaccatttttttcttctggagttggaacttgccattttcttttgtttcttggtttccaaataccccttgtatacatcttatccttttaaatattatttttgtgactgtttttcttttctttctttctttttttttttttttgagtcggagttttgctcttgtcgctcaagctggagtgtaatggcgcgatctcgattcactgcaacctctgcctcccaggttcaagcgattctcccgcctcagcctcttgaatagctgggattacaggtgcccgccaccacgcctggccaatttttgtatttttagtagagatggggtttcaccatgttggccaggctggtctcgagcttgacctcagatagtccgctcgtctcaacctctcaaagtgctggaattacaggcatgagccaccgcgcctggacgtgactgatttttctactagatctaagcttcacgatggcaggggccacttatatttttattcactgttgattcctggggatcagcacaatgaccagcactagtgctcaataaatatggaggaatgtataaataactatataataactgttattagtagcagtaaacaagagggaaataattttagatatttgttaaatgcctttgtaagtttaaattgctctgaaattaaatatgtaggtgtttttcaagggcctctaaaaaattcaaatgtatcttgtaattaaataagatcttgtttttttcttatataatctttcatgttaatgagggaaagtctgaagagagggcaaataaacatagtttaatatctatcagcttttcatcttagccagcattcttcacccaagccctataataacattacctaaaccatccaggtggctgggcatagaatcatcttgagccaaatagcagaaggatttaatgatgaagctgaacattcttaaaagattagattatgcctggtacatttcctttcatccgagacctcctgccattttggtttgcatatcccaaaagtgcaagctatttcatattacactcttaacttccgcaggttcaaaactgcattttgtggctgggcacagtcgctcattcctgtaatcctagcactttgggaggccgaggcgggcggattgccagagctcaggagttcgagaccagcctgggcaacatggtgaaaccctgtctctactaaaatacaaaaaaattagctgggtgtggtagtggacgccaatagtcccagctactcgagaggctgaggcaggagatttgcttgaacctggaagagggaggttgcagtgagctgagattgtgccactgcactccagcctgggtgacagagtgagactctgtctcataacaaacaaacaaacaaaaaactgcgttttgttcattcagaaatagagttcattctttcattcattcagcatttatttcacccctacaatattcaaagccctcattaggcactgaacatataacaaagaattcaggttataagagaggtatattttggaggatacacactctccctgtatctcatgtttacctgtggaagaacttttgttagaatattagcatatacctgggtatgtatatgtaacttagtttcttctgggtcttctctttgagacttacttacctgcaaagatggcagtggttttacagtctattctcatttttatgacaagctaagcagagtaggtcatgtctccaagggagaggcttaccacatggggagagggtaagtagaagatgagagggggtccggcatccttaagccacagtttccaatatatgttaagttttgttaataaaaacacctacatttcgatctgttttctgtatctttgctccttgggtttttcactcagtaggaaagaggagtatttattattttgaccttgggagactgtgaagcttatggcagcctagcctacaggcaaatgactgtcaaaaccaggcacagctgtttgtgatgggtgtttaggccttagcaagtgcaggatgcactggtcctggcaagtggagccatgctgggctttgtgggtgggctttttgggttttgtgggcacagcttggactcgtgttgcaggtgaggcttaggaaggggtttgacatttttagtcatttggggtggaatagcatttgctgcttttactgtatttcagtcaaggctctaggccacgacttcaaactgtaaaagccacagagttttgttttgttttgttttgttttgagacggagtctcgctctgttgccaggctggagcacagtggcaccatctcggctcactgcaacctctgcctcccaggttcaagcgattctcctgcctcagcctctcgagtagctgggactacaggtgtgtgccaccatgcccagctaatttttgtacttttagtagagatggggtttcaccatgttggccagatggtctcgatctcttgacctcgtgatgtgtgtgcctgcctcggcctcccaaagtgctgggaagttttaagagtgctattgtgtgaggttctttctttaaattgtgagagacaagccaaggaaatgataaattggcttcaccacattcacttaattttgttctaggccaaatgaaggccctggagggactaatcttatgtaattttgtagtttatctacaaatcttaataggccacctgtgatatgaccaacctcaactgactaatcaagagcagaccaagaaagcatcctctgtatacgtatatcaaaacatcactctatatcccataaatatgtaaatttattacatatgaactaaaaataaaaaggaaaaaaagatggccagaagtgactggccaccaagactctaagagtaggagatctggtgtgccaaggaaaaaggaattgaatcagaactaagtcaaaaaggaacacatcctctctgcagagaagcaggtctcaaagacaagacctgtgagaagctgaactctacactgcctagggggaagaagcattgttctaataccccaacagaagttcctctacaagaaaacgtgagttttgtttgctctggatttcataattaagttctggccattaggtcatggaactgtagctgtaaaagatgttggattttgttatttagcagataaaaaggaatgggggtggcccttaagaaatatatggcatattcttgggttgagatagacaagcaagtcagtaatcttattgcaaaccagaaagttaagaagatgattacaaaggccgggggttggtatggattctagagatcaggttttcttagaatatcaaggagaaagtagaattggtttgaaaaataagttttgttatgatcagaaaagaagcagtagtagactgaaaagactaagctaggagaaatgttcacatttcatgagaggtatgaagggagaaatgagatcttaagtcaggatacacagatataaaaaggaaaagagatcactctaatgattaccaattagaaagtgtggtgggcctgaagaagtgagacaagatctgaaatttttttaccaggttcagaaaatgttgccaagtgtccctttaaagatgtagtgagagtctgaagtatgatttgtaaggccaagggctggatatggtcttgcattttgtacactgagtaaagatttctgctagtagaggttgaaatgcaactgctgtcttctcgctgtgggatctcaccagggtttacatctgtcctggaggggtactttcttctagtttgtataaaatattcatcatctcactaggctagtgttggtgaccctgggatagcaatatcaagtggttacagaaaagttgcatttgcaggggaaagcccagcgatgccagcataacatactgaagaattcactgagtttcaaggtgttaacattactgtgattgggcaggcaggtatcacttgcacgctgaaggaacattctcaaagttttttggagttcagactctaaggggaggcaggaaaagatgaggggtattctaggaggagacagtctagggctggctggatgtggcctgatgagagtcacctcctgactgggattatgtaacttgggaagtgaaggttgacaagatttatttaaataatgcattttttttggtaggggagatcatattcagaaccttaaaattctctgtcatctgggagattttatgataaaacattgaggaatatgttagaaaatcaaatatctggtgcaggaagttaaagagaaagtaagccatttatttctacccaacagtgatagctctaaagaggaagagacaggaagatgggaggagcctctgaagttttctcaaaagaaaatgggatcagtgtatgaaaatttaacatgagggatataccctacttctggcaaaacaaacaaaacagaagtactgaggacctggtcattaaaatgtacagaaactctaatcttttaagtgtccataaaaaggtgtagctcgtcacaggccccgaaggatgttggcctcggaaatggttctggaatcaaaagaagttctcgaatcttctagagttcacttggaaaaaatgagaggactaagagatgaccttcctcaggaagcagtttttacagcccaaagcaattacacagcaaaaagccgttgcaacagatgctgttgcccaagactaaaaatttctgcttgtaaaagattgtgaagatgatgactctactacgcagagaccacattcagtttagtcctttagtactagaaacatgggactcagaagaagtagaagataggaaatttagaatgtgcgggctgggaaagaaaggttctacaaatagggcctggagggactacggttgccaccactgcaaatttctgaactttgaaagaagtgagtgatgctccaaatgccaggctttgagggagaagacactttgcaaagtcagattttttcctgccagtatgcatggggccaaaattaacctcctgcttgaagatttcttctagttgagggtttttttttttcaattgtgctaaaatatacatagtataaaacttaccattttaaccatgttgaagtatattgttctgtggcattaagtacattcacactgttgtgcaatcatcaccaccatccatctccagaaccttttcatcttccccaactgaaactctatacattaaacaacaactccccctgaagcccctggcaaccccctttctactttgtctctctgaatttgactactctagatactgcatataaatggaatcatacagtttttggccctttgtgactagcttattttatttagtttaatgtcctgaaggtttatccatgttgtagcctgtgccagaatttctttcctttctaaggctaaataatattccgttgtacagacaccactttttgtttgctttttcattcattgatggatacttgtctcccaatcgagttttaagctttagaaaattggcatagtttcgcaggcatcctggcaaggctgaaaccaggaggactttgtttttatttgtagaaccttctctatctttcaaatgtcctggagtttctgctgttgtctttggaagcaattacatggctctgggttatgccaaattctggattctgggaacactggcttgcttgttgtggtagctacttcatggcctgaggattagctttccttttaaatattgtgggtgtggggcagatgatagtcttgcctgaccttataattctttggtctctttaaaagtggaggatgtcaaagatttgagataacgttgactcaacatctgaggctctgaaggaactatactttcttcattacagcttgaagctgtttcaaaacaaacaaaaacaacaaaaacctctacaattctacccaggcatcaagagctcctccagctggtaatatagaatacgaaatttgagaggatgaatttgacctttaatattgttggactttgtattggatatctttcctccatcacttcaaaatcgtcttgcttggcctcttattgcaaccacagctgcagtagacagttccatacaagcttccaagaacttcatgggtacatctggagagcacctcacctggggccacattctctacctgtcctgtcttactcttcctcctctgggcttctttctggtgcatgggggtggggggagatattaagtattccccaagagcaatggtcagtttagtaattcgtctttgtatttttcttccttccttccccatttttaatctgctcctcaggatcacttcaccaactaaatcctgcattcaggattttgtctaaacttctactttctgggaaactcaggctaagacagactatataaagatgctccatgacttagatggggttatgtcctgagaaacccataagttaaaagcattgtaagtcaagactgggtgttttgtagacatgatgggatggaaaaccaaaaaacactatatccaaaaaatgctggcatcacagttacattgtagagtattggttgtttaccctcatgatcacttggctgactgggaggttttgcttgctgccgctgtccagcatttcgagaaagtacggaactgcatattgttagcctggggatagatcaaaattctaagtacagtttctactgaatgtgtacctctttcacatcatcatgaagttgtaagttgaaccatagtaagcctaggaccatctgtgtaaaggcaagaaaatttgagtctagaatttaattcctttagaatttaacatttttggacttgcaaggagatttagtttctagtctttaatatcttaatggaaaactaaggtttatatttaaaattggcgctgttatcttagtgtttagaaaaaaaaactagacaaatttaacacagtttaatgaagccaagaacgatttgcaaattgggcagcccccagaaccagaataggtccacagcgattctggggctgccacatgggaggataacatttatggtcagaaaagggaaagtaacagaaaatggaagtgaggtacagaatcagctggattggatatagctcagcgtttgccttatttgaacacagtttgaacagctggccacctgagattggctgaaactctgtgattggctgaaactctgtgattggtacaagagtaggttatggtctatttacacatcccattaggttacagttcactgtgtccatatgtgcagataaatctttaggccaaaattcctttttcattgttcttttgttctgtaagtgctcattaaatgcccagtacattaggagcctttgaggtaatcaaagctacttgttgacatgagaatatttgagtacttcatgggtttagtgtcatgagataatatcacataaaccctttgggtttaccaaaacaggaaacatggagagaaaggacaaccaagtcatccactgggcacttctggattgttctgacatcctaattatgtccctaggctgcaagctcttccctccatgcctgcttcctcttccatttctgcccctttcttatctacagacctgtttctacagggaacagatatttcagtctttgggaatttatccctattccctagccccccaaaaaacccacccctgtggtcctgatagtttcctcccttgagaatctagatccctaagacactcctgcctctcgccttcttggtcccatctggcggctccttcctcctcagctttccttgagtttagggctggcccttgaccttagtgcctgaaggatagaaggtggggacatttctcgaagttggttagcctgttttctggctcggggatcgcctcctcttctgtagggtaattgtttcccattttcattcttacccttcccaccacctgtttatatatgaagggtcaagaatacctatagccctgagtccatcctccctggctccccaagaaggttaggcttgattccatgccaggcatgttgagaagactgcagacatgctctgtgtgacagagtgcattttatgatgcttcaaagcaaggaggcaaagataaaatgatttcatttttctattttcagcttttttgagttgagggttgctggcctatgaacttgatcacaagagccttatttatttggaaaaatgtattctaaattctaaggactagacatgttagtgtactacattctaaaatttttcttaaattggggcctacctatagtgtatagatattaatgcagtcattatattgtgttaataattgggactacaagccttaaccagagtcttagaattttatgaattttaatttataattttattttaagggtgccactagaaaccttgtgattaactttaagggctttttggctgtaatgactgtaattaggataattatgcatactttctttagcattgtgtcaacatgatagtgagggcataaacagccaagaagcagttataggtattccctgctcattttgcattcatcacacattcattgaatgttttgtacttatctcaaatagtagaggataccaatggtgtaagtttaagaattacatggttcttgtcctccagaaaccatggagtccagcaggaaggaaatgacatactggtatttggcaggcagagatggaagtttggtttgaagaaaaccttttgtgctgatgttacagctgctgcagtcactagccacattcattgtgcaaaggctggaggattccacagtcagcatggaagggaccaattagtcatgcgtgggtttcatccttgcctctataagaagtaacatctcaatagtcatggtggtgttttgaatttaaataatcacacattatttcttggtatgtttttcagatcgccaaatattgtggttttgtgtcacatgtgcattatttgttaaaacaggattatggtgtgaatgatggagctgtttttttggggtggcggtggagggtgttatgtttagactgtcactcttgctaggcatcctttgcctgactgtgtgtaaggtgtggcaatctcagtagtcacattggccctcccatttcccgtagtctttggaaatctgaccggcagcattgagaagtaagtaaaaggggtgccctctcagatgtcccttccttttaaggaatgatgtgtatcaaatcacaagatcggtcggggaaggagcagcgtgacacaggtgtatcttttctgtggtttgcgatgaggcataagtgcataaattccaaccaggaaaggaagtgcagggaattctactctcaggacatccttatggtcctgacaacttctttggcaatgtcagcagcccttggcattttgtcatgcattcttctccaacttgaaattcaggcttagtgcatgcagtatgccacagtcaggcttgtggctactccaggaggggagctgtgactcattcttgagtcacttggccagctttggtttcaattaagcaaatgaatgaaaacaattaaaaacagaagttgccgactaaggctaataaaagggcagcagtaatttttgtctactgtcactgttgtttctctagattgtcatatctttaaaaactcggtaagacaaatctgttagtgtttgattttagatttcttgtttataatctaaaaatcagacccagaatctgatttacctttttggttctaatctagttatattgtaattctaacactatgcacaactaatttatatattaaatatagaatttttcattggctaaatgcactttcctcaaatttgtaagaggttttccactattcaaaagtgttacatgttgcattaagtcattgttgattattcaaattattttcagatttattttccaagtactaaaaaaaattgtgggtgtattttcaggatgttttatctatcaattcatatttttgagcccctcctctcccttctcaattcacattttaaaaattattagttcatcaaatctaggaactgtaataatgtcctacgtttacttttctccccaaatcataaaatttcagtaaagtttccaaaaggggcataaatgtgtcctcatctctcacacactgaaaagcaaaattcttcaactgatggggtattttcacctctttgatgtctgtgtgcctctgtcatcggtgtagttcagagccttatctcccttccattagaccatcacctgatataccatggtttctttcatctccttgtcattgtaataggaacacctttccctttgctggttaactcctatttctctgcaaaatacagcataggtaatggccttggttggcctgtctgtttttggtgcctctcctgtgtgcctccctagcacttcccctttgtcatggtgcacaccactgcaccctattgtccctttgcctctgcctaccttgctgtgaacttattcaggtcacggatggtttcttactcatttctgtaactgcaatgagtaagtgagtgaatgaaatgttcatcctcattctgatggggaaacttatttctaattttagggactgaggaccaaatttgtgtatttgtcagacctggcttttcattttctccaaccactgaacatttcagtgctcgtaacactgtaggagagagtagaccctgtggtctctgtgcagtaggtgctgctgctcctttcttcctggagaattatatatttacttctttgatataccttatcactgtgaattttatttgctgactggcagtgtaaactctggctttctagaggtttatcttaggaagaactcaatatttattcacttgaatgaaatcaaataacatttggcttaattgctttaaaatgaaggaataattagaagcaactgctttgctttggagaactgtaggaaactgtaatcttacagctgtaattgcccccaaatggagaagaccttaggaatttatgttgaaagtagaacactgccaattgttctcattggcaaattggctgatatgaatgtttgccaaccggaaacttgccccatcagttcgcgtaatctgtgggaggtgaatatattttatgaagaaaagtgatagagggaaattagaggctattgttactagtgtgtgatgggttcatgtactaccaactcttctcctcaaagctgcagatagcctggtcgtgcaagaatttgtttcttgtagcacgtctcctctcatttgcctcgctgtgccgctatattttgtttagcatgtgcttttctcttaataacaacacagtgattcacaaaattccccagagtgtgtgttcagtctgaaattttctgaatgtgatatttgaaaatgctaaatacagcatataattaaaatttcagtggttaagttttcatcataacttatttttggaactaagagtttccttttcgagacttttgatgtgtaagaagggtacagtttttaacagagctacctgtgtttgttagaactatacttttttggttagaactatacttttcataggagccgttcctcctggagacacatctttgtctgaaatatttaggaattcttaagtaattgttgctaatactcatcttagttaaatggcttaaaaaacaattccacatatgaaggatgcacacacacatacacatagcctgttttgttctgtttctgttttcacaggaagaaaaagagtggcaaaatatatcttctgctctgttctaagggttttggtccagatcacaagtctcaggattcttagcagcagaagagtttatgattctaagtagaggtgcatctgtttcttgttgtaatattaatagatgacatccaggaaagtcttgggttttgcaatattttcatctagccatttcacagaatagagaatttatccttattctaaaggatataattatttaaagaataaaccatagagttcttataattccaagataataagaatagaaggcacttttgaaatttccttgaataaatcctaatttcttggattagaattaaacagctttttgagtatggtcactgataatgtcagaaactgttttgcattcaacaaagctggccagagaccagtggtagtgctttcatcttttggtctgatcactattgtgagccaagctcctgctaagggccaaagaagaaactgtaacttctgtactcctcttatgactgtggaaacattgctttacctacagatagcatgctttttaaaatcgcaattttcaagtaatgagatttaatttttttttttttttttttgagaagggtctcattttgttgccctggctggcatggagtggtgcaatcatggctcactgaagccttgaattcctgggctcaagccatcctcccacctcagcctcctgaggagctggaactactgggtgtgtgtcatcatactcagctaatttttaaatttttttgtagagatggggtctcagtgcattccccaggctggtctcttaactcctgggctcaagtaatcctactgccttggcctcccaaagtgctggggagattcaattttcatatgtcaattaaatttacagaatttgcaaatccaattgcaggaaatgggtagatgagctttaactttttttctccttctaattgctaaccttgaagtgagctaattaatgtagatggactctgaggacatttatattcagaatttgaaatggtcagattttcaagagcaatgagtctaagatatcctttgcttataaagggtagaggaggaccaaatagtttctggagaaaggttatcttttgtactggaaaaaaaaaaacacaaaaaaaccaccacaccaccaccaaccaaattaaacctaaacctctggcaaatatgagtattgtaagcaaaacaagacaataaaataaccacaaaactgaataatttagaaagaaaatatttacactgtactgtcatttaggcctcggaatagtaagaggtttttaatatattcacacacgtttcattatttggcataaatttcttatacataggcatatttattggggagatatattccttaacattgggatatgtattagtttcctattgctgctgtaacaaattatgacaaatttagtggctgataataacccaaattcagtattttaacagctctggaggccaaaggttcaaaatcagtttcactgggctaaagtcaagatgttggcagaactagtttttttaagaggcttcaaggaggaaattaattttcttgctttcttcaacttccagaggccacctggattctttgccctgtggccccttctttatccttcaaatcacatcactgtaatgtctgtttccatcacaacattgctttctcctgttctgtggtcaaatcttactctgcctcctttttataaagacagttgtgattatatttaggactcacccaggtaatccagtataacctccctatctcgagatctttaattatgtctgcaaaatcccttttaccataataaagtattattcattggttccagggtttgggatgaggacatctttggaggctattattcagcctaccagcatacttacaggtccttgcagcatagaccctatggagctgtgttctgtaaatcatactgcatagttattgctttgttcccatcaaatcacctgaagtctcacatgtttctgcatagtctctttcaggttttgttcatgcaaactaatgtcactcactcctgggcagaggacttctgccagtttctccatgactgctacataaatcactgaattatagtctcttcagctaccacttctaaggtgtcattcaccttgaactcctgagaagtatgtcttaatgcccgctcttgaacttgtgtggcatctctcgtgctgtgatttgggtaccttttgttagctgttgtgatgaattaacattattaccagcacataaagtaacatcagataaagtaaatgaaccaattgacatgccactgaagccggggaaaacacaagtgtgggcaccaggaatgcccagtgcagtgtgccaggctggctcttgttgcctgtatgggtgtgagagctatcgttgtgctatgctggttggccataagaaaaacatttattagctgtactgttaagaatgtaatagatttctatattttttcatatagaactgttctcagattagtttcataaggaccatgcttaatgttcaaagcacaaatttgaaataaaatggtgaggtattgaattactgagagttagtccctttgctaaacccccaaatctgtggtttggaattagggctgcttccatagtgtaatgctagttgttgttactctcagcatgagctgactgttaataatggctgtgtaattttgagcagaccacttaagttctctggtcttcattttctttatttgttaagtaaggaataatttgactacaattctttatgacaatatttcaatcacgtgttttaatatccatggataatctaaaatatgtaaagtataatctgtatcatttgaatagtctaaaactatttatgttggaaaattttaaacatacacaaagagaatatgaactgtcatgtacccatcacctggattcaacggttatctaggttatcacatttgcttcaactatacccctttattctttaaaaatgtatattttttatttttaattggcatataataattgtgcatacttatagggtacaatgtgatattttgatacatgtattcaatgtataattattattctgcctaagtattaaagcaaatcccaggcatcatgctgtttttgtccttacacgctttgatatgcatctttaaatttttaaagattttcctaaatagtcagaatgccattatcacatctaacaaagtgagcaatttcttattataatctaacatacagtccgtattcagatttcttagattgtctcaaaatgtttcctctacacttggctccaaagaaggatccaaacaaagcccatttggatccttactgcatttgaatattacctgtgagtcacttttaatttagtggtccttttctctaggtagtaacgagatcaggaaacctggtcacttgtctcgtagactatttcacattctgtatttgttgtcttgctttctcatggtgtcattaacttgttcctctatatattataataccttaaaattgaatattagctctgaaggcatgaacagattaatattcacctatttttgctaagatacatcatagccgatgcagtgtacttcattttgttccacatcagaggtaaataatggctggttgccccacacgtagatttgctaagattgatcggtgggtttaggtggtgacagtatcatctcttcaatataaagtttttcattgacttttcatcaatcatgtcatttattattaatctttgcctaaaacaattttttaggacttgcaaaatggtggttaaaaaaatgtcattagttctttaacattttttgactggaattcttttgtaaagaagaatcttttcttatcgactaggtaaccctgaaagtgtaatacatatgggaagggcagaagtagttaggtaattattttcctttgattaccaattttcagagtatgtcatttctagtaatgactaattgatttctttttggaggggaggggcagactttctattgttttaagtctcattctgagctagtgggtctttatatatattcaatgtgttttttatcaaggtactcataattctttaaaaaaattttttagttttaatttttgtgggtacataggtatacatatttatggattacatgagatattttgatataggcatgcaatgtgtaataatcacatcagagtacatggggtatccatcatgtcaagcatttaagctttgtgttacaaacaatccagttatactcttttagttattaaatgtacaattattttttactacagtcaccctgttgtgcttgcaaatagtatatcttactctatttttttttgtacccattaaccatccctacttcccctccaaccacccactactcttcccagaatctggtaactatccttctattctctatctccatgagttcaattattttaattttttagctcccacaaataagtgagaccatgcaaagtttgtctctctgtgcctggctcatttcacttaacataatgacctccagttctgtccatgttgttgcagatgacaggatctcattttcctttatggctgagtagtactctgttgtgtataagtaccacattttctttatccattcatctattgatgggcacgtaggttgcttccaaatctactttaagctgataacaaaactgtttgcacaagcaaacaaacaagcaaaaagaaaactaataaatttctacactttttaacttcgtccctccactttttaactctttattatttctgtttatatcttattgtactgtctgtctggaaaagttgtagttattatttctgattagttcatcatttagtctttctacttaggggagtttacttactatagttacaatgttatataatattctgtatttttctgcgtacttactattaccagtgagttttgtaccttcagatgatttcttatttctcatttatgtccttttctttctgattgaagcttttaacatttcttgtaggacaggtctggtgttgatgaaattccttagcttttgtttgtatgagaaagtctttatttctccttcatgtttgaaggatattttcactgaatatactgttctagggcataattttttttttttttttttttgagacagagtgtcactctgtcacccaggctggagtgcagtggtgtgatctcggctcactgcaagctctgcctcctgggttcacgccattctcctgcctcagcctcccaaatagctgggactacaggcgtctgccaccactcctggctaatgggcataaatttttctccttcagcactttaaatatgtcatgtcactccctcatggcctgtaaaatttccactgaaaagtctactgccggttgtactggaattccattatgtgttatttgtttcttttttctttctactttttggatcctttctttatctttgatttttgggagtttgattttcaaataccttgaggtagtcttctttgggttaaatctgcttagtgttttagaaccttattatacttggatatcgatatctttctctacattgggaagttctgttttattatccctttgaataaactttcttccttatctctttctctacctactctttaaggccaataactcttaggtttccctttcgagctgttttctacatcctctaggcatgcttcattgttgtttattcttttttttcttttgcctcctctgactgtgtattttcagctagcctgctgtcaagctcactaattctgcttaaacaattctgataaagactgttgcattcttcagtgtgtcattgcatttttaaacttcataatttcgacttaacctttgaaaattatttcaatccctttgttaaatttatctgatagaattctgaattccttctttgtgttatcttgaatttctttgaatttcctcaaaacagctattttaaattctctgtctgaaaggtcacatatctctgtttctccaggattggtccttggtgcctaatttagttcattaggtgaggtcatgttttcctggatggtcttggtgcttgtggatgtttgtctgtggctgggtattgaagagttaggtattgtagccttcacagtatgggcttgtttgtacctatctttcttccaaaggctttccagttccaaaaggacttgggtgttgtgatctaggctgtatctgcattaggaggcaccccaaacccagtaatgctgtggttcttgtagagttgtagaggcaccgccttgatggtctttgataagatctggaagcattctctggaccaccaggctgaggcttttgttctcttcccttactttatcccaaatagagtttctctttctgttctgagccacctggagctgggggtggagtgacacaagcacccctctggctaccaccaccgggactgtgctctgaagccagtatagcactgggtctcacttaagacccactgtaaccactccctggctactgctgtgttctttcaaggccctggtgtcctaccatcagcaggtggtgaagccaggcttgtatccttcccttcagggcagcaagttcccccaggccccaggtgggtccagaggtatcatctgggagccagggactggagtccaaaatcttagaagtctacctgtgttctattgtactgtggctgagctggcatacaaaccacaagacacagttcttcctactcttccctcccctttccacaggcagaggagccttaccccatggccagcatcacaggcccacagggagtactacgggactaccaccaatgttttcttaagggccaagggctcttcagacagcttgtcattaatgctacctgacctgggactccccttacagggcagtgggctctctgttgctgggcaggtccagagctaagcctgtaattggagaccccccagagcccacttggtactatatccccctgtggctgagctggtacctaaggtacaatacaaagtcccctttgctatttcctcttcttttttcaaacagaaggcatctctctccatagccaccacagctgggaatgtcgtgagtctcaccagaagctagcaagtctcagagtctgatctgaggcccatggtgtactacctgggtattgataatggttattcagggaccaagggcactttagtcagaaggtgattggtcctgccagaactgagtccatcgcttcatggcagtgggttcccttgtggcccagggtgtgtctagaaatgttgtccaggagctagggcctggaaagggctcatgactgtgatgtcctatcctgctgtggctgagctggtatccaagatgcaagacaaggtcgtctttactcttccatcttctctgctgaagcaaagggaaggattctcttttggagctgtgagctgtgcagcatggggttaggggaggggtgtggtacaagcactcccttagttgcccagctggtgtttcagtaggttgtgttcccccacagtcccctggctctgagcccagttcaacactaggaatcacctaggagttgcaatccctgtggtctagactgcctttcaagtttatgttgggccctagagcactttagcctgtggtggtgaggcttgtgggacctcaagttctgactgctgagatggaaaattcccctctggccagggctggtttaaatactcccttcatgggcggacttcagctgagttcagcctggtttggatttctgctgtgatggggcaacactgagttaaatgcaatgcctcgcgcttgctgcactctttctctaccatgtgcacagattctctctctctaccacacagctactaccaggagatgggggaggggtggcatccatgattcaagactgtctttcctatcctcttcagtgctgctttcagtgatgaagttaaaaccaggtactgtgagtgctcacttgatttttggttcttatgaaggtgattttttgtgtagttagttgttaaattggtgtctttgaaggagacaattggtgtagccttctattccaccatcttgctctaccccctacccattattctttttgaagttcaacttgtcctatgtttggccaatgggagccccttgttgattctttttgttttgttttgtttttgtttttgagacccaagtctcgttctgccacccagactggagtgcagtggcacgatcttggctcactgcaacctccactcccgggttcaagtcattctcctacctcagcctcgcgagtagctggtattacacgcacctgccaccatgcctggctaatttttgtatttttttagtagagatggggcttcaccatgttggccaggctggtcttaaactcctgacctcaggtgatctgcccgcctcggcttcccaaagtgctgagattacaggcagccaccgcacctggccccttgttgattcttgtaacaattttttacattagtttttaaaagatgcaagagatacatctctgtttatatatacgtatgttatatatgtaacatatatatcatatatgttatatatttatatgtgacatatctgtttatatatacatatatggtatatatgtaacattttttctttgatttatttttaattacatagttcaatagcattaagtatgtgtccacattgttgtgcaatcatcaccacaattcatctccagagctcatcttcccaaatgtaaactgtgattctgtaacattaaacagtaatttcctattcccccttcccctagccattgacagccaccattctactttttgtacctatgcatttgactacactagatacctcatgtaagtagaatcatacatttgtgcacttgtgactagcttatttcacttagcataatgccttttaggtttatccatgttgtagcatatggcagaatttccttcctgaaatttaaggttgaataatagtccattgtatgtatacaccatattttgttcttccatttatatattgatgaatacttgagtttctttaatcttttggccatcgtgagtaatgctgctctgaatacgggtatacaaattcaacttttaaattaaagtgtaatattggtttgtaccttctttaaataattatacagcttactgaatattcacaaactgactctcctatgtagttagcataggatattaccagcaccctagaatctcactttggtccctccctcaggcctcaaaggtacttctatcttgaccgtcaacgctaagattagtttttctgatttcttttttttaagtgtacgtaaatagaatcacacataatgcactcttttgtgtctggcatcttgtgttcaatatcatgttttgagacatatccacattgtcccatgcagcaatattttgttcatcttataaatgtaccatattttatccatttttctgcttccaagttttagtattacaaatatactgccttgaccatcctgtacatatcttttgctgaatgcgtacatatcttttgggacacatttctgttgtgtatagaactaagagtggcttttaactgtgtcgctctagctgtattacacagcatttgccagagtttccctaaatattcttaatatcgttgtgttgttctatgtttaatatttaatatgccaagggttctcagggaacatatggtcacagttttttttcccccaatggtgtctgtaaagaaacaggataaacatttcaccatagcatcaactttccaaatagatatgaaggcactgtttttagctactgtcagttaaatcagtttggtcatgtatgcaatgcatttacagtttcttaaattttcttagtgtgtattgtatttgcatgatcagaaattctaaagccatagatatttttggtggtggtatgctgagaagttgacaaaagttgagaggtaaccaggaggtaatatttcctttttgctgatgtggccacttctatgtcattaaagccctgtcagccacccagaaaaccagctatttcttttaaattgagtgtttacagggttttttttttttttgtcataatatcgactggagggtaaaatttgttatcaagctgacatcatttagtaacattcaaaattctttatgtggaaacaatttataacaattgatttgtaatttaggcatggacatttagttttaaaatagcgatgacatagatttacttatttttaattctttgccttcaaaactgcaatgggttgttgacaaatttctgtcacttctcaccaataagattctatagggaacgggagagaagaaagaggttgtatccatggccatgtcccttctccagaatatggaattacatgttctaaaaactgttctaaaagctccagagtgaaaagtccaaaacagtactgttttggttgatttgggctgctataacaaaatactgtaggctggggagcttataaacaacaggaatttatacagttcttgaggctgggaaatccaggatgaaaataccagcagatgtggtgtctggtaagggcctgtttcctgatttatagatggcaccttctcattgtgtccttacaagatggaagggcaaatgagtccccttgggccttgatatggttaggctttgtgtccccaccgaaatctcatcttgaattgtaatcctcagatgttgagggagagacctggtgggaagtgattggaacatggggcagtttcacccatgctcttctcatgatagtaagtgagttatcatgagatctgatggctttataagcatctagcatttcccctgcttgcacttatttttcctgacaccatgtaaagaaggtttttgctttcccttcaccttcctccatgattgtaagtttcctgaggcctcctcagccatgcagaactgtgagtcaattaaacttcttttctttataaattaaccagtcttaagtatttttttttaatagcagtgtgagaacggactaatacaggcctattttataaggtcactaatttcattcatgaaggctctgttcgtatgacctaatcacctcctaagaggcctcatttcctaataccatcaccttcagggttaggatttcaacttatgaatttagggtgggaggaagacacaaaccttcaaaccatagcaaattctgtgggtaggaagatcaggcctgatgcagtgggactcattattagttgggggttaagcaattccaaaacaaaacccaaacgcacagaaatataccatatgagtccatttatatacagttttagaaaaggcaatttaacttataatgacacagagcagattggtagatgctagagacaggaagggatggaagacagacatgaaaaaagagcataaaaaaactctgcaagctgttgagggtgatggaaatgttcactcccttgattgtggtggtggtttcatagatgtatacacctgagataactcatcaaattgtgctcttttttttttttttcttttttttttttgagacggagtctcgctctgtcgcccaggctggagtgcagtggcgcgatctcggctcactgcaagctccgcctcccgggttcacgccattctcccgcctcagcctcccgagtagctgggactacaggcgcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccaaattgtgctctttaatatgtgcaatttattgtacatgagtcacacctctgttaataaacagcaatgatgtaaaatgtttcctcttaatgttcttaaaaattaagttgatgatggttaggaaattactattttttaggccatgttgcaagaacaaaaagctcagctagtatactttatacaatataacttgtatagatatatattcatataaaactttaaaaagtgaaagtcacaatataaatctcacagtgtactcaggatattgctatttctgttagataatagactttcagtttttaactttggtaaaatatgcctaaaaatcccttctactgcctggataaactcagtgattttttttttctggatactgacacaaaacaagacattaatttcctccttatggaggtttttttggcagtcagttatataaatatatattatgatacagcttgatgtggacagcacttgaggtgtgtgcaaggtagagtgatagatgagcccagtggaggcaactgtcaaccctctggctggagtgaggtgatgtgatatatgagggactggttgttttcctgaatacagttttgacagatcaaggagatacataatctaattcatgcatttcacaagcactgaatcttcctcagaagaacttagtgtctattccttgggtcatgtttgtgaggcaggttgaaggcctggtttacacaaaaaagctgagaagacattaaataactaggttaaggttatcctccatgaactagtgtaatagcaaggaatagcactaacattttaatttctcatacttttaataccttttttcctggtttttacagattaagaaaatcaaaacgatatatttaatgccttcttatttgcaaattttcttagaatgttacagtagataatttcactttagaactaaagattgggaggatttttaaataataaaataatttcagatgttaagaatgtttaccaccataatttccatttaaaacattttcctctggatgctttgttgaaattaggaaatgcatctctaagggatggctggttatggagtgatgacttggctgtcaggcaggtttcatgtttgagtagaataaactttcctaccactttccagaactttactgtgtccaggccgtatgtgtagttctgggatttagctttttaggcaaacattcttacaggtggtttctagctttttatcaccaggaaccttcttacaatttagagggggaaaaatagccatgtttacctttccccagttccttaccctctgcaatatgagaagtgctgtagggaaggcataagtgaagtattatgcagtgtgtttcactaaagtatgtgatgcagtttaaagactggagtagagtgttgatacctggcaattagcctggtggatcaggtcgagagtgaaggcccagaggaaggatacatagatccttaaggccaggctttcggatatctgcagcaagcgatgagagagcggatgggattgcagtagccgtgtatgacacgcagatgaacttgcaggaagccactgaaggattttaagtaggaaaataatataattggaattttgttttggaataatcttgcaaggagcagagtgaaggtgaattgcagtagagagggaaaccagttaaaaagctttatgatagtatctgtacaaaatacaatattaattaaaatactaataagttttattttatgctatttgcttattttgtatataacacatgtgagatgtgaagagaataaagtataaataaggcttttgtctgttctcagctagcttaaaagctacaaaggagatatatatatgcctcatttatacacacacacaaataatcgtaagggaaaatgtgctgatcactgtaagaggtacaaacaaggttctaggaaattcagtagggggaggatcccctgtcactggaggagaaggaaatgtttgtattttctttgagctcactttaattttttaaaaaagtatttaagaaattacataaaacaattttgcaataaaatataaggaataggtggggagctttttcatcaaagaagtggtttggagagttcaaactagttgggtagaatttcctgatttggaaacagattatccagagatatacacatttgtgagatatcatcatttcatattgttttagatgagcaaaatgccctgtctctccctccaaggcaatatttggtggaccacccgtaagtttttgtttggtttggtttggttttagcctcatcatttaggggagaagaattttgtccctatttgccccgaagtttcattagtggatggccgtatttataccctgtgtgtggtaatgatgaactcctatgcattttatctagcttttcaactattaagtgaagcttggtttaagcaaatctttagatggtagcattgtgccagtactgttcccgttttatcacatgctatacgttagtctagttcagcagagcattatgctacattcccttctcagtgagttatagatcttgaagttttcacacactatgttctggaaagaaagtataactgtttcctgtgtggttgaaatgcaaactaaagatatttcaactgcttctgtaataaggagataaggtcagacattatgaaagaaaagattaccaccgatttttttccccttttattcaagtgatttcaaggaattattttgtaagaaagtcacctcaactgatgaaaaccagtgttaattttctctttcattttttttaagttacctttattaaggtaatgttttttatgtttctgagttctgtttctgggacattgattcttttctttaattaattttctttctgttcttattaagataccacatggtttatggtgatttcataagatagtttaactgttaagaaattgtttttacatatttatggaaatattctataggtctttatataacatgttagtatttatatgtttacctgtataactgtaataaaatataatgcttacaatggtttataatacttagaggaaattatgcataatatatatattcccctctctatcctcctaccggtccctccatccaaagttcaggtgtgtcagcttgggcaagccatttaacttctcctggccttactttctcatatttaaaacaatagtcttgtagaagataaattcttagactttttgtacttgtctgatttatccagggttttagacaactttccagtttatattaagaataggctaaaacgtaaaccatcagaacttatcagccacatggaaatttcattaaaataggctcactggagccatgtaatagaattagtccagattcaatacatttatattactttcctctaaatgtaatcacatgcttaaattgatgagcagtagtataatagttccatagtgaatttgattcaagcaatagttatattaaatttctccacaaaaatttataaccattcaataaagctttaatatattgtcatctaaaggtaaatgtaagttttgtttttagaataactattgagtatatttcaagtcattgatttgttttttaattataaatttataaccaatgactaatttattaattttatgaatggtaaataaaacatacattggagaataacttgagtggtaaaatatgccttggtccagcggggtggctcgtgcctgtaatcccaacactttgggaggctgaggcgggcggatcacctgaggtcaggagttcaagaccagcctgggcaacatggtgaaaccctgtctctactaaaaatacaaaaaattagctgggcatggtggtggatgtctgtaatcccagctacttgggaggctgaggcaagagaattgcttgaactcgggaggcagaggttgcggtgagctgagatcgcaccattgcactccagcctgggcaacaagagcaaaactccatctctcaaaaaaaaaaaaaaatatatatatatatatatatgccttaaaaatatatatatatatgccttaaaactactttttactttatggttcattttcatggagtggtttattttttccatcaaaatacccaattaatttggatacagtgagcaaatgcttctgaaatagaatgtgtcaaaatattcttggtttctttggcctctttcatcatttacccacagcccctccccattcccctaccttcattgacctcggcttggtttgcaacaatccaggtttacatttttgaaacattaaatactctgagagagttaaagacttgtctgtgttgtgttcagatttgtagggacctcctgagctccacagtcccatttaccaggtctgctgttggtaaaataattgccacctgcactctggtttttagttccattgctttgttgaaatcatgatatttgggtttttcatctcattctgtaatattttcatttccagcatgtccctttcttactgtgctatctttcccaaccctgcctgtgtgtgttcctgttccccaaaggtgcttttcacactgtatgttcggacctggacatacatgaatacccttccttttggccagtctgaaagctattggagagcagaaactttgttttatttccttctgaagttagctttgtggttcccataggaaaggtattcacagaatatttgtcgattaaataattaactgttattctattctattactaccctttttcagttaattcctgggtctgtgcatctcagtccttaattcatacaggttgagcattcctcatctgaaaatactccaaaatctgaaacttcttgagtaccaatatgtggctcaaaggaaatgctcatcaaagtattctggatttcagatttttggattagggaagcccatgcagtatgtaatttgaaagtattccaaaattgaaaaaaaaaattcaaaatttgaaacatttctggcctaagcatttcagatcagggatactcagcctatattccaactttgatcttaggctttttcatttttgactgtctgctgggcaattctccttgactgttcttctgtaacttcaaacatagcatgtttgagactcaatgtctttcttgtgttctgtttttaccagtggtatcatcattcttttagtcaatcaggtttgaaaatgtctagtatttttttaaaagttgtggtgcccctttatgatccaggagtatggtgggtcagatctgtaagctgagtcagatagaccaatggctagaattctggcagttacctaacttgttgaatcttagttcccttatctataaaattcctacttcttggacttgttttgaggattgtgtcagaatgtccatgaaagtgcttagcgtggtccctggtatgtggtgaatgctgagtgagctgtctgtaatttccagtgtgtcatgaggggcttctgtgatgcttttcagctgcctcactactttggtgaggccgctgctgatgcttgagtacaggttctcatctcttgcgtgggttcttgcagcagtggcctctgctctggcccatgcaggactctaccagtagattttgattatttccttctcttcagaaaccatgatgactttctgcacccagcttgatcaggcctgtgcacacctcagtttgatatttaaatttttggacaatctgatcgtcaccaacatttctagccttagtttggtctcctctgcccgaatttccagtcactgccttcacactttacatcccctcaacttgtcttgtgcgtcacacagttttctcccctctcctttgtgtctagttttccctaaccatcatttgtggcccctgattcttgctgtccatgatgtttctcctgaatccttcttgtgacattgttcttcctacttaatccatgaatcgtattaattcattcattcactcactgccttgtaaggtagtgattctagacacttgttctagttataggtacttgaatacactggtgatcaaaaaagagacactccaaccatcccagaacttatgttatttatcagtatttattttacagggaatcatgtgttgtgacatctttgtataatttgcatttatttattgaactcctgtaaaattttttccctgtacaaattgtaaattacttgataggtattttaaagcttttaatatttcctttaatgtcttatttgatattttacacagagaaggaactcaaatattagttaactttagagggtcacattcagggcttgaggtttgaaactacaccttcaaaataaaatattacttgcaatatatttgaaaccagatttgtacgttatgcttcaggtatatgtttctttttaagaaaggtctgtaacagcatagattgattgtagtaattcatatttttctgataaaaatttgaccatgagtgaacagtatgcttctattcttaccagtggtaggtagaacacatttgatgtcacttgaacttaccaggaagtttttttcttcttttcatatatatatttttttgtgtgcaacactccccttcccttttaatgtgatgtctggatcaatgtttgaaaaaattctatatttagagcaacaggcagttaagtattaatagtttttgttactgtggacaataatagaagtaattgatgattgtcacttgcatggcttgaaggccttctctgaacttctacgctgagttaaatgctcccctcattgctctcaacatgcacatcccctgtgcttccttttttttttgtgatgctttccagtgttgttattatttgtatagtgtctaattttcctactagaccacatgcttcatgagggcaggagctctttctgttttcttcacaactcaattgcccggacctagtaagtccacagcacatataatgagtgctcactaaagatgcattgcagtaaatttgacattcattcactaatcaaagacttactggattcctgtagatgtcagggactgagctaggctctgggtttgcactggagaataaaacacagcccctgtccacagggtgctcatcaactagcaaaatgtgctaaatttgccttatttaactgacatttatatatggcttaaagtttctagattttttttaagcctcaaaataactctgtgaagaggtattgtttccctctatagatgaggacatcgaggaacagatcaagtaacttactcagtttcacataggattgggacctgcctctgtctggtctccaaatccttcacctgagacctgtgctacttccagccagtaaatcacatgggggtgatagtcataacttgcacctggtttatcagaaattaaatttgtttctcttggctcatgtgtttttgggtttgcattaaaagctggggcaaggaattatgatgtggaaatgagcccactactgattgaggcttttgcatctcattaaacctttaatagtcttattttctttgagactcttttcccattaccacaatttttcatggtgataattttgtttgactttggaaactgactagtctacattttgggcctattggattaagtttaaaaatcttttcttggtatttgggttctccatagtctgaaaaacttctgctccttttaacccctcactattcaagtgagtccctagttgggcctacagatacattcctacctttatacctgtctttaggctgtctctctctctaatgccttccacaaacttttggccaattaaaataaaaaatgagttcttccctttagttttcaaagtaagttccacctgcagggtttgcccttcagtcctgtgctagcctccaggccttgctgctgctttatgtgtgctggttttgttccctagtgagacttttaatttctggagcaaaaggaccaaatcttgtttttcttttctgtctcccacagtatttagtacagtgctggctataggaccatgcctactaagtaagcactaaaatgagcccattactgattgaggcttgaagtaaatttaattatagagtttgtacttcctaattataactgaaaacctcagtgttttccaaacattatggcacactggagaaaggcagatggaggaggcacagtcttttataagaacagagatacttcccgtttgtatttgtgcaagacaggttacggattgctttcatgggcattagctcacttaatcctcaagctaattttatgggagagaaattgtttaatcctcactggggagtgatggcattaggactcaaataattcacctataaatcacatggctgaagctaggacttggtgccaactcgtgtgactctagtgccctgccacaggagagacaggagcaaccaggctgcgagctccagaaggcagggcccagtaatgtttattgcacgtcactgttgcgagataaaactgaggttcttgcgtcagctgccctttgaattttctcatgggtacatttctgtctggctctgctggcacagttgagtttgtcccctctattgctgggatttctgtactcattagccatttacattcatctgtctgtcatctatctgcctatcatctctgtatgtttgtatataaacaataagacatttgcagttatataaaaaccaaccatctgaagtcttaaaaataatttgtgcactttgggaggccaaggcgggcagatcacctgaggtcaggagtttgagacctgcctggccaacatggtgaaaccccgtctctactaaaaatacaaaaattagctgggcgtggtggcaggtgcctgtaatcccagctacttgggaggctgaggcggaagaatcgcttgaacctgaaggcgatggttgcagtgagctgagatcatgccacttcactccagcctgggcaacagagtgagactccacctcaaaataataataattaaaaaaaataataatttgtgaagttgtaaattaaaatttttgttagtgcctccttaatactccactctgccaaggttgatgattcctgtgtataggttggtgcataactgtattgacagcattgggctggagaatgcaaatattatgattttgagaaagagagattattttgtgtacttatgtatttcatgattgtttcaaagccctgatcatctttggaatttgtccttggaaatttgtgaatacttttaaggtcaatgcatttccttccttttgcctcatgaattgagttcttgctatgggaaaggaacatatttttccagttatctgattataatttagagcatttaaagtttttattgctgttgctgtgagcgattagcagtgtactttcaattttgtactcttggttgtgtatacactctgggcacaatggcatgccagaggatcatcaaactggatagttcacacttaaattgactacatcttccaaatgggcattttatgtctgtggccttctgacatttctctggcaaacattagcttgtggaattcatcttaaacatttcctttgctttttgtctgtataatctgatgccagaaccatttaaaatatgattaaaaatttaaaacattaaatatagatatggattgctgtcgacagtatggactctataaagaaaagacagtcttatatttgtgctcttgataggataaaatctatatagtttttaaaaaacctacatgaaaaagattacaatagcttagtttagaggtagtataaacatgagattgccatcttcatattagacctggagagaaataaacgagaaataggcatgttgacttccttgatcctaaggatatgaccactgtaccaagtggttttgatgctgtggaaagtgtggttgtggaaaaagtgtctgagatttttctttcagttcaaccagagatgagtagttgagacttctttttcataaaggaatctgctagagagatgtggttcctaagggtcaaccaagtttgcagttgcctagtagtgcacctgctgttccagaagaggtgcagatgcaggtatctagtccctgacctggaggagctagttaatattttggtaagaaaaaacttaagaaaattagatctaacttacatggtgcttaatatttgtgaagtgagagatcagagaagggagagagtagtgtaggtggagaagccagaatgataggttgggaaatcggatctcaggcttttctctctaccatttgtcccagcaggccagagtcctggggtcctgtccactctcaacacatgcctttaatactcttacaattttattttctaagacctttttaaaaatcagaggataagcctttaagttgctggtatagggttgttagggaaaaaatcagtgatgcaaatattaaatattaatcactatctgcccttggtggtgttttcttatgcatttttaaaacctgagcttattggaggtttcttcctcaaaattacaaagcaacaaagcattagttttgtttagtattttttaactgatagattctcttttgaaaacattagtctgcctttgaagttgttatttttttgtgtcagaaagagatttttgtcaaatgtctgctttttagaaaatgatagtcataggtgtgttttctgtatgtgctacaaatttcacaaagctttcattcttcataggaaactaacgtaaacacgcacacacacacacaaacaaacaaacaaaaaacacttggtatttactttcttttaaacttccaagtcatgtagtccctgcctggctgttctgtgtcattactacatcatggcacttgacacctttatctatattcactacatttttgtttaaatcagcgctgtttgcagtaagtctattgtgtttgcctctagataatgtaattgatggacagaggaatctaaaggacctgtccaattgtctgtgctaaatttgtgggtcagagtgtttaaacacaggctgatacgaactctcatttttacattccccttgatgttatatcccagttgagaacctgtttctttctcacttggccagtttgctaacagttaattctcccctggcagataatagtgctacttttcttgctctagcagcagtctctatggtggcccattttcccatagaacattttttctttaaaatagaatgaaaatactgagcatacctttaaatgacttgatttatgttttatttatctgtcttaattattctgtagatttaaaaatgatttaaatcattttcagagtgggttaataccctgctatataacacattcaaaatttatctgcctccagttgtgtttatgggagacacagcatttttattctattaggcatcactacatgggtgacctactatcattttgaatttttctcctgtgttgaactcataatttctttgtctgcaagttacttgtattaagcttatgttttatacatagctcataagaaagaaaaaacaaaggaatacaatacacagatatatacatgttaatgttagtaaggttgcaggtaacttttattttctaatttatgcttctttgtattttccagcttttagaagcttggaaatactcttttcgtaataggaaataactgtttaaaatttctaaccttatgtgctattagaagttgggaggcgaagggagtctgctttatttttaggataataagcaattgagtaacattttatttgtctggtggtgttgaatagagagagattatgactcaagcctaccttgctttttttttcttttttttttcttttaatgagactgagtcttgctcttcagatgacccagcccagagtgcaatggtgtgataccggcccactgcaacttccgcctcctaggtttaagcggttctcccatctcagcctcctgagtagctgggattgcaggcatgtgccattatgcccggctaattttagtatttttagtagagatggggttttgctatgttgcccaggctgatctcaaactcctgacatcgggtgatttgcctgccttggcctcccaaagttctgggattacaggcatgagccaccacgcatggcctcaagcctaccctttaaaagctgagattttaaagttttcaaacttgagaagaaaaccttatgttattagtattacatgttttaaaatccattgtgatgaaatacagcatactgaattgattttgaccttatcctggaatcagggtcattactgtgaccttcaattattgtacttttggcctttcccttgctgtcagctgtcactgcagcaatgctaattggggcttttaatcatgtagcttagtgaaaacaaatagcatataatattttatgtagatagacttactaaattctgaagaatcgtctgaaagcttccttcttggagtgaaaagtatgtgattgtcttcttcaggacacggaagaggggattttatcacttatgttcctgtatttgttttaataactgatgacccatggcagatgtttatttttgcttttatgttcttatccgtgtatggaaaagcttagattgggtattggtaaggccttggaattagataggcctggatacaaattccactgatatctcttagtagctgtgtaatcttgggcattcagaataacctcttcaagttcatttcctcttctgtaaaatgaggataatcatgctttcatcgtagagttgttgtgaggattaaatgaagaattcatgcagtgtgctagcatagtgtctgcacatagtaattgctcaatattatcaataatgataactattttcattactaatttggatttgactgatgtctgccacttcttaatttcattgttcaaataacctgtaaccgatttggaatgtgaagctgagcaagcttgatagttgaaagaaaatattattatgaaatatttaatgtattcttcactgattagaaagattttctcaccttcccataaagaagataacacaattaaagaacatctatacatggcagagtctggatacctgcattacattatgatatttaaaggaatcattgcaaactacctcaaagaatcctgagaggttaaaactgagtttataattatatagacttggtaatttgttaaatgcagcaagaaaaataagattacaccataagtttttcggaaatttcccattttaaataaaattgtcaattctatgctgtatgtgatgggtatggaatttgtgattaatctgtaccaattggattaaaatgggttcagcaggtttttaaacttattgttgataatggaaatataaagctcgggaaaaattgtgaccatttttttttccattgtctactcatctttcatttaacttttattgatttaaaatcctttagtgcagttaactgctattataaagtctattgaagtaaatactcatataacatttttttacttatatgacagttgcttttggagtagctggaagagctgtgaggtactcatatttcatttttaaccatttggagaatagttttctatgtgtgaaatgtccacttaatcagcaccatagctctttttgctaagagtcttagaaatgaacaagatagtataaccactgaatgaaaaattttaaagatgttactcagtgaaaagtttctaaaataaaaggcaacacatgaattactctgaaaaagttatttttagatagcaaataaatatttttctttcagttatttgtaggaacatcaatctatcaaaacttttccctcatgtctttaacaggatgtaaagtatataatttaatggaataattaatatgaatagcagttgttgtacttatgtagcaagtatttgttattttgctgaggtagagaagtttctccctatactgaatgcttccagaatatgttttatattgtgtgtgtgtgtgtgtgtgtgtgtgtgtgtgtgtgtgtgtgtgtgtgtgtgtgtttgagtggggcgggggtgttgggtgatggtgatgtaaattttaaaaaacaactgctttttcttactccttttctatcagctgtcacatcttacccctgttgttacattttcttcagtagtcctttccttttaacatggaaaacaagtaatgaaggtttttaaaattgtgcaagaaaagtatgcataatttagttctcaccaaaggcccgaagagtgaactaaaaatctcaaaacctcctctcatgttacaaatgcagtacacatttattttaaaaagccagaaaatgttaataagaataaaaaggtcacttatcatctcacatactagagatcatttcttttttaagctaaaacaggaaaagataaattgctacaggtattttagcaggaagagcattgatatagggaaggaagattggtaataaccgatcttactttgaggatatcaagaaatgagagaatcataggaagccaccacctatgatatcagccacctatagccctacagtgggtgattatcaggagctttacccagaagccatgtatacatcaccctaacatctatccccacttctaccagccactgctgggggaagaatatggttgcttctctccagtgttcttactttcacatgagtgcctttcatccacagaacctaagccaaaatcctgcctacaagggatctgggaaatgtagtttccaggcttccaggcactgtgaaagagcttgaaagtatagggatgatgttgaaaattctgtcatcaacagataatataccctgcagcatccttccgaattcattcctcaacacacgtatgctacttacaactgaacacttaatcaggaccatagctagatatatgctgtttggtaatttgcttttatcacttgatttagtataacgcatatctttctaaactctgttactgtctatgtttgttttctgctgctgtaacagaatacatagactgggtaattgttaaagaacagaaatttatttcttatagtctagagactgagaagcccaagatcaaagggctgcatctggtgaggaccttcttgctgcatcataccatggtggaaggtggaaggtggaagggcaagagagtaagaatgagagagagagagagagcgcgtgtgtgtgtgagagagagagagaacgcacgcacacgagagcaagaggggtcagatttgcttttatgacaactactgtcgtggtaatgaatccactcctttgataacagctttaatccatccatgaaggcaaagcattcatgacctaatcacctcctaaagttcctacttttcagtactgttgcattggggattaagttctcaatacgtgaactttgggggacacatttaaatgatagcagttatacatatatcttaaaatttttgtgttaaaaaggaatatattaatatttttggtaagctgcttttatcacttacgatattgtcaacatctttttgaatggctctttagaattctgttgttggatttattaaataagcacccagtgctagacaatttagatagtttccaacttcttgctcttatatcagtgatttgctctgcatctttttgactaaaactttgtatatgaccatttattcttcagggaaaattccaagaaatgtaatttccgagtccgattgtgtggtccatggccttttctgacttgtattttgcttcttcctaaattctttttgcttacttccatttctctggtaactggatgccagaaagttgttgtggagatataaaaattcaggatggttttaacacttaggcccttttgcattgagagtccttaatcctcaatcatataagatacttggacctccacccatgcttcatataaacactaaatgtgctttaaactaagaaagcctaagaacttctgctaaagattaattctaactttccaagccagggaacagtaggttggaccaagggtctctagagactttacctctttcattttacacttccttctttccttcttccttctcaccctgcttttctccctttttcattccattctattgtgatcataaaaagtcattaaggtatttagtatttagagatgatctgttattttatttttattttattttatgtattgtattgtattgtattttaatttttttgaaatggagtcttgctttgtcacccaggctggagtgcagtggcgcgatcttggctcactgcaagctctgcctcttgggttcacgccattctcccgcctcagcctcccgagtagctgggactacaggtgcctgccaccacgcccggctaattttttgtgtgtttttagtagagacggggtttcacggtgttagccaggatggtctcgatctcctgacctcatgatccgcccacctcggcctcccaaagtgctgggattacaggcgtgagccaccgtgcccagcccgatttgttattttatacaagacttcccagttgtgaagcttatgttgacatgtgttccttgctggccatttcagcctgggtgacagaatgaaaccctctctcttaaaaacaaaacaaaacaaaacaaaacaaaacaagccttggcttagggttgtggcttctggctacagttacaagccttctgcatttctgtaagtggctgtgataaacagggaatgctggaagatctcctccttgggggctcatcagtggatctgccagtaataaggatttcatcactggcaggaagaccttaggtaattggaaaatgatgagcaactttaaatttaggagatttttcttttacaatataggcacagttccttggtaatctcaacattctggtggtgccctttgcttctgaccttatttaatagactcttcacttgtgttgaaagcaattctacaaataccagcttttatctagtgtttacatgggcagtcctgcttgactttgaatttatttgttagttttttgattattacatgtatctttaacattttctaactagaatagaatacttttttcttttagaaatggcttagttttattaggaagataaaatattctatgtcttagaaagcaatattgaagccagcagcaaaacttaattatctgaaatgaaatacagatgattaaattatttcctaaaatcaataaaattgaatcaactgaaaaaatcaatgtgctatataaataatgccttttaaagtatttcccatgtctttgtggaatattggctcagaggtttgcaatctgggcagcaatgtaaagtttcattcataaaaagtattctagattttttttttaagatgtcagaggtctttagcattggcttccatgaacagttaccatgggtctactatgtatagggcatgttgacaggcactggggaagcattatggctctagagagatttccaatttggtcagatatacaaggaagacacatagctagaaagaacaaatacatgtaaatatatggtcgcatataccagtctttaaccatgtgcaaacaggagtttagagaatttgatgatggccatgatttgggatgggaaatcttccttgagaaagtgttgtatgaagtgaagggcaacctaaggcaagtatggaggagcaggaattctaggtaaggctgacttatcaggttgtgcaatacacaaaggtcctgtataaaatatggaaatgttctcattcttgccagatgccatagacttgtatacattttataacagtttcggatagataatctgacttctcaagccaccttggctccttgatattccttgattatccgaggaagatttcttccttaaggctttgcactgggttgttcttctatctggaatgcttatccctcagatatttcctatttacttcaagcatttgcttaaatgtcaccttcatgatgaaacttaactagtgtaccctatttaaaataactatttccctcacctgcatataaccatgctatagcatttatcaatattgaatataatgataattacatgtaattaataagttcattattgtgtgcctctctctccaccctcttaccccaaaagagaaagtctcatgatggtagagaaatttttcttctatgcatttttagtttactgatctatatcccaagtgcctagaatatcaccttgctatgtagtaggtactcagatatttgctgaatgaataaaggtgtgcatgaatgaagttgagtaacatttatagaacagaaagggcaggaggcaaaactgttacacagtggttgggggcagaaataaatgcaggagaaaatattatctgaagactgtggaaaaagacagtgaccacagtgcagaaacatggagcagtcaaataagaaaagaaataaaaaaattcagtcatcagatttggcagttgagaggtcgttggtgatttttgtttcagttggataatgtagatggtgagatgcatactagaaaagaaccaaggaaatgaagacatcattcttatgtaagactgttcatgtttggtacccgcctgctggacatcattcagtcacatcatacgtatacatttatctagagtgacagcttggcatctagcagtaacatggcattctttaacaaaatcagcattttaactcaattgaggaaggaaggaagggtgccttttctgattgataccaaagggtcatttggccagtgtctacgtagtggccctgagtggaggcaattccacaagctcttttgggaactgatgtttgatggaggaggaagaggaaatgatggagcacgtaaggtggaaagttatagaacaggtaatgggtaggataggttagccaggaagaagccaaggacagagagaccaagtgttagagtatccagctgcagatcgatgagggcatgggagtggtaggcaaaggagtagtatgaggcaggcggcagagggttgagaggagctgctgatggattgggtgtgaccaagagaacaaggggtcaagaatgacttcaaggccataagtgtgggaggtgaggcagattaatttatttacacaaatggaggtgtcagttctcagaaaatataaatttagttttagccatgcttaatttaagatggctggggaatgttaagataggaatttctggtagatggagtttttcaacaaatataaaggggaggactcagttttgttagtttttagtgaaaatcctgcagtggggataaagatgcatactcagcttctgtagtgagtatcttaggtgaatgcccttattactgtctttgccacactttgagaatggtattcttatcatttctacctgaagttagagagattttatcatttatctggcatcttgcagcttatgaatgatagagttggaggtcaaatgcaggtctctctgctgccacagccctcatattccattctactttctgcttgtaccctcagaggtcacatttggggatgcctaggaagtctgggattgagtagcgcatttctggcaaatatgatattttttatagctgtgttttacattcattacttcaaagattatttggtctacttggatcaaatgtttgttacagctgcagaagcttcctgctctctgaatcctttttggaggtgctggttttcttctgaaagttttaaggtgcttttttcttatgaaccaactgctcagatttttttaaaaaattaaatatcctgctacctcattttttctctatagcacattcccatgtcttaacttcgatttttttcttttctttttgtgtcacctgactttgttgagaaggctggagatacatttcaagcccttcctagtccttaaaattatttctttcacactagcagattatctcatttcaattctgcctttatggtttaacgaaaacctggtttaataatccagcaatgttagccattgggattcatcctttggtataataacatcagtatccatggctgggaaattattaggttctctatgtgttatggcaaatacgggtatggatatagataaatgagttgccttatatcaagagactgcacaaataagtctgtaagctttttttttaattctttaattttatttgtatcctactggccttcgctctccttcccctctcttgttgatacatagatatgatttatatcctcatggcaggtgtcatactttgtataacttcataaatattttcttaaaggtttaaacatgtaggacctcaggttattctaaaatacgtaaaagaacaaaacaaaatcataaatcaatgtaaagaataaatgcatattatggagaaaattacctaaaaaactcctacataagactatctagcggtacttaggtgcatggcaatagtgaaagggcagaaaacaggggatggtaccaaaaatagatgcgttattcttccagaatgtgaaacattatataattgcttacaaagcaatcatcatatgtagacaaatgacacagaatggaagatgaataaagtcaatgtaagattaaaaaaaattgaaacaattacatctccatctgttacactgataatgtaaaaagatattgtacattcaatcacagatggccttttaatcactttagaaacttagcacagaaaactaggcaaagtctgtagagacccttggtctagcctcctgtcctttagcttggaaagttagaattcatctttagcagaagttcttaagctttcttagtttaaggcatgcttaatatttctctgaatttttttttatttttttattttgcaggccaaaacaataacagtttttgttgttgttttttttgtttttttttttgagatggagttttgttcttgtagtcaaggccagagtgcagtggcacaatcttggctaactgcaacctccgcctcctgggttcaagcgattctcctccctcagcctcccgagtagctgggattacaggtgcatgccaccatgcgtggctaatttttgtatttttagtagagacggggtttcaccatgttggccaggctgatctcgaactgctgacctcaggtgatccacccgccttggcctcccaaagtgctgggattacaggcgtgaaccaccctctccagcccagttttgtttttaagtagttatctctaagcaatttaataaatatttatgtcccaacaacatagtagttggttgaaagaaaataatacaagtacattgaaaggaaaaatatttttatttttattttattcttaaatacccacaattattactaatgggatgtgtgtgcctgttgggcactacataacttctcaaatcttggaataagattacacaccaccacaccctcattttttgttttacattgattgttgtaccatgtttagttgttaaccactgcatctgctgaatatccagcttcacaaagatacaccattaaaaggaacttagtgggatctaatgttaaaactacacagtaatttgagctagtaattcatgcagtatcagatgctgaatattcttgtgatttttttggtgaaaatttaaaatatcctgcagtgtctctgagtttgctgtggtgttccaggataccttggtgtataatttaggaaccaccaaccaataatcttaaactagtaggttatgggacacaggccagaaattatttgcttcctagtgctttttaatcacataggtaaattgtcagctacaatacctgggacatagcagctccccagctggtgtaaattatttttcccttgctatactgtcagcatttatagccatatctttccatggtggtccgatttatatttacagtccagtaatctttagtaagtacagtctggcatatcttattgccaattgtttgattttatgtggaagtgggtgacacagttattactgagtctctttataaaaatcttatttacgtaaaatatacaaggtaaggaaatgcattcattaacaactgaagactgagtgagtaaaaaaataacttgtggacactattttcttgtataattgaaaattatgcaccactaccaccactaccacaaatagttttgtataagatatgtctgttaagttcagagaccacaaagtccctattgtgatgcaataacctcggttaactgagcatatcttctccatgtcctggtgaggatagctatttcagaagatcatttataggaccatttacaaaaatacagtatcaatcacactgcttattttagcatgcttcagttgtggtttacaggcagtgatccctctgtaaatggactgcacttatcaacatgctctcatggtttacaatgatcttgacagcagatttagtggattgaatatgggtctgatatggtatggccttctcaaagtctagactttataaggtgtaacatttcactttgcacgtggaagagaaacttctcatgttctccctgttaagagttgaaggcctaaaaacaatttgcaagtactgtgttgatgatttagttattagcacattttccaaaagcatgtagagaaaatatcaaatttgcatgcagtggtaaggggtgcataaaggtaacttcctcctgacgtgtggctacaaagtatactatggatatactttgcggctacactgtaccacgttttcacttctcatatcctgttaattttcagtaggtttcctaagtgtcgaagcttgtagtctatgtagcaaatgtatttctatccatgtgtaactgtttcaaattatggaaaatatcacaccttgagccttgagctttactttgtaatgtgtttagtgcaggattgagttccttgaaaagtgaagaagaagagataattttagtgagctacaaatgcctgctgatatatattaagtatgctgaaagtgtatgaatataaaaaaaggaattttatggagaaagaatagttgaaagacctaaggagattcttgaaggggtcaggtttcaggaaactaaagagccacccagctaagatacagatcaaagtaagccttatgtttattgcttatctgttctgggaaaagcagaggcagccaagtaagacttctgatctgctttcaaaacctaattcaccagttattattagtttggctttaggcatgttacttcattctctaaccacacgtacctcacctagaacaatacccaggcgggaatgggaacaatacctatttcataaaataatcctgaagattagatgaagtaacactgcaaaggacttcactcagccttgatacatcattctgccttagaaaattccaatgaattcattctctttcctgtcctacggagctcacatgtggctggctccttgtttcttaaaccttccctcaatgtgtagttaactgtgccatcatctgtgcctttgtagcccttcacaatgcatcccattatagcacgtatcaaattgtattatttattcctgcttctctttgctagtgggctgtaaggtcgttgaacatgagggaccacatcttattcagcaccttgcgcagaacctaataagtgctcaaaaatgacatgcagtgaatgagatgattggatggccgcttaccgctgttggctcagcccagacatttttttattaatatatctctatgactgtgcccttgacactctcttctatatttctagatgcttagtaaaagaaatagatactttcataatttatttttaggaaataataactgcattgtgaaaaaagtcatctaggaaacttttctgcccccacccttgtaggtaggacaaccatttttattctttgtgccctctcagaaccacatacatactttcatcatcttcatcatatacttgaaccatttattgaactcatttgtttgtttttctaatgtatagtaagcttttggagagaaggcattgcatctagttcatctctacatccttagtactcagagggtatttgttgacaaatggactgagtgtatccctttcttagactgagacattattatttttttagaatgaagaaccttcccattacttaaaatactttgtttttaaatggaactacattgcttagaatagtttaaaagatgttttgttttttatgttcatgtatagtatataatctgttgcatgaatattttacttacatattttatgggatatgtgttttcagtagatatatttttataggagatacatttttaaatacctacaaaaatcccagtactgtgaagtatctgtgtcattaagtgtaataaaacatattacagtaacagtaatctgctgaatgcttcctattaccctgcagggaccctagagattgaaagctttattttggaaaagtcatctttatggtaataatgtaaatggatgtattaagtaacagagcacttataaagagatccttgtctaaaggcttggtatgtagggcagaaaaccatgcttcactcagaaggccactggctgtggtggaaacttgctgtttcttcatggagttgataacaaatattttttcatgttattttttctcacatttatttttcaaagtaaaaacatttatttttcatatttgtagaattcttctatttataaaagtaatttctacttatgaagagagcagaaataagaggaactctcactacccagaaataaccattgttaaatttgttgtgtgtaattccctacatgtatacatgcattatatatatgtattcacgtgatgatactcgttcccccatattttccaaaatgaggtcatagaacaggtgctgagttttgatctgcttccttttttttttaatttaataatgacattctttgcccaaaggagtaataaaacctatttttatctaaaatctctggagaacaaaacattttacctaatagttttcaagttaggtaagggttttcatactcatattttaaactttttagcttttcataaaaaatcttttaagatgtggcacactctagtggttatgagactttgggttttattgaacagtgtagggaaaagagcaagaggggattttagaaagtaaggtacagcaataaaatttcataaaatatgtcttaatgtgtactatccctttcatttcataaaggagaggaccgattctagcaccatacatgaaggaagagtataatctcagaatgccaggctgccattcaggaagtaccagcatgctgtctcagataagcggttctgaggaactgcagtctatggtttatgcacttactgagttaccgtggtgtcatgggcagggtgaatgcacctgaggtggtgcaggacgccaaatagtgtaactagaagtcccagaggaggctaaagccttcttgactaaactgcgaccctggtgctgtgtgggtagctcctttcctgcctcacttcctccttttccttccctcgtggcattctcagctttccatatgccctttctgggtcctggttgctcctgttccctcccctgttgctcctgatactcacctcttcttgtcttttctctctttctccctctactttttcaattctcatggttttctctgtagagaaaagctgatcttttaagacacagtggtctttttgtatgaagtatgtaaatgcctttgactactacatacatatgcctacatatgaaagtagtagtaggcatatgtatgtagtagtcaaaggcatttattaatttagttgttcaatatatatttactgctgtgtctctaggcaacagagatgcaaggccaagccaaacctcctcccttgggaattctcaggacagtggcagttactttgggtctttagcacttatggcaggtgtcagtgctgctccggctccttgtgttgccatctgggtactgtttaaaccttattgtggactgtggatttctttgggtgaaagtctgtttttctcacccttctatctgttgagtgctgtgcagtgtcttgtacagaatagatttattttcctgtctatttctggagaggggctttttttgaagatctgatcaatgattggagtcaaactctttagtcccacatgtgatccattgtaaactaactggcaaatgtttcatatttcccctctaatacataacaaaaacagtttaagtctgaaaagtggtataaatggaacggaacatgacattcctgtagccatttttttaatacagattatatccctgattaataacaaaattgccagtctttttaaatataaaattacaacaaccatatagaatcacacacctccaacctctgctgatcttgatcttagtacatgaggcttgggttgcgattagatttattgtggcaggaggttttgtgtttgaggaactaaaggactttctagtaaacatagatgcaggagagcaaatttgtgagtaaataccttaaagtctttatataagttttttgtagttaaagtcactaacacagaacaataataacagtacaataaatacagagaatgtacgtggcattttagatatcaagttggtaataatggctgctgtgcgattaatttgatgaaagaggacagtgatgatcctgattggaagattgatagctcttgggtggggtggggatggggagaggcactccacttgcttttcttaaggacttgctcaaagtaagtctgtgtctctaagtggagagctttatcaattgatttctttttaacatttgatatatgtccagtatgttctgccaaatgcaggttgccaaccagtaagttacagaaatggctccatggttctgcagtgctctggctgcctaaattgaacattatgtatctgtgttgttctgatggaattagaatcctgcaggtgcttgtggccatgggagaaagtgtgtggcagcacctctggcacggagagttacttcctgcaagaagtccaagctgaaaatggatccccgctgggccacatttctggtgccacttcattgagcactttctgtgtagcagcagtttcctggtgttactgctgaattgtttcaggggtaatttcctgtgagttcagtatgcatagtaacaataaagaattttcatattgctatgtgattaatgtttattaagtataaaatttcacagttgtgtaaaaatatgcaaaatttataactaattcatttttgagcaaggacacatgattggggtgggattactatttaataaaaatgctactctattatttattgtaagtcttttacaagtgtacagaaatcagtgacgtggccaataataccagtttttctttcctgtgtcactgggtagtctaaaggcatagtgaggtgtttagtaacttcatagtttagtaactgtgaagccaggctgcctcagtttgaatcctacctcctctaactattggctgtatgacattgggcaactatttaacatctctctacctctgtttcctcatctgtaaaatgggggtagctgtgagaactggataagattgcttaggatagtgtctgacagagtaagacctttgtaagtgttagttctactaattattatttttcagattcctgcattatttttataacagcagatgacaagcaatgtgaaaaagtaccattataagtacaatgtaagtggaatacaaatgttagccatggttttctacacctttgaggaaataatattgatttttgttccccactcacgtcccatgggtgagagtccgattccttctccaacaagtttctgaagccttggggcttaagttctcatgatcattgcagccctgtgttcctgctcctgcttcccatagctcttttttttttcctcttcgtcccaaactgacttggacaagaaactcagtcccttcctcttgatttctcctcattcccccagcttctctcattaagcatttgggtgggcaacagacttcatgggaggctttggcagtggaggtgagaggggctgagatctgttgtaaacaatttatagcaccttttgtgttaaagcaaacatgactgcctgatagaatagaaagcagaatttacatatgataaagaaattctagctgtgtggtagactgggccacttcaggcaaccagaacaccaggaatgtgcatttattctcctctgtcattaggggtacttctatgggggaaatgtttggggaagtacatttgataattgcatcatatagtgagcaaacagtttgaaatttgtctttcagtcactgttctacagtttgcaggtaacaccctataatatttatatctgccgtttttaaaagttaagaattattaggaaagcatttattgtctttaattatagagagagtaatgtaaccatattgtctctttatctttttctttttgggagctgcctgccaagatttaggaatcattttgtttttctaaacacttaatttcatcataatgaaatttcttgtctaatgagatttatatcactttccttattatgagagttcagcttgttttaattgtgatgtctgagaacttatactgaaacttgccgtagtcaggaagacacctgtcctaataggaagacattttacttaatgagttgatgccagtttaaatttctgccttgttttacttctaccttttcttctttgagtagtgaaaattgcatttttatctagctttaaaatttgctctctgcagtgagatctactacatgaaatcttttctcaaagtgatctgtgtgaaaatttaaattaataaacatataccattatttggaatatgagctttaatgaaaattcttgcccgagtaaacagtgtccatttacagtcaactataggaaataatttaactatttacaaggatgcttttgagggatgacattggtagtcattgattgttgcagccccaatcagtattctgtgtgtgctttgactggtttggtgctacttaccttcacatgccaggggtctttctttacagaaccgatgtgttgatggtgaatcatgatgcactgttcttgcacagaggtagccctgacatttatttcatgaaagagttttcctattttgggatcttgtggggatattcatgaacataatagcctacccaggaaaaaagttagatatggtgaagaagaacaatgccatatttaatgcttgatctttaaaaaataagtttcttataactttggtcagaagaacactgatatagtttggctgtgtccccacccaaatctcatcttgaattcccacatgttgtgggagtgacctggtgggaggtaattgaatcatgagggcaggtctttcctgtgctgttctcatgtgagtgaataagtctcatgagatctgatggttttataaaggagagtttccctccggaagctttttttgcctgctgccatccatgtaagacatgacttgctcttcctcaccttccgccatgattatgaggcctccccagccacttggaactgtaagtccattaaactcttcttcctgtataaattacccagtctcaggtatttctttatcagcagcatgaaaatgggctaatacaaacacacaggcttgtaaaagtagattacttttaagtaaacacttttaccctgtgatttttattataaagttggagatgggtacttttgggaaaagtattttcctagatgtgtaaaaatcaaactttaaaaaggagcaaatgtttaaaattgagtctagtaaagtatttatagaaataattttaaatgttattatataatcttgctgaaaaataagtcactaaataaagttatactactaaaaatgaaaatgttcgtgacagaataactggctgtaggaacatctcactgaggattattatttttgtaagttgacactggagctttagcaacttgaccaagttttttactctgtgtatatttttaattctttcattctctgattttagttgacctcttttagctgtttccagaatcatctagaagatcttttgtattagtcatgagctggaggccaggtagtgctcagcctaatgttaaacctcatacaaatgggcacatgagaaaggagtgggcagttattgttgaaatattattgctgacatttaaaatggttatagggatgggggaaatctaggccaagaaaaaggttatctttgtcttcttcagacttgagggcatggagagtatgacatgagcaaacctaatacttgattttcagaaattcaggggaaaatattcactgacaaaataattttagaatgtctataatttttagtgaatatatattgatgtagcaaatttattgtagtctttatatatagatagagaggagtccacatcatttttttttgtaactaattttttggtttttgcctaaattcaggtagcaaagatgaaatgttggttaaagaaactaaaaataaaaaaatagaaaaaaggggaaggagaattagaaaaatcagaaaaggaaatttacaggggagtgaagagatggcagtgatacgtgcatttgtacaactccttcaggttaaaagctgctccttggactgtgaactccttgggaaaaggcctgtcttctctttgtatctttagcatctaatcttgtactcagcgtgtgcttaaagtggtacctagtacgtaatgggcactcagtcagtgcttaatgaatgaaatcaattaatgaaacttagatttctcatgggttatttcacctgatacaagtcctttaaggaaaacgtaattttccccatattataaaaggacaaaccaagactctcatgggttaaatgattgccaaataatgacaattctgctaacaatgacatgccattatgacatattaatcacataaaattagggatatatttgtatttcatgatttataatttcattattattagcagtaagtaatatttagtgaaagcttattgcttcctaaaattatgcttgacatgcaaatttcactagactaaatactatcctgtaaggaagatagaatcatctacattttatagtctggagtttaaagggataggttacctttcaagtttacctagctagtggatgggtgacttgaaagcagcctggtctgacccctgagctcttttttttttttttttttttttttttgagacggagtcttgctgtgtcccccaggctggactgcaatggcgcggtctccgcacactgcaacctctgcctcccgggttcaagcgattctcctgcctcaacctcccaagtagctgggattacaggcatacaccaccacatctggctaatttttgtatttttagtagagacggggtttcaccatgttggccaggctggtcttgaactcctgacctcaggtgatccacccgcttcggcctcccaaagtgctgggtttacaggcatgagctaccgtgcccaccccaactgagccctttcttaatgactacactaagttacctccttctagtcacacagttcttgatggcagagccaggatttgcatccaggtcttttgttcctagttttcttcccctgtatatcgtgcgtgtgtgtgtatttcatttgccttgtagtaggccatgatcagggcatataataatgaccaaaaacctgaattctgttagtatagaatttggtagattttctgaaagatatttgattaaaatgatataacatctgagaggagagaatgactatcactacctggagttgccatgcaaggcttgacacagaaatgtaatggcgtgaagaatgaggaatactccaggtagaggaaaaagatgaatgactatgcaatttattgtccaaatcagattttttttttttttaaagaaagggacactagcaataattgtggtaggacatcagggcttgaaccaggaccatctgtggaaaccaggccagtggtctttgtacagaaattctgttttaggcagaaggagctatatatacaagtggctatttaaaattcacataatatttcaaacagtgttagattaaaaaaaccaaaataataaaaccctacaccacatctgccttataggagtaaagtggcaatgaataactactgaagaaacagcttataaatacctaattagggagaagagagttctagaatgatctagcacagtctattcaggaagttgtatgatctgaaagtgtcttccatttttggtagaaaaatggctaagtttggtgcagatttgcagagcacagaaattaaggtatttactagagttgggggtaaagaaggataaaacatttaattcattgaaattaatttcactgtgaacatatgactcaaagaaggcagactaaaggtgtctggttgtgggaattaacagaattcgagttagtctatccatttatgtttccttgttagatttttctcttcccactggaagtgaaacactgttaattcactattgagccccagacagaaatagtgtgtatggtgagaatgtggtgaggggtaatagagattgtttggattagcaagtttctgaacagaatacaaactccttttgatttagagatggcagtgtttatgggaaggctaagacaaggtgggaaaaagaaaagaccaagaagtactttgtatacttaattggatatacttcaacctggttagtattctatatggctaatattttcagaagaaatactacatagaagtagtggtatttattaagaaaattacatatgtttgtatgtgtaaacatacagataacaatatatatgatatatgtacatgagccatagtgtaatggttagcactgtggactccgatatatgtacacaaatctgactcacaatttactacttcttgctgatacggtgattttagtgcaaaacctaagcattgatactaagaaagaataaaattttatttttataaaattaagattgtgaaatagtgagcagagctaaaatctggagtataagccgtaaataagtttctcaggtaataaaatcaaaagcaggtaatacaataaagaaaaaggatagattatctcaaattctgttaatttccacagccagatgcctttagtcttacttctttgagacaaatgttcacagtgaaatcgatttcaatgaattaaatgttttatctttatccccaagtttagtaaataccgtaatctctgtgttctccaaatctgcacctaacttagtcatttttctgccaaaaatggaagacactttctgatcatacagcttcctgaatagactgtgctacatcattctagactctcacctctctaagtaggtatttataggctatttcttcagtagttatttattgccactctactcttgtaaggcagatgtggtgtagggttttatttgtttatgtaaaatctaacactgaaatgttatgtgatttttaaacagccataatagtatatatagctctttctgcctaaaccagttttttttttctgtaggaagaccattgtcctggttcaccacagatggtcctggatcaagccctgttgtcttaccacaattattgctagtgtccctttctttaaaaaacatctgttttggacaataaattatatattcattcttcatttctgtctacctggagtattcctcattcttcatgccattacatttctgtgttaaaccttgcgtggcaactctgggtagtgatagtcattctctcctctcagatgtttactatttttatcaaacatctttaataaaatctacccaattgtatagtattatacaataacagaatttggaggtttttgggcattgttatatgccctgaaaatagcctgctacatggcaagtgacacacacacacacacacacacacacacacacacacactctacacaggagaacttggaacaaaagtcctggatgcaaatcctggctctgccatcaagaattgtgggccataaggagataatttactgtagtcattaagaatgggcccaggagtcagacccacccactggtgctgggtaggtgaatttaggaaggttacttaccttctctaagccgccgattgtaaaatgtagatgggcctatctttaaatttatgtaaaatttggagatgatgctaaattcagaggagtgtgcgtgccgagaaagaatatcaattaggtagaaatatagacagaaaatagaatgtaatttagtacagagaaacagtgactgatatatatgagaataattttgtttcaaagtgagtcagggtaggcccggcccagtggctcatatctgtaatcccagcactttgggaggccgaggcggggggatcacttgaggtcagaagttcgagaccagcctggccaacatactgaaaccctgtctctactaaaaatacaaaaattagccaggcgtgttggcgggcacctgtcatcccagctacttgggagtctgaggcaggagaatcgcatgaacctgggaggtggaggttgcagtgagcctagattgcaccattgtactccagcctgcgcagcaagagagaaagtccatctccaacaacacaaacaaacaaaaagtgtctcagggtagagaagaagcctgctgaaaggcattgagaaagaaagtggtgttctcctttgtagttggggaaaggaagaggggagagtaggttgcctagtctagcgctacgtgttttgctgatctgagctacagtttaaacactgggtttgttggttattgctacatagaaattatataggccaactttttctgaagttgaagtcacttgtggggaatgttgcactttgtttttagttgcactacagattacctctttcaataaagaagatatcacagtgtggggttaataacagtgttctctgatgtattttattatgccagtaagaataataatacaagattataaagtaaccattaatcctttctttttactttatgtagaagaattaacacactattcttaagtctgatcttaaagatactttacaaaataaccccccccccaaatttttggatagaaccaaaacagcctggttggaggccagaaaaattgttattttgtaaaattaataattatttcaagtttaatgatgcatatttcctacttaattgtcacaaaaatgacaaagcagaaaatgaactggaaaaattaaagaggtgccagaaaaattattatgtatttagtttgggtaaggagatcaaagcacctgtgggtcatgaaacatcagagagggccaaatatctgagcagggggttgtgttggtgtatgggttggggtatcgtagtggtaccattcagaagtggcacttatacaccctggctttctgtgaacagtaaccaagggtttagaactgaaaattaagacgcatgcattgtaaaagatttttaaaaactttctgaatatgaaaggcaatatgagggatgtaatttggatattcaaatatgggtattctggggacatttatcacggagatagaaggacaaaatagtggaatttacatttcatagaagattcataaaaagccagaatgaatggttgcagattttatgtgttgggcagatttctatcccaaagaataattcttgtgatatttgatacaattgtgatacaatgatttaaaatcagattacatttatttatgagagtattattgatattgctgtttttaacaacatgcactggtgggtcactgtagtcaaaggaaaatactaaattcaatccgtgattgaagccattaagatcaaagctgacttcctggagtttgactgaagtgtgtctgccatgcgggtaagagcgcagtcctcatggctactgctcgctgccaggttggacggagcattggtgggtaaagggtgcagcctggggcttgggttggcccagagccttagggttgaagcaaaccatggagaagttctctttgactagtaaaaacatactaacaagtgtttcatctatttctagtttaacttaataacttatgtttactttcttgttttactttacagactttctttgtttccttgcttttgaatagaaatacaattggtagaacatttgttaatgtaatgcttttggatgtgtttttgttgtattttttttaaacttaatttttctgatagtttttctttcccatggcaaatgcaggtttttttttcatttttattttgtaaatttgagtttatactaaccactgcagagcagcagcagatataaaagcatgatctcctgggtgggggtgtgctgcttgggagagcaaagggtgaggaatggagcagtttgatggaagtttccagcatgggtggaattgaaggaagaaagtacaagtttgtacaaacctagatgaataagattcataagaagaggaaagctattttggaaactacccactatacaaaacctatccacttagatttcttgaagctttgggggtaaaaccaaatgaaggaagtcctcaactttgtttgttccaacaatttaagttggttgtagtatgttttcctgaggaatgacatcctgccaggcattccttagaatggaacacaagtctagataagtggcaggtgcctgcagtccagtcctaaggctgctgtagaacccctccccgagaggctgcgtagcatggaggggaagggtgctggcaggggcttcagatttgactctatacttgttagctaccatagctttggttatttgtggcatctcagtttcattatggatagaatggaataatggcatcttcttcatcgggttatgtgtataaactgagatactccatggcaagttcttagtgtcatacctgggacatatgtcaatattgtaagttgtttgtaggaggcagggtcatggccgtgaggcattatcttgtccttatggagaaattaattctgacttccagttgaattcctgcatttcctccaaaattttggccaggccttttcatatgctagtccccttgcttctcaccatactgtttctcatgacctttttgttcatccttggatgttcagttcagccacttccttggagatatgaatctcccttcgttggaactaaacctagtgggattgacatgtcctgttcatgtgtttctctctttctcaagattatcatccccttcaggaaagaacctgtagctcccagctccctagtttgggacagtctgccatataagagacagaatattatggttgttaaaggcatggtttgggagccaacagtgtgggttagaaccttgcaccatcacttactggctatgtgaggtagggccagttgttttacctgtctgtgccccagtggctttgtctgtaaatgggaattgtaacagtacttacctgtatcaggtaagtactgttacaagtcaagggcaggttaaatgaggaggaagagacttaggcttgaagaggtgggtaggcaggtaaatgtacctcctacatttgtagataattatctttctgtaggtttgttatgcttgactattccatgttctcccagtgatgattttccaattacttatcaatttactcctggggaattaaaatgtaatgttttttgactgtatttttcttttcttttttttttaactgttggtacttttaaaataagttgtggtgaggagagttcaaattacagcataacagaattcatttagtgaattgatgtaacattagcattagtctgccattagcatatcatatagcagtattatccaggtaaggaaaaatatgccatctcaaaaaaataaaaataaaaaataaaagcgacagacttatgtgtcaccttttccctcattttgaatgttgtactctaatgaggaaaaaccccagctcccctccttctggggcaaggcaagcatggcgattcttgttccctgcttcacagggagctgttttcttggctggtgtgccgttctgaagctcctctgccttggaagggcaggcagtccatttctagcctagataccctccatgcttgtgttagcagctgctacgaccaccactgctattccaattattaccactacttctattccactgttatttttactgctgacattactattgctaaaccaccactatttccattgataccaaaatcctgactttagttactgtattctactacttctttatcatgtgtgcagaaagaaatgcttattttccatgccctaagtagagaaccttgcaagctttctttggaatgtagattgtgccatatttttaaaaatttttatattttaaaaaattgtttaatttttttttgggccaggcatgatgcttatgcttataatcccagcactttgggaggttaaggtgggaggatcatttgaacctaggagttcaagaccagactgggaaacatagtgagacctcatctctacaaaaaaataaaaaataaatttgtgaggcatggtggtgcctgcctgtagtcccagctagtctagaggctgaggtgggaggatcacttgagcacatgagatcagattgaggctgcagtgaactgagattgcaccactgcactccagcctgggtgacagagcaagaaagaacctgtctcaaaataataataataataataataataataataataataataataataaataatttatttttaattttgggggtacatagtaggtgtatatatttatggggtacatgagctattttggtacaggcatgtagtgtgtaataatcacattatggaaaattaggtatctgtcccctcaaacatttatcctttgtgatataaacaacccaattgtactcttctagttattttaatatgtacagttaaattattattgactatagtctgcctgttgtacaaatactaggtcttattctttttaactttttttttttttttaaactgggccccatctctgggttgctttgagctagctgtcttctggctaacaaaatagttgagtgctactttctttcaccaaaggcagcgacatgcaccactttcattagcaggttaattaacttaggaaaatagatgatccaggctaactttgacctctgcacttccaaggtattcagttttttagtgcaaagactaaaaacacaaaaggaggagtaaagatgctgcttgtcttccttttgtatgtccagggactaatgcaggtgttgacagaaaaacctttgaaactgagtttctaagtctaagtttctgccaagggagaggggtgcagtgcttcctcttataaggacaagagctgttgaaagcagcagagggcttgtgtgtgtgtgttatggtgactgctggccaagggcccctgaaaatcagttggcagcttcccattgaacacacaccagaggcaggaaacacagactaaagatcatgcttaagaatgtaattgcctaataatttaaaatctttattgatattatttataaatattaatataacttctaaaaatgttcttaggtaagtttaaaaagacacattgctacattaacattgaaataagaagatatgatgacaatttaatgtaaaattttactgagttccctgactactaaggaatcgttgcatttaatttttcctagagataaactgcatcaggattcattcatcaatttatttgaaaacatgtatgtgctataaaagctttgggatacaaagacaatatagatgtattctttactctcaaatatttactatttcttagggcactaggtagtcagacagatatattatagttaagcacagttattaccataacagatgtgagccgggtgctgcagagcaaagagggtgcatgtgtttttacaatttagccctgcatttatgagcttagccatttcaatataattacatataactcatgaaagtacattatcattgaatactgtgaaaaaaaacctgttaactttaaatggtaaattactgtatttttgaacgaatgacttaaaaaattacccattagaaatgagttgtggcctggacaataatcaaaacagaaatattggcttttaaattgctgagaatagggaggttttggtttagtgaactgatgacaagattacagctaaggaacaacccttctccatttatgtcctctctgcatgtcctttagggtcatcatttactgtgatattagcatcagtatgaaaataatttgaagcttcatattgtgcagtcctaaactgataccacatgtagcatacttattttgtaattcaggggatatttgaaggtatgatttcttagaatgaggatgatgatgccccttctgttgggacccactgatacacgggggaaaaggacaaataaggtcctcatacaaataaaaattattcttttattaaatttctaggagatgtaagatttagctcacctaattttaaaagagagatatagagaagatatggtgaaagggacagaaatagggaactccagtaagagagaagcttgatattattatattccttacacctcttcctccttaccagttaaaaaaaaggatgatctgagacctttggagaggtatagaggaggagttatgatgagaagagaaggagaattcttcttgtaccttaatgtttgtaaatcggtttcatggtcgtctcttctgtgcctttcgaaactgccaatcatcttattataatggccactcataatttgaattatgccagaccctcaaattcagggccgatctttcaatagcaagtgtcctactgagaacttctttattctgagatgctgagagcttctttcttcaacacacaggttggctctgggtggtccttgcctcatcaaatataagttagaaaatctacattgtgtgaaggtctattagcactcaccgaccttctcatgaaatgtcatttctcatttgggactgaaataactcatctcacaataagctgtagagatttttcctcttccattgcctcagttaacaccactagtccattattcctagcaactttggagaagtcggtgtttattttttcaaataaaaagggaagccatcctgtttgcattcatatctttgagaaaagtcaagatggcttttacacatagagaaaaaggaaaccatacacttttaaggggtagaggaaaaggagcgattcagagttttgtagtgaactttagcagtttgaccttcaaatgtttccttttttaagcgtcaatattgctaacattaaagtggtaacaggaggctgcaccttgaaaagccactcatgccttgtctgttgtggtagctacctggttatgaaacattttctaatccagagagctttggcctgatttataattttaggatgttttagaccttgatggtgttaaactttcttcttcggaagttatgtgcattgatattgagtgcttttctaccattttccttcctcaccttgaaataagcgagctattcatgcccttctgaagagggagagaggctacgcatggttgttgaagacacatggctttgttgttagaatacatcacttttcactggatatacctgagagagaggctaggcagcatctaattactgggagtttttatatgtgaagacaagaattaactgactccctggcctccttttcacatactatgtcccccaatttgctaagttaccattttcagtgaatgccctgctatccttccagtgcccaaggcagagagaggtacagttataattctgaggtcttctcttttctctcccactgcgtccccacacacagtcaatcaattaccaaatatttcttttccatgtaatctcctggagttcttcccatctctccttctactatcctagtctaaatcccattatttcttgttaaattatatgataatgtcctggttgtccttgtcttgtcttcctatgccacatcatctctctagtaagaagaaaaacatttaattctataagctgcaaaaatggagttaatataacatagtagttaaggatatgggccctgtagccagaatgtctggatttgaatcctgactccattgctttggcaaaagcagttatgtaaatgttggtaaatctctaagcctcagtatgtgtttaaaaaaaaattaaaacttttctgattggattgttgtgaggattgaatggcataaacatttagcatagagcttgacacatagcaagcaccgaaacatcactacaacaccaataatcataaatgcaaagctgagtattccgctttcctttggtgctttttttcttttcttttttttttttggagacagaatctcactttgttgcccaggctggagtacagtggggtgatctcagctcactgcaacctccatttcccaggttcaagggattatcatgcctcagcctccccagtaactgggaccataggtgtgtgccaccacagccagctaatctttgtatttttagcagagatgaggttttgccatgttggccaggctggtctcgagctcctgacctcaggtgatctgcccacctcggcctcctgaagtgttgggattacagacatgagccaccgcatctggcctccagttttctaattaagaccttttaacctcatcacttctaggacaaagccaagatctctttggcatgccatggacatcccagctcccctcttctgttccttctgtcagcgctcttgtccagagaagtgtccatctcaaccgcttccactgccccaagtggtccatgctttcatgcacattctttgccgtttgactggagcatcctctcactgcaagtctggaaattgcctttctgccttctaaacaccaaccactccttctctttatgtaggtgactcccactcatcctttcttacctcatgtatcagttattccagaaagctgtccctgataccctagggctctcaaggagcatctgaatgtattcttcattgcacttgccaaactattgtgcaaccgtggactcacttgtctgtatgttctgtctcactataataagcctttgagtatagagtctggatcatgtttgcttttcttgtacccagctcttggcatttttattcagttaacatttgtttaatatattaataaatcactacccaattggggatttgttttatggagtttcattatgcctagtgcataagaggcacctcatgaatatttgttaaatgaggatgcatggctatttaaacttttgtgtatccttacttggcaactcttatatggatacactgaatatttaaagaaatttaaagttatttaattctaagtcctgaaattctaaattctaacaaattgttaagttaacttatgtaaataagttagatgatttagcaaagttgtacaatttttttttttgtcaaaaataggtatggttatgaaacagtgagctggatttgcccttctgactcataaaatatctctgaaggcagtatatttgaagctgcttcagatgattcaaaggtctagcagataacttctaatctcaaagaatgaatagactgggaaaaaaaaacactcaagtaatgttgtgccaaaacaccctatctctagccataaaatcatacattcatcagttttcttcagttatctcaattttctttttgtctgaacacagtgagataagaattggcttattatgcactccacaaagaaaattatagaattttctgagaggaacattagaggccagttaggccaatcctgtgtatatgagccgttctgttgcaagtgatagattgcttaagcaaatggtggaggtatttgttcttctcatgtaattggctcttgtattctaggagcagcatggtggtttccaaatactatttattgtataaatgaaaataagacttatttggagaaatggctgattccagagctacagcagtgaaaatgtgagatggacctgggacaacttgatataagaaagcaatgaaacaaatattattgtaattattaattatgttgaaaggaaacatgaaccaatttgaagggactcccagtggccaaacgtgggacaatatgagcattaaaaaaataatgatggcaattgattattacaaaaatagaaaaaaagggaggtcaggggaagctttttttctgttttttgacaaaagaatactagcgtgtaagtaagaaaagaatgatagagttagaaaaatcactattttaaagtctcatatggaataattaaagcaaggatgatcaaggaatactaatcccattgtgaaaaattattgggaaataggacagccacatggtaccacatcttcacccctgggttacttactgctataaaggggggacatgtacctttacagtagagagatgtggcagtaaccatcttaactaaatgattgagtttagcctcagtaatgatgggacaccctaacattttgtgtcttctgatgtgatgaaatatgaagttcacagtatgaagtacttttatcagaactgtttaatttgaatctagatttagctttcagttcacaggaaatacaagtgaaagaataataggtttaatgataccatgaagaaacaaccaaacaaatgcagaatttaggacattttgtaagacaaccagcctggactcttcaaaaagtcaatgtcattaaagaagaataaaggcaaaagtatttttagattaaaagatactgactaaaagataaaactgccaaatgcagtgggtaaaacatgactggatcctagtactaaaagtgggcaattgaggaaatttgaatatggaatggatattagataatatgaaattattgttaattttcttagatataatggtattgttgatctgtaggaaaaatgtccttattcctgggagttgcaggtagagtcagagtatttaggagtcaagtgttatctgtaattcattttcaaatagctgaacataatacatttataaatatataaagggtataggtgcaaaagcatatatggcactatgttgcaattgttgcatgtagatggaatgttcattgtattctttcaacttttgttctgaaattcaaaaaaataaaataaataaactggaaaaaaaatcagtttggtaaaagcaaagcaaaagtcctggagtggactgctggcaggctggcagcctcacttcctctattcctcagctctgttcctatatgtgcacagagccacacacttgtgagcattgagtgaagtgtgagcctagtgaataacactaggctcgcactagactcagcactaatttagtcaaattttggagcagtgggaaaatctcctgataaatttaacagagaagcttgaggaagagctttgtcttgttcatttttaacatttccagtatgtgtaatgttgtaggaattcaaaaactgaaaaatacataaataaaggggtgaccaaatttgaggattgcctggaaaagtgagagtatataagtgactttcaaattcagtaaatatttgtggaatttagtagatctgaactagttaagggacaagtaagtttaagatgaattccagaagtaaggggaaggcctctttttaaatcttctgtgcatgcaatatttcatattgttttaacttttagtaataatacttgcttttctgaattagtgatcaaagcactttatggaagtcttctgcagctttccctacaggtggggaaagtttgagtttggtgggaaatcttcagagcgtggtgtgtgcaattatgctttgttccttggtgagctatgagtcaggcacttaattatgtaaacgatattgcaagagagcagttgcataatccccaagagagtaattattatctgtcttggtagaatacaaggcttttaatctgtaaataagcaattctatgtggaagagctacatgcagagtgattctgtgtcttaaaggtctcttatgaattttttaaagtgaaagcagtaactgcatgtgctgattacctgctgcctttgtgtttcaaagggtttatgatgcttcccttgtggttttaatccctcctgaaatatttaagcctctgagaatgattcccgtgaagggtaaagtgtgtctaagttaagcctatgaataatccaaatgtttcaaatgtattaatagatgaagtaaaaaaagatatgctttctgcaaattaaaaaaacaaaccaagataaacaaaacaatgaattaagacattggcaacacttttaaaaaagcaaagatacaataattagctaatacgttgctcactttttgatggttagtaggtttttttccatttttttaaactttattttggtataacttacatataataaaatgcatctatttaaagttttcacatgtatatttttaaaaaaatatgtgccactgcagttagggtatgtgtgtattttgcttaggtggatctgagtcttttagacactgaaagcaaattttaacttttgtttttttaagtagtcagtagtgtctgccttccctcctatctccctgttatagtgtggatgagttgaccatgctcttctctaaggtcagctgctgcacttaaacacttgatctctccccacttcacctaatcaggactacatttggggaactgtccttctctgctttgttaccagctttcccctctctatcaggttattcccatcaaaacagaaacatgtctcgacatcttctgctgtttcttaaaactcttgaccatttctctgttctcctctgcagcaaaactcaggagtctatattctgtcttcacttccttttctctctttgtctctgaaaccaactccaagaggcctttcatcccactcctccatatagagcctgcttttgtcaaggtacccgtgactttcacactgccagaatccatgggcagtgttgaccaatccgttggtctaaatcctatttggccgtctgcagcatctgatatagtttttcactcccttcatctagaaacacattctttacttggcttcaggaaaaccctatctcctggttttcctacttcctaactggtcactcttactaagactcctttgtgagctcctcctcttttcctgatcctttaaagtttcctggctcaggtactctcctcttctttgctctattccacagtcatttcagccagtgtcatggttaacagtcctctgtacactaaagactcccatatttctgtctgaagtacacacctatcccctggactccacacttattggatgactaataggcctctcagatttaacacagtcaaaaagtgaccacactctggtcttcccacagttgtctctcacctgggttattgcaagagccttatgtctggttttcctgcctccaccctagctccggcccctttcactctatattcagcacaacaggccaaaaagacctttttaaaccatcagattatgtcctccttttggccaaggcctccaatgacctcccatatcagtcagagtaaaaactgtcccataaagatcttcatcatctgaccccactagctttccatctttcctccttttccccccattactcactctgccttgctgcactgacccctttctcagacacgctcagaggcctctatgtcagggccttggtatggaacacttctttagtctgggctgttgtgtgctacggttctccatggcttgctccttttgcacctcagatctctgctccaccatcctcttctctgtgagaccttctctaaccatcctgtttaagttcccccacccagccccaccaactctcctgatccctcctccaggttttatttttctctattgcacttaccaccatatgaaagtaaaaatacttgcttatttgtgtttgttgctttgtctgttttgtctgtcttttcatattagaatgtaagtttcatgagggtagaaattgccttggtcacagctgtatcacctgtgcctgagagagactgcaggctcggtcagtactgctgaatgagtaattgaaaagcaacttcaaaggctgcttgatgctttcttgtcatttttagagcagtcttgagtgttacagagggtggatagcattcagaataattaactttatgctaacagctcttttccattcctcagtttctctgtttgaagaacataaggacatttctcacggcctgttgtgagacgtttggaatgaggaaaagtgaacttttcgaggcatttgacttgtttgatgttcgtgactttggaaaggtaattatacttcatttttaacactactttttaactggaaagcatttaagcaaattgtttcaaatcttgaagtagggcatgtgacttaagtggtttatgtatctgcattatatagttaaatttcacatgtagatggcttagcaaaaccaaaaaccaaaaaacaacaacaaaaaagaaaccccacacatacaacaacaacaccaaaaaattagcatcaactttccaaatgagattagaattattttgtaattaaaatagtatacagggagggaatcttttctccagagataattttttttctgctggtcacctcagaggttagggttactattatctgccctttaggttgatcactgggcactcaggcctgaggaccagtattcttttcctccagtcttctctatatctgaaagctgctaatttttggaagttgagaatgttctgttgtccttttctctattttgatacttggttgggtgactcagagaagacatgaatcacaagtgttcaagattgttgaataatttctgttgcttgaatttcagcagatatttgttggatttcaaggacatttttcacatggaaattgttttaatatttactgttatccgtatgcacactaaacacatgtataataagtgaaacaaatcatcatttcaaaaattatggtcatttattatgaagtgagtggacataaacctctcacaagtaactagccataaaagagtcaggtaattaaggtgacaggactttagcttatgctgatgtaattgcattatgaaaataagcaaataaggaggaaaaaactaatgctattgagaagtttgtccttattcttgtaattcaggtgctagtatcttatcaaaaggctgtttgagagtatacattgttttaactctgagatataatattttcattagaaaataaccaatggattgctctttgctaaacagcataaacttgagacagaaatataggaaatttgatgctgaaatacagcgcatatggggaagccactctacctggggtgggggaaggccctggttctctctccggtcttaacccatggtcattttgtgatctagaaggcaccagccttctcaggcatcaggctgcctgccagcttggaaagctgtacaaaaggaaggggggataagaaggtggtttctaagattcctttaatctctggaaagctgtgatttaactgtcttgaggtccaaaaagtgatggaggataaaagatgataatttgtacaacgaactgaaagccaagcccctagtaaggaaatgggagcgcatttgtctgtggccatgaatcacaggtgaggtggacacttctctaagctgttggccctgaaaaacaccagagatatttctggttttatttttcttttatccttccgcctgttcctcctgcacctttaaaaaaatcttccttgatttttctttattttcaccctctcttttggggaaatgaaaaatgaaaatgaattggggaaatgaaaaatgaaaaagtcttgactttttaaagctcattaaggaactatttatttttcatttaagtttgcaagaaatggtgttgataaatgttggaaaaatatataaatactttaaaatgcatggtggtgttctactggaatgagattgcatgctagattgattagacaacggaagctttgtaggagagttgatactacaaaaaattgaatgtgaaagcataaactgtatgcttctcaaggataaatgtatttttgactgcttaaaatattttagcagtggtagatctgaaacagaattaaacatgagattgtggtttagaacttgaacctacattatagtcacttacattttgctactgccaagattggagtagctatctctttagaactgtatgatctaaagaaaacactgaaagttaaagaatttgtgatatagcttcataatttaccagtactaatagtattaagcattatatactctaagtaaaaactgccaataccaccagtagttgaacacttaaaatatgcagtctgttcagtcttcatgtataatttgtaaaattgtaacaacgttaagaggttaggtactacatttttctcttctgcatcccaaatcacatatctatttgagattgaagcagcagtttgaactcaggtctagctgattgtccactactgtaccatagtgcaaacattcacatagcacataacgtgtactttgcatatattgagggaatcagcgcatcaatcccaacatgtggatactattatttttcccatttataggtcctagcttgtgggtaatggaactgaaataattcttgtagttttaagttgaaaaaatgtgaatagtgttaattcagaaacaaaataatttctgatgtcgtgaatatatacattttaacaggatgtggataggttgttttcctccattccgtaggatttaattaaatgttctgttaacttaaaatgaataatatctatgtgtgctctcctgtctgcctcatttcctacattggtgaatctggaattcatgtgtatttggcatctttttgccaaagaatgtattaattatgatagcagcacctagtgtttttatagcctttgaagttttcagagtgcttaatattactgacttcatttgattgtcataatactcttgtgaagacattcttcagatgaggaagctaagacatggggaggtgcttggatagtgattctagggtctccttgcttgggaagaggaacaagatctggagctcaggcctctggcttctcagtcctgtttttcttgtccactgtctgtgttttgggtctcactgctctgtggatggtcagggaaaaggatgaacttatagaagaaaattaaaggaatttataaaattaaaaaacacaggtgatgtgttacttggcatctacttatactttagaaagaaaggaaagatttaggatactgcatgagtctgcagcccagtggtggttaaagttgtttactctaaataggcatgtgattcactgattgtacacatgcagtcaattcttagctatactctcttaccccttttctcattgtggtgttttctgctcactaaactttgtccaagctctccctctgtttggggtttaggagatttattttgaatcttaggcttgatatggatgtgttttcttttggaaaatcctggaaacagtgttaacacaaatgataatttgtattttgtgagatggtgaagagcatctatttgggcttctctagaagggcttatgataattctgcctttcagtgctacctttattcttagaattgagctctttcctcagtagtaattcacttcaaactccaccaacatcaacaaaaattagaacagtttgaaacgctttctacacttttttttttaatcacacaggaaagaggagtgagtttagtaacttgaactcatttaagagtcagcagaggccttcaggttagatatgactctcactcttcagggttgttaaatactgaaaaaagctcctgaaagagggagatttcttttctaagactgctgaggtctggtggggggagagggggggaatgggggacgttgagggtttatgttttgaaaaaccatttactttcttacttttgaaaaaagatgaatctctttctggctttctgataataaaaataagtaaaatcttgttagttaacttctttgcttaagaaatgtaattaaaatgtttcccctggcataatattagaaattactatattattttttgacatcatgacagtatctgtaactttgttcgtttccgtactgtatgtaaagaattttccataactgtttcaatcgtcagtttatgattaactcactctttggaaatgtttcctactgagctgtctgttggcacattgacagtgcagaagcacatgggattttttctttaatgagacaatttctagagcgtaatagaagtcaggctgccactgtccagatgagtgactaaagtcatctccttaccctgcctctgggtgagtgtgaagggcctgcttcccatgacacacagtgtaaagtgatatgttttcttaaagagtatccatacctggccagtggtaggtccagttgatttgaattgcaataggatagtttcatcatgttcaggttcaggacaggcaccgtcaaaaggaattcagagcatcagcttaggggtgagtcagggatacaggtaagaacattattgggagagagagagagaaagagttgtattttagttaagaattaaactaaagagcttcttcacagcaaaatgaacagtcagcagagaaaacagacaacccacagagtaggagaaattcttcacaatctatacaccaaacaaaggactaatatcaagaatctacaaggaactcaaattagcaagaaaaataaaacaaacagtcccatcaaaaagtgggctaaggacatgaatagacaattctcaaaagaagacatacaaatggccaacaaacatatgaaaaaatgttcaatatcactaatgatcagggaaatgcaaatcaaaaccacaatggaataccaccttactcctgcaagaatggccataattaagaaaccaaaaaataataaatgttgacatggatgcagtgatcagggaacacttctacgctgctggtgggaatgtaaactagtacaaccactatagaaaacagtgtggaaattccttaaagaactaaatgtagaactaccatttgatccagcagtcccactactgggtatctacccagaggaaaataagttattatacgaaaaagatacttgcacacccatgtttatagcagcacaattcacaattgcaaaaatgtggaatcagcccaaatgcccgtcaatcaatgtggataaagaaattgtatatatgacggaatactactcagccatacaaaggaatgaattaatggcatttgcagcaacctggatggaactggagactattattctaagtgaagtaactcaagaagggaaaatcaaacattgtgtgttctcactcatatgtgggagctaagctatgaggatgcaaatgaataagaatgatacagtggacttgggactcaggggaaagtgtgaaaaggaggtgagggataaaagactgcaaattgggtttagtgtatactgctcgggtgattggtgcaccaaaatctcagatcaccactaaataacttactcatgtaaccaaataccacctgttcccacagaacctatgtaaataaaaaattgaaaaacaaaacaatacatggtttctgagttagatcttggtttggattccagttaagctccctattagtatacagtcttgggcaagtaacttgacttctttgagcttcagtttcctcatccatgtattgagtttaggtgagtattaaatgaaattgtgtatgtcaagtgcttaacagagtgtcaaggtccaaggtaagtactcttattgttaatgttattatcactattattatttttaatgattgtgggattcattggtaaacataggtgtcgaattttgaattaagtgcaagagaactaatgatattaaaagggtgagataagaaataaaattcattctttctaatgttgtatagcactattttattttattttgcacagccatcgtttctctttccttctgtggccttggatctcctttgagaaaccacactttcctctttcttaattacagagtttggatggtttcatcaattatatcccatgcctttgaccacatagtgatggttcaggaatggggttagtcactcagttgggaccaataagacatttgcaagggtagttttatttttctctcttcctgatacagaagagtgtagatgtgagtctacacaaggagctataaccatctgggtaccacatggagtttcaaaatggacccagttcagagggaatagagttgaagatgaacctagtgacaccctgtgaagtgggaatcagtgctgtgcccaaagctaaatgtatatctataggtttttccatgaaccaatacattcctccttttctcttttttgagccagttttcactagttctttcaaccaagagtaagagaaatctaagtgattcactgtgtttcaccagttaaatgatttcaggtttgtagatgtgttaatctttattaccgaagttccaagcaatttggagaccatttgttaagcctctacatctcctatcgtatatgcaagaggagatataaagacaaagtcccagaacctattttgcagcatgtaaataataaaatagaagtacagtcccagcttcatagtcaatgctttcttttccttgccagtgattccagaaatatcatcgatcttgaggtttagaaggtcaccacaggcatcccgacaacctacttgagagcctgcaatggtttactactacctgtctatctttgtgaaattctgcctggctttccctgtcacaagaaaaccctcccaagcaaaggcttctgagcctttcttggctataggtggccccagggacctcaccttggcatggcttgaaagagccttattatctagtgcatacacgttaatcaacacctgaaaacattttttcatatatacatatgtaaacaggaagaattattttagggtgtaaatctttttaggtacttgtttgacataaaacacgtttgatgtttctctcttgaagtatttcccactcaaattatccagaaatctttgggctttatgtcatccatgggacttaaatcagccttgcttcaaagccccacaggagcttgatctctctgtctgctagtgtggtgctattgcacaagactggttctgtgtggttcctgggacagctttagtgctctgatgctagcaatgcccttgtattttcagcccttctcaaccccatactacccacacaagtttccttcatccctatagcattttagcttttgcattgagcctggccaggccatatctccctaactttgtgatgaattcttttcaggggctccttgtattctgtcagcaagcctgggtcacatcctcctcattcagcccttacagggtaccaacttccagtctcagagcggcatttgggatcctgagtatttttcctccctcaagggtctggaattttcccacaaattagccagcttccagcctagagctggctcagcctggcaaggagtactgtcaggagtcaacctccactcaccaaggccgcgtttgctttgtccccctgagcagtaggaggcttgcctgtaattacataactaagggggagctctgcagtgattcctccctgaacaaagatagcttgttccaaggctacctttttttaggcaaaggaggagggaacagcttctagccttccctaatgtatgtgtctggctggctgttaacacaattcccagatcattagcactattgccctcctttgtttttggatggagttgacctgtttaacaaccttctcatctttttcccttttgtaggggtatttaatgcttggcagatttttccattcctacctcctcttatagaactttagtacccgagccatgcaaacacattttttacaccttagtgattattcaagtccagtttttagtctgctcctaattatttttgagtcagttcaataaactctttactcttctgtaaactaaagactgttgaaaacttctggaataatatttcccaaataactttgcaaagaatcccattgtcctaagaaatgttaataggaagactggagaaaaatattcttgttccaatgagtttggtaaacactgcatattgtatttatgagatatagcatagtaaaggaactgaaaagtcctgcagtgaggaaaacaaacttttgtttactccagaatttctcatatttgcacatgatattaggtatttagatatcatgctatttaggtatcacacaattgcttcaaactcattatgtataaaactgaagtacttttttttttcctttggagacatttctattttggtaatgtttcttgttttgttcaccctgccaggagctaaatggttacaaatgccctattttttttttttttttttttttttttgagatggagtctcgctcttttgcccaggctggagtacagtgacacaatctcggctcaatgcagcctccaccttccaggttcaagtgattctcctgcctcagcctcccgagtagctggggctgcaagtgtgcaccatcatgcctgggtaattttttgtattttttagtagagatggggtttcgccatgttggcccagctggtcttgcttgaactcctgacctcaggtgatccacccgcctctccctcccaaactgctgggattataggcatgagacaccatgccaagccaaaatgccttttctttaaccctccttgcttttgcctttagttgaggtactcatcactgggattattgaaattgtcttctaggtgttttcttgccatcagttttgaatcgtttcaagctcatcttcaacataatcttccaaaaatgtagatctgatcattttactcatgggtttatcaccaggggaaggtatctgagttaccagtggcgaatctgtacaggtctacaggaatctcaattcttgcctcctcagaagaaagaattcgactgaggggcataaggcagaaaaagagaccgaggcaaatttcagagcaggagtggaagtttattttaaaagcctttagaacaggaaagaaaggaaagtatgcttggaagagacccaagcagacactgaggtcaagtgcagtgtttaaccttgatcctaggactttagaagctggcccctttcccatgattcttcctttagggtgggttgcctgcaagcccagtaccctccttatccttgggaagtgagcacacacagtgtgtttagtatgttgtatgcatgcctatctgagactttttccctttttctggtggagtgcccctggaaactcatactctgccattttgtctcttactgtgtactcccaggaaattgcttatctctggtgcctgcattcagttaacactttagtgcaacaggtgtggaccatcaggaagtggcttttcccttgcatcagctgccaagttatcacttttagagaggcagtgtgataattgccaaaccttcacctgacagtcctagtggctgggagaaccctttcctgtccactcttgcctatctaactagctgtaacaggtttaaaacttgatagtggatccctgttgtttataagagaataacatctaaactcttttacaagccgcacaagattcttcatgatcaggcctctgcctacctttctaaccttatttctcactttcctactcccataaactccctcgcttaagtccttccaaattataaatcatcatgactcaccagattaatattgattaatattgtttcctttgcctggaatgccttttcttttcattccctttagtcccttgtctgcggtgactcaattcaagatcacatacactcattacactcatacacacactgcttaaaatctgaaattatgtgctttatccagagctctggacttagttggttcttggatatattgagtcttctgggcctggctttgctacttgtctctgcacattccctcagtttcaactgggaccttccccctgcttctctgccccacagaaattggaccttgacacattacattggctcttttcttcagctcatcctgagactttgagatcaagtaaaactgactttcaccctaccctgcccccagccacctgtgtgcaggaaagttgctcagcctctcagagccttcatgttttgatctgtaaaatggccctgatgaggatccctactgcatggaattgtggtgaagagtgtgaattgaattctgagggaaaagcaaccagtgcagtgtggggcagggggtaaggctcagccagaggtaactcctgagtaattcacccatcatttactcattgggaagtatttgtatgccatgtgctcgtttatcagggtggaggagcaggtagtcaagaccccctgctctcaaggcactgtcactgtccatcactatccaagttaaggaaacaaattggtaaagcataaacaaacaagataattacaaccagtgataagtgccactgaggaaagaaacagagaacaatgatgagcagctggaggaagccactttagacagactgggaaggaaacccatttgaaatagtgacagcccagtgagaaggggatgctagtactcacacatttacttatttatttattattttttgagacagggtttcaccctccatgcctaggctggagtgcagtggtgcagtcttggctcactgcaacctccttctctctgactgaagcaatccttccacctcagcctcccgagtagctgggactacaggtgcatgccaccacagccagctaatttttgcatttttttgtagagacagggttttgccatgttgcccagactggcctcaaactcttgagctcaagtgatccacccacctcagcctcccaaagtgcttggattataggcatgagccaccacgactggcccttgccctcttatttaaattaagttttatataagttataaagcacattttaactagattctatcctacctctttcagtagatccccttgggctactccttcaacttggcctcagtttgttcaactctgatattctcctgattctaaaatgccacttattggtagatgtaatatgtatacattgcattttgtaaagtaatgttttgctttgatgattcttagttgtgtaatcctctctgaaaacatcaaggcttaggctctctcataccttttgtttatatataagctcttctgcagaggcttttaaacctgggtatacttcatttttggtaatattgacattcccttaaaattttaaacttttagagagaaaacttgactgtacatacacttctggagagagaaaggcattataaagagctaaaagcatgataaagatatcacctagattttacgtctgcatttggcatagctactgagaatgtttccaaaactggaaatctggtttgagaactgaaatcaaacttctctttgctgtttcaaggattcctctatagatcaaacagtgaatctttcgggtagttttttaaaaaaactctatttccttcctaatatacatgtaaatatgcacacagaggtttacagacataccaagatatacgtatctatatacgtaagtagagggaaagttatttaggaaggtgccgaagtggtaatccacatggaatttttggatttcgctgatagtcctcacagcttgagtgtaagatgcaacaggggcaagctggatcttgaggtccagcagagattggggccagagtatgagggcccttgagatcttgcagggtctgcactgattctgacaaagggccagtgagtactttttaacagatagacaggagatgaccatagacaggagatgacctgctaagtgcttgagctaagcattctgtcagtgggggaggctgtagtggataattgtaatgccagtggtaggaggagcagacttgaaactgaggcagtctggttaaaaaatgatgcagacctttactagagcaactgtaaaagaggcccagagtttgagagatttgggatgtttaagaattgaagtgagtggtcagaggatgagaagagagaatagtgagccttggaaacctggcgaggggaaaagtagggtttattgcaagggaaataatggagcaagagcaaatataacttacagtgggtttcaaattaatgtaggagaattctaatggcatttacccttaatttatgtatattttacaaccgagtagatatgttttatttttctatgatttttgctatattgtgccatcctaaattttccctttgttcctttttttgatgttcagttggttgcttggttgggtttttttggtatttactgattatctagtggaagcttggtccctggtagaacacttagaaatttggggtttatcatttctattaaaaatggaaaatattttctttctgtgtaataggaaaccttctaggaatatttgtctgtatttccaaggctatggcacatatatgctcactaatgcacgtattctaattcctagccttagttgttgggccgtatcctatctgagctgtgttcagaaatccttgaccttgtcacattggcttaagggtaagatgtagtttatccaagttacatatggaggtcattgagtcttcatttgcttacaataaattgtaaatatgatggatgagaaatatgtaaggagaattggttaattccagtgggtgatatattaatagtcaatttacttgtctacacaaacaacagtgaggcagaactcttggcctttgactgttgtgcctgtgtatttcctatcaacaagatctcctagaaaaggaggatggcactttccatgtttattttctgtgtcttcttttttttaatggcttatgcacatctgtaggaataaaggaggctggtgtttgcttcccatgctcagtgagaggggtagtgtgggggtggaactggctgaatgctctcatttgcacaggattaggcagaggaagtgtgcaccagtagtggtatgagcaccaaacaactacaggaaacaatgcttggcagtcactgcagctgtgtggagtccggctgcgcaggcttcctctggatagagtttagtttctgagtcacttgttttccacttaaagcacctgtgtctttggagaactccattgaagaaatattagttgaatatgggcctttctctggtttgcctcaatgccaattataatgctctttggacatgaaaagttctgctaaatcaacatagtgtctgaggaccagtggtgtcaggacaggccagtgcgtagagcagtcagaaatcattaggttagaaaaatgaatggtttttaaatctttcagaacactccccactgaagtatgtatgcatgtgtatacacaattaattttgcacagagatgtgcttggtgaccttaggtataggctttaccttgctactctcattctttgtttctgtgtagaggaaatgaaggatgctgcttgctgcttctgagtaagcaggtgccttatagattgtgtgctgaatcatttacactctttgagttgtcttttaaagtagctgcatatttataattcatcttagacaagatgatcaatctagaatggttatattcggatatgggtggacactggacactatttttattggtcagtctaggtcaaattttaatgatgattgatagcattggatatggattgggtagagtaataaaaacatacatagaaggctagattcatgttagaattagctatgcatctgctccttatatctataaagtttaacaaggattctttaccaaaatcactgctgatttttcctaatagccttaggcttttgggaagaagcagcagaaaaattagaatttattggctgccagatgataaagtacagtttcttggggagatagcaatttagaattttagcaaagttactatgaagtataatgatgaaagggagatgatattaattagcgttggcttttacaaaaaaattgttgaagtatttttagctttgtttacttggaatttggtcagttgactgcacccaagattctccaaatacatagacgtgtagaaagataagcaatcaaaagcatatattcctttttttctatactgttttggattcatggttggaatcccttctgcagtatttgaacaattcctagagatgtaacagaaatttcttaagtagcaacagttccaattatggatccagttatggataatgaattatctagagattcatcactaataataaagcataatctatctttctaaattttcttccattggttttagagcagcacagaattaatttctacaccttctgtaggacaatcgttcaaatatttgaagattgttatgtttctgtaagtcttttcttctttgttgtcttctttttttgtaaaagatagggtctcactgtgttgcccaggctggactcaaagtcctgggcacaagcagtccttgtgcctcagcctcctgagtagccgggactgcaagtgcacgccactgtgcttggcttctcttcttaaaatgaaataaacgtcgtctcctcagttctttcttttttgattatttctttctaacttctgtgggtaatttgaaatgtctgattaggataacacatatgaaacagcacagttaaaggttaagaaatttaaaatcgaaggagagaatagaagccatttaaagaaagggacactatcatcataccaagtggtttgaggattacagtgatctctcagcagccctgaagtcaagtaaaaaagaaacccaataggttaatacagaaatgagttcatgaactagcttaaagcctttgttcccagtggtaatttggaaaatgctaaattaaaagcccaagaacttaaattattatagagataaccaaacatataaaacctagaaaactactacaatcaccgctcatatatctactattgaaaaattatcatttctgtctctacaaaaaaatacaaaaattagccaggtgtggtgccatgcatgtgtagtcccaggtacttggaagattgaggtaggaggatggcttgagtcaagaatgtggaggctgcagtgagtcgagatcatgccactgcattctcgcctgggtgatagagtgagactccctgtcaaaaacaaaaactaacatttgaccatatttgattcatctactatctattataaatacttatataccgctatttttgctgaacaatttaaaagtaaatatagataggcatcatgacatttgtcccctaaatacttcaaatggtacagccgtcaaaataaggatatttttctatataaccataatatctttatcacatataacaaagtgaataatacttccctggtattatttaatatccagatatttaaaatatcaaattttactagttttctccacaatggattttatagctagtttctttgaatttgacatgattgaataaaggttcagacattacttttggttgtcatgtcttcatgagtctaagaaaaatgttttctttagcagttttataaatatcttgatttgaatttaattttctgatgatctaccaaaggtgattatcatttttgatgtatttatattgaatttatactgctcctctttgagtttgaataaagctttagttttctgtaatttaggggatttttaaaagccttggcttgcattcagtgtggaagggactcagtaaatatttttgttaagatttaaataagtagtataatgttaaacagtttacaagtattttaggactattatcagctaagcactaaatcagtcatcgagaattattccatgtttttatgcagagtttaaatacaaggaatgtactcttttagataaatagatcctaaagcatgttttctaatcaagaaatgtctcaaggggctaggtgtgctggctcaacgtctataatcttagcactttgggaaacagagggtggagaatcactggagccccaggagttcaagaccagcctgggtaacatagtgaggtttcatctctacaaaaaataaaataatgaactgggcttggtggtgtgcaccagtagtcccagctattcaggaggctgaggtgggaggaggtcaaggttgcagtgagctgtgatggtgccactctactccagcctgagtgacacaacaagactctgtctccaaaaaccaaaaaatgaaaaaaaaaaaaaaactcctcaagaatctttcagagttttggagtcttagttgcttgaatgctaagatttttatctggctaaacaacaacaaaaaagagaaaacaaaaacacccaaaccccaaattatttagacagtatttaagccatttacactttgtcaaaaatgttagaattctgatttatccctgcctaaaacaactgtatagtttcaagaacatttgaagaatgagatgtcatattcttgcccatgggatttcatttctatggagcatttacccaaatatttgctgtgactcacacttccaggatactctcatctagagcatcagtccccaaccttttaggtaccagggactggtttcatggaagaaaatttttccatggaccgagtactgggggaatggtttgggggtgaaaccgttccacttcagatcatcagacattagattcttacaaggagtgcacaacctagttccctcgcttgcacagttcacagtaggcttcatgcttctatgagaatcgaatgcccttgctgatctgactctaggcagagctcaggcagtaatgctcactcacgcactgctcacctcctgctgtgtaccagactggtactggtctgggggttggggacctctgttctagaagtttcactcctttttaaaattttcttagatggtatctgacttaaatttttcttagattttggttctaagaaatataatagttaaaatttcaaaagcaatagttttgaaggaaggtttagaagagaagaaactgtttttagaaaatcttgtataatttcagtgctgtcaatatgttaatctcaaaatgaagatcacatttttaatcttagccctctaatagcaaagaaatgggaagaaagcaaggaaattttcttgtagttaagtggattttcctcctttagtttaaattctggtggtggtatatctttaagagtggttaactcacttaagagtgaaaagaattccctaaactcaaaaagtataaaatgtataagcatattctttattacatttattattgccagagtggttgtagtttgttcaggattaacattttctttacctatgttgttactatatattacttgttacataaataaaatctgcaccaaagttgggtcttataaataatataacatttgtatcctctttttaatgaaaaatttcccatgtagtccatatacctttcttccacattttttctctctcgaactccagctgatctaaaaggaatctaggaagcattcttcattcaacctttaagaggcccagcaaagtcttttggtaaagttgacaattctttttctgagacaggaatcaggcacagtcagtcgataacttccccccctttcattctgcattcattctgaatattttatgacaaaagcttttagttttgttacagaaaaaaaatacaaagcccagatttgtccaaaagaacatacccgcaagaaggtctacggcagtgaaacagaaattgaaaagagttgaaatggaatttttttccatgtttcatatcctccattgttcctaaacctgtaccattcattgtcatggaaaatgttactacagtctaaaaagttataacaaagttcaaaatttatagttaacttaggatttttaataagaatagaatatatatcatatatatgagaatttattaggtagttttaattcacaccaccacaaggtcccacaataggctgtctgcaagctgaggagcaaggaagctagtctgaatgccaaagctgaaaagcttggagtctgatgtttgagggcaggaagcatccagcatgggagaaagatgtgggcaagaggctaagccagtgtagccttttcgtgtttttctgcctgctttatatcctggccatgctggcagctgattagttggtgcccacccagattaagggtaggtctgcctttcccagcccactgagtcaaatgttaaccttctttggcaacaccctcacagacacacccatgaggaaaactttgcatccttcaatccaatcacattgatattcagtattaaccatcacaccatgtcatccacagtggagtgaaatggtgcaatcctaactcactgtaacctcaaactcttgggctcaagcgaccctcctgcctcagcctgccaagtaactaggactataggcacacacaacaccacacccagctaattttaaaagtttttgtagagatgaggtctcaccatgtagctcaggttggtcttgaactcctgtgctcaagtgatcctccagcctccgcctcccaaagtgctgggattacaggtgtgagccaccatgcctggccttccttcatacttagaaattgcatgaatcattagatttttgtagtaaaaaacaaaaatctcatatttgctctattagataggtttcagccaattttcgagaagctggttactaaacaagagaattaaacttgagaacaaaataaagtgctatcaattagttatcataactttgataggcaatttaaattaactattataacagtaatgttgattttttttttaatatttcggtcctgggggaaaagtaccatttaaaatttcatgtgtcttttgatcagtaaatcagcatattggatagaaatttcagctatctactcataaaaaatgttatattctggtttgactttggctcaaatcagaaaattgctatgtaaaaatttacagaataatgcaatatcctctactcaatagctcccaactactaagaatattataaatgtaagcagttttcaggaacatagcaatgtgggatatttcactggaatgatgtaaaccgtaattaatcacatttctgtgactgccatcagtaccatcaccttccttcagtgtctctccttgtatttgggaatcccagatttcatgtcggcttttgagtagtcctgctgctgaccataggcttttctctcatcttgcttctcacccactccacctgtgtcacagtgtcatttgtgagcttgcttatgagtgtgcatggggtggtctcctactcagaacatgcccagctgtgcttctgttgcttcctagctgcctctgcagcttctgtgagggaagactgttgggcaccaatggtagtgaagcctttggacctcaagcactgcactgttttctgggtagaagtggaaggagcctgtgctctcagctttctccacacattttcctttctctggactcagcaggtatttttctagagttgacacaaaggaagagctgtgagacatcttcctgtatcttgcctttgagtcctcttttattccccctggctgctttgttattaggctgaattttttttcattaggttttgtagtcctcatactattagatttattgtgggtcaccctaccagtcctaacaaggacatcagtcatgtttgaaactcatagatttggggtaagctccagttgttacacaattcctgcccctgctcttaacaaatttaacatataaatgaagttaacaggcctggtggggtggctcacacctgtaatcttagcactttgggaggcccagtcctgttgatcccttgagctcaggagctagagaccagcctgggcaacatggcaaaaccacatctctacaaaaaaatacaaaaattatctgtgcatggtggcatgcagctgtagttgcagctactcaggaggctgaggtgggaggatcgcttgaatccaggaagttgaggccgcagtgagccatgattgtgccactgcactttagcctgggtgacagagcaagactctgtctcaaaaaaataaaataaaataaatagagttaaataccagagatttcttgaagagccttttttgtgacagacagtagaatgctgttcaccaaacccatttcttcttgttttggggtacataggcagattatatttccaagcctccttgcagttagacttagccatgtgaccaagttttagccagtggattgtgtgcagcagtaatgtgtaccattcccagacctggcccataaaaacattcgatgtgctatcttccatgcttttgtttttgtgtgttttctctaaacaccaactgagtacagaggttttggctttagaagatggcaaaggcacaaagggatggatgctcggtcgctatgtaggggaaagtcatctgctaagcaggaacaccattgtgggattattatgtgaatgaaattaaactttagcatgttaaaatacagaattttagggtttgttacagcagttactgttatgctttcacatcatttttcagcagttctcaacctttttcaccttcacatacctgagagaagagaccctcccatcatattcgtgattcactatggcagggaaagatagtctcaaggtcagggaggtcattatgacatactgcaaaagtggtcgagcaggaaaattgcagagaaatgtcattagatttagcaacatctagagcactgttaaacaatttcagtagagtggaagtagcaggagatgagattgcagaagcatgagaaataaatggtagatgaacacatggagtcagtgaatgaagttatctaatatattagattccatcaacataatcataagattgcaaaatttgtggaaaacaagggaattgttttttgttgaagccatttgttaaaagattttaaggtgaagatcttcagcaaggtagtaataaggtaaatatgtatctgtttgcccagggtggtgtcggcttatgtctgttaacctagcataattttattttattttatttttttaggcagagtcttgctctgttgcccaagttggaatgcagtggtacaatctcggctaactgcaacctctgcctcccaggttcaagtgattctcatgtcccatcctccagagtaactgggattacaggcgcacgctaccatgcctggctaatttttgtattttttagcagagatggggatttgccatgttggccaggctggcctcgaacccctggcctcaagttatctgctggtgtcagcctcccaaagtggtgggattacaggcgtgagctgccatgcctggcccctagcataattattcatagtgacctttcactcttagcaatatcccaacttagaaaaaaaaaatacagttaccctacactgtgacaacctaatcggcatacacagggggttcagatctgaaagagtggctgttaaacacatagaaagttagctcataaataagttgtctgtggaatattctttagttacctcttataaaggagttaaaatactgtttcttggtttacttaaggacattgtcaaattagccctaatataggattgtgtttaggaaatagaatgttggataaccttcattgatctgggttctcttttgatctatttttgtttctctggcttttctctttctgtgatggtctttctgtgtcctgctttgtcatcaaaaataacttttttttttaaagacattaaaagaacttgcagcactataaatgaattttttttttttggttcttgagggatgggggaggatctttctgagtatagaaacaagaacttgtacagaaggtgatacattttcatttatgaaaatggaaaacttgtgtatctcaaaaagtacccccaagtaaaaggcacatatggcaaactctgacaaaacacatattatttatggaaaatatagtgttgaaagttttattctccataaagggtaaataatggattacaatggaaaacacttgtctcctatgttgcagcatagatgattgcatttaatattcccagctccattctgttattatcttggtttcacagatgatggttaggtaacttgccatagccacatgactaataagtggtagagaagggattttgaacccatggggtcggattccagagcacgagctcttaactgctgctctcctagatcaatacataaatggaaaactcaaaagaagaatgctcaaaaaacagttttcacccacatccatgtgcacatacttgcatacacttattaatatgagtgaccagtaaacatgctttcaaacctgttggaaatgatggcaaaaatcaatacaaattaaaaaaaaaacctacaagccttcatttttgtctattagataggcaaatcttttctttcctatgaaaatactgagaattgataaaggtggtgtgaaatgttggtgatcctatcctttgaatagcatttgcctggtgaaatgcactcttttagatagagtggttgctgataaaccatttttggttaggatttgtcatggtctatctaaaatcttaaaattgtttatggtctttgacctagtaaatatacttttaagacattaataaaaataaatattcagagagtcttacatacttaagataccagttgatatacataatgttaatttaataatttggaataaaaactaacaaccattcaatagaagaaagttggttaaatgagttttcagaacttcataaaatggagaactctgcagccatttaaatattttagaagaaaaatggaatgaaataaatcctcacaattaatgaaaagtatctaataaaacagtatgtaaaccatgatccccagttttattaagattatatatgtaagcctggaaggaagcttgccaaaatgttaactgtgtttgtttttcagtggctagatttgaggtggtttttattccttttctattttacaaatttttgtatgcaatgactttgtcttccttaattggagactcattttcttttaaaaatacttaagactttgaagagtcctttaggaacatacctgagtcttcaaattatttttttggaaggttgagaattatgcatagagaggaacagggaaactaaaaagggaatttcatcatcctcataagggaaaaatatatagtcccattgaaaacgtttattaaaggtataggtacagtcttagttccattttaataaacaattcaaacttctagtagtcattcctctggcctcagttgcttagcaccagaatccttagttggaggtatgataacttaattgtacctctgaacatagcctttccaggaatcagttctgcctcaatgaggattacagattaaaagcaatctcactgtattgtacttgaaattgagaattatgtttccattttattgtatctagtaaaacctgaaactcttgaaaaacttttttaaaaaaatcagcaaactcgtaaaatagcatcagttactgtattttctcaaatataaacaaggcgctatactgaatcgatcacaaatttttctaagtgggtagattcatatatttgctgaaacacatttagctgatgctgcctaatggtgacattagatgcatcttaaaaaatcttctctattatatgtttatttccagcaacatcctgatttggcaagaattatttttcagagcctgttccctttggggacagcatcctgtgggagcacttctgtttccctttgacttcctgtgtatttaaagagctcttaacaagtgtagggtatgtggtgacttttttatcttgcaaataaatatgaaaatcttgttctgtggctcagtataaaatgaataaaggctttccagcttaataggcaagaacatttaagattaaaggtaaaatgaaaataaaatgaaaattcactattgaaacaaaaatttgcttttttttttttttttttctgagtgtttttctagttcaagtatgctgggtgttagcagccaaattaaaactgaatagatatgacagtgacccttttataacacatttgtttaaggccagatgatacagatgatgacaaatgcttgtaagccaagtgatagctcttctcctttccctcttctcatgagtccccttcctctagctttgggaatgagggccggcttctttttttttttttttttttgagacggagtctcactctttctcccaagctggactgcagtggcgctatcccggctcactgcaagctccggagggccggcttctttgttcatgtggcagttgcttctctgcacttcttctcagctctgtcttgttcccagccttaccttgggcccctgctgctctttctgcttattgccacctagaattcaggataacttttcttccttcaagttctgttgctgtggagggcaatgccaagggcacacttacctgtactgttgcttggtttcccactatgcagccatacgaaaggaaatatatatatatatgtgtggtagcctttattagatgtttgcagataatagggaggaatgacaattaggaagagaaaccttaaaaatagttgatcagtctggctctacaaattaaaaggaagaaaactttattttttctttcttttttttaaaaaaattatactttaagttctgggatacatgtgcagaatgtgcaggtttgttacataggtatacatgtgccatggtggtttgcttcaccaatcaacccatcatctacactaggtacttctcctaatgcaatccctccccttgccccccacccctcgacaggccctgatgtgtgatgttcccctccctgtgcccatctgttctcactgttcagctcacatttataagtgagaacatgccatgtttgtttatctgttcctgtgttagtttgctgataatgatggtttccagcttcaaccatgtccctgcaaaggacatgaactcattcttttttatgggtgcacagtatcccatggtgtatatgtgccacattttctttatccagtctatcattgatgggcatttaggttggtttgaagtctttgctattgtgaatagtgctgcaataaacatacgtgggcatgtgtctttatagtagaatgatttataatcctttgggtatatacccagtaatgggattgctgggtcaaatggtatttctagttctagatccttgaggaattgccacactgtcttccacattagttgaacctaatttacactcccaccaatggtgtaaaagtgttcctatttctccatatcctctccagcatctgttgtttcctgactttttaatgattgccattctaactggcatgagatggtatctcatggttttgatctgaatttctctaatgaccagtgatgatcagcttttcttcatatgtgtgttggccacataaatgtcttcttttgagaagtgtctgttcatatcctttgcacactttttgatggggttgtttgtttgttttttcttgtaaatgtgtttaagttccttgtagattctggatattagccctttgtcagatggatagattgcaaaaattttctcctattctgtaggttgcctgttcactctgttgatagtttcttttgctgtgtagaagatctttaattagatcccatgtgtcaattttgtcttttgttgccattgcttttggtgttatagtcatgaagtctttgcctctgcctgtgtcctgagtggtattgcctaggttttctactagggtttttatggttttaggtcttatgtttaagtctttaatccatcttaatttttgtataaggtataaggaaggggtccagtttcagtgttctgcatatggttagccagttttcccaacaccatttattaaatagggaatcctttccccattgtttttttttgttaggtttgtcaaagatcagatggctgtagatgtgtggtgttatttctgaggcctctattctgttccattggtcaatatatctgttttggtatcagtaccatgctgttttggttactgtagccttgtagtatagtttgaagtcaggtagtgtgatgcttccagctttgttctttttgcctaggattgtcttggctatgcagacttttttttttttttggttgcatatgaaatttaaagtagttttttctaattctgtgaagaaagtcaatggtagcttaataggggtagcattgaatctacaaattactttgggcggtatggccattttcacgatattgattctttctatccatgagcatgggatgttcttccatttgtttgtgtcctcttttatttcgttgagcagaggtttgtagttctccttgaagaggtccttcacatcccttgtaagttggattcctaggtattttattctctttgtagcaattgtgaatggaagttcacttatgatttgtctctctgtttgtctgattggtgtataggaatgtttatgatttttgcacattgattttgtatcctgagactttgttaaagttgcttatcaccttaaggagattttggactgagacgatggaattttctaaatatacgatcatatcatctgcaaacagagacaatttgacttcctctcttcctatttgaatgccctttatttctttatctttcctgattgccctgtccaggacttccaatattgctttgaataggagtggtgagagagggcatccttgtcttgtgctgattttcaaagggaatgcttccaggttttgcccattcagtatgatattggctgtgggtttgtcataaatacctcttattattttgcgatatgttccatcagtacctactttattgagagtttttgaggtgttgaattttatcaaaggccttttctacatctattgagataatcatgtggttggttgttttgtcattggttctgtttatgtgatggattatgtttattgattttcatatgttgaaccagccttgcatcccagggatgaaactgacttgatcgtgatggacaagctttttcatgtgctgctggattcagtttgccactatttttttttttttttttttgagacggagtcttgctctgttgcccaggttggagtgcagtggcatgatcttggctcactgcaagctccgcctccagggttcacgccattctcctgcctaagcctcccaattagctgggactacaggcacctgccaccatgcccaactaattttttgtgtttttagtagagacagggtttcaccgtgttagccaggatggtcttgatctcctcaccttgcaattcaccctcctcagcctcccaaagtgctggcattacagacgtgagacaccacacctggctggtttgccagtattttattgaggatttttgcattgatgttcatcagagatattggcctgaagttttctgttttttgttgtgtctctgccaggtgttggtatcaggactggcctcaaaatgagttaggaggagtctctctttttctattatttggaatagcttcagaatgaatggtacaaactcctctttgtacctctggtagaattcagctgtgaatctctctggtcctgggctttttttagttggtcagctattaattactgcctcagtttcagaacttgttattggtctatgcagggatttgaattattcctggtttagtcttgggagggtgtatgtttccagaaatttacccatttcttcttcattttctagtttatttgcgtagaggtgtttatagtattctctgatggtagtttgtatttctgtggaatcagtggtgatatcccctttatcattttttattatgtctatttgattcttctctcttttcatctttattagtgtggctagcggtctattttgttaatcttttcaaaaaaccagctcctggattcactgatttttttgaagggttttttgtatctctatctccttcatttctgctctgatcttagttatttcttgccttctgctagcttttgaatttctttgctcttgcttctctagttcttttaaccgtgatattagggtggcgattttagatctttcccactttctcctgtgggcatttagtgctataaatttccttctcaacactgctttagctgtgtcccagagattctggcacattgtttctttgttcttattggtttcaaagaacttatttattttggccttaatttcgttatttacccagtagtcgttcaggagcaggttgtttggtttccttgtagtcgtgtggttttgagtgagtttcttaatcctgagtcctgatttgagtgcactgtggtctgagagactgttttttatgatttccattattttacatttgctgaggagtgttttacttccaattatgtggtcaatttagaataagtgcaatgtggtgctgagaagattatatattctgttgattatagggtggagagttctgtagatgtctattaggtccagttggtccagagctgattttaagtcctgaatatccttgttaattttctgtttcgttgatctgtctaatattgacagtggggtgttaaagtctcccactattattgtgtgggagtctaagtctctctgtaggtctctaaggacttgctttatgaatctgggtgctcctgtattgggtacatatatatttagggtagttagctcttgttgcatttatccctttaccattatgtaatgcccttttttgtcttttttgatctttgttggtttaaagtctgttttgtcagagactcagagactaggattgcaaccgctcctttatttttggtttccatttgtttggtaaatattcctccatccctttattttgagcctatgtgtgtctttgcatgtgagatgggtctcctgaatacagcacaccaatgggtcttgactctttatccaatttgccagtctgtgtcttttaattggggcatttagtccatttgcatttaaggttaatattgttatgtgtaaatttgatcctgtcattatgcagtttcttcacagtgttgatggtctttacaatttggtatgtttttgcagtggctggtactggcttttcctttccgtatttagtccttccttcaggagctcttggaaggcaggcctggtggtgataaaatctctcagcatttgcttgtttgtaaaggattttgtttctcctttgcttatgaagcttagtttggctggatatgaaattctggttgaaaattcttttctttaagaatgttgaatattggcccccactctcttctggtttctagagtttctgcagagagatccactgttagtctgatgggcttccctttgtgggtaacctgacctttctctctgactgcccttaacattttttccttcatttctgccttggggatctgataattatttgtcttggggttgctcttctcgtggagtatcttagtggtattgtctgtatttcctgaatttgaatgttggcctgtgttgctagtttggggaagttctcctggataatatcctgaagtgtggttttgaacttggttccattctccctgtcactttcaggtacaccaatcaaatgtaggtttggtcttttcacgtagtttcatatttgttggagtctttgtttgttccttttcattcttttttctctaatcttgtgttcatgctttatttcattaagttgatcttcaatctctgatatcctttcttctgtttgatctatttggctgttgatacttgtgtatgcttcatgaagttctcgtgctgtgtttttcagctttatcaggtcgtttatgttcttctcaaaactggttattcttgttagcaattcctctaactttttaaaagtttcttagcttccttgcatttggttataacatacttctttagttcgcaggagttttttattacccaccttctgaagcctacttctgtcaattcgtcaaactcattctctttccagttttgttcccttgctggcaaggagttgtgatcctttggaggatgagaggcattctggtttttggtattttcagcctttttgtgctggtttttcctcatctttgtggatttatctacctttgatctttgatgttggtgatctttgaatggggtttttgtgtggacgtccttttcgttgatgttgacgctattcctttctgtttgttagttttctttctcacagtcaggcctctctgctgcaggtctggctggaggtctactccagattctgtttgcctgggtatcaccagtggatgctgcagaagagcaaagattgctgcctgttcctttctctggaagcttcgtcccagaggggcacccaccagatgccagccggagctctccagtaagaggtgtctgtcgacccctgctgggaggtgtctcccactcaggaggcacaggggtcagggacccacttgaggaggcagtctgtcccttagcagagctcaaacgctgtgctgagagatctaccactctcttcagagccagcaggcaggaagctttaagtctgctgaagctgcgtccacagctgcaccttcccccaggtgctctgtcccagggagatgggagttttatctataagcccctgactttgggggctgcctttctttcagaggatgccctccacagacaggaggaatctagagaggaagtgtggttacaggggctttgctgagctgtggtgggctccacccagtccgaacttcctggaggctttgtttatactgtgaggggaaaactgcctactcaagcctccctcccccaccaagctggagcatcccaggtcgacttcagactgctgtgctggcaaggagaatttcaagccagtggatcttagcttatggggctccatgggcaggggatctgatgagcaagaccactcggcttcctggcttcagccccctttccaggagagtgaatgtttccgtctcgctggtgttccaggaaccactggggtacggaaaaaaaacttctgcagctaactcagtgtctgcccaaatggccacccagttttgtgcttgaaacccagggccctggtggtgtaggcaccagatggaatctcctgttctttgggttgcgaagatagtgggaaaaacatagtatctgggccggatagcaccgtccctcgtggcacagtccctcaaggcttcccttggctaggggagggagttccctgacctcttgcacttcctgggtgaggaatgccccaccctgcttctgcttgccctcggtgggctgtacccactgtctaagcagccccaatgaaatgagctgggtacctcagttagaaatgcagaaatcacccgccttctgcattggtttcactggttgctgcagactggaactgttcctattcagccatcttgcccagaatccaggaagaaaactttaaaagttaaagtctcttataggttagttaaagttatgtcttatataagatagtttcatcatgaatacttctcagtttccagttttgtttctttgtcatgaagttcattctcttctcccttttccaggaagaatcatcttctttgaacccccacagtggaaagctccccgctctgtaggggtacgttttatcctaggattatctgtcacaactgaacaggcaaaagactcccccaaaaatgcatttttccgtgtctgattttatcagtctggaataaccccatggggggagagggtgaaaaaacttggtgcagacagtgtgggatgaagtttggctttctatgttccagccccttctgaatattcctcggtaatgtggaggtttaaatacgcctgctcatacttcagcagatggctagtgaattgaaccaccttcctcatatatatatatataaatatatatatatacacacacacacacgcacacatacatttttaatctcaacagtgtaattctaagacaaaagtctatagatgattagtgaacatttagagttgtgatagaaatccaatttgagctaccactagaactgataataactaatgtttattaactatatatatatatatatatatatatttgtgttgtgctaagggcttcacatatctagtcaaattctaatgacaattttattagtaggtactcttatcatccttattttatatatacaaaaactgaagcaccaaaggtttataggaaacttactcaggatgtgtgtttaagagtcaggatttaaatccaagtagcctgattccagagctgtcagttataatgcccacccaggagcattatgccttaggttgagcataatgtggagaatttgactcataggtttcacgataaattggaacagccaaactattgggaagggcggagtaaaggtggacttcaggaacaagtggaaccaggaattcaaatagcattctctctgtctgtcttttttctctacttttttctcagtaggtctgcttctgctctcatcatagataaagttcctcatgataggaatatgaacacttgatgttaatatttccatattaatgaaattaaccatcattaatttccatattatgttaatatttctctcattggagagactgtttcttagctatggttataaaaatcgggagaaatttctagacagataacgatatctgcctaagtctgtgccccctcccaaaatatcctacatatgatagagaacaagaagaaaaattaaaatgcgtaaaaatgacaccccctgcataaccagaaaaccaaggacacccaaacttcaaattaactaagttttaaaaaaaagaagaatgaaatctcattgagctatctctcataccttgcctcaaacctttgctgtgaacaagaacagtttaaaaagctgcatgggagagaaaagagatgccaaagattaaagtgaaactactgccacagaagttcaccagatgggtggaagtaccgaaacaatttccagtttggctcacaaaggcccaactatacactgtttataagagacacacctgaaacaaaatgattcagaggtactaaaaatcagtgggaaggactgcagttgcctcaccttgagtcagctgttcactcctgggccactcaactgtggccaacagtgcagagtgctttttatttttagctattcatctcgcaactcccttcccttgccattcagctatgtccaaggtagtggactcattttagaatttgggaactaaatgtttaaagcaatgtcttaaagaagaggggttccacactcagaagagggaggtactaggtagacaatataagtatgaaggtaaacatttgctagaaattgtttttcagtattctctttaatattcttattaaattgatttttgtttttgagtaatttggggcatgagcaatggtagtatagaaaaatttattactaggtagtgaaactagaataatgctgtctaatagaaatatgagagccataaatgcaagccatgtaattttaaattttctagttgctacatttaaaaagtgaaaaattaattttaataatacattttatttaacccaacgcaccccaattatcatttaaacatgtaatcaatacacaaagtataatgagatattttctgttttttttccttattcttccaaacccagtttgtatttacacttacagcacatagcaatttagactagcctcatttcaagtgtctaaagtgatggacagctcagacctagagagaggaacagtcatttagtcattttagcataataaatgaaaaataatacttgaatcctaaaatgtgttttatttctacttcccatcgcagttaaagtgtgccctatctaatgcttttactttgtgtttttgtatgttaatgatacctattttaaattggggcatgtttatagcttgatctatggcacccacaagcagtgatggagtggagaaagattgttttctcacctcctttagatctctgtttaaatatccttgttatagatgccttttctgaacatttgaaacaaaatagcaaccgctactgtttctcctcagccttctgacaatttctgtgccctttatattgctttagtttttttccccatatttcttattacagctgatataccatttatacttttaaaattgtttctttttctacccccccctttcccctaaatacaccagaatatgaactttgttgaggacaagaactttgtgctgtattcactgctatgttaccatatcctagaacagtactgcacatagaagatgcttagtattttctgagtgtatgaatgaatgaatttaagaccatatggcattcactattggtgtatataatggaactcccatcatcattcccctgagtggtctccctttggtactggccaactctgccctaccacactgctgtcagtcagcttaaacctcagttcttctagctaagaccatggcagtagtctcattgtggtctcactgcctccagccttcccgtataagctatttgattgccagatgaattttttttttttttaaaagcatctctgaacatgttgatcccttgctcagagttttcacttccttccagtggtttatagttcttcacacttgcttttaggagtctctgaaatatgctgtacttatatcttggtctgttgccaactagacagtttgccttttatttttaaaatgctttcagtgctttctcctcttcttttcctttgtatcaactactttttgttcctagtcactttttttcctttcctgccttgaccagaacccctgacttaacttttgttgcttcctttacgtttctttagggcacgttaagaacgttaactttgagcacttcctgatggattgatcatagaaaggctgtgaaatatgaatagacaatgaaatgtcatcaaagcaagacccttggcatgtgtgccaatggttaaatgctctggaatggagcatttgtggctgagagggaaatgtttatatctgttaaagtgcagggactgtctagaataaggcactttattaatgaacatcctttgataacctattcctttactaccttgtctttaagtggtgccaatcaagaaaggtctttgcacaactttaaaatatacatgttgttttgtagcaagtaaaaagtgacctaaatgctttctagcatattgaagcaccaactttttatgtattgaatttaaagcagtgatttacactgctaacactgtaacatttacaacatttacaacattacatttacaacattacaacatttacaggctaacagcaaaacatttacaagtttctatagagaactttaggaagtattctttctattttctggaagaaattgtggattatattttccttgaacgtttggtagaattcactagtgaaaccatctgggcttgatgttttcttttggaaggttattaattattaattcgacttctttagctgatacaggtctgttggtattatctatttctcctgtgtgagtttgtgtctttcaaggaattggcctgtttcacctaagttatcaaatttgtgggcatagtgttgttcattgtattcccttgttatcgtttcagtgtccatggaattagtagtaatgatctctcctttatttctgatattagcaatttgtgtcatctttcttttttcttggtttgcttagctggaagtttatcagttttattgatcttttcaaagaaccatcttttggttttattggttcctcctattgtttacctgtttccaattttgttgattcctgctctaatttttagtatttcttttattctgtctgctctaagcttaagttgttctttctctagtttcctagggtggaagctttagattattaattttagatattttttctggtttaatatatgcatttaatgctataaatttttctctaaggaccaatttttgctgcatctcatgcatttagacaacttgtagcttgattttcatgtagttaaaatatttcaaagttcatttgtgaatttttcgactcataagttacttgagtgtgttctttaattaacagatatctagacattttctagctatctttctgttgttgatttctagtttagttccatattgtctgagaacatactttatatgatttctattctgttaaggtatgttttattcagtaattatttttataataaaataggttatcagttttgtatttggtcataagcttgaagaagacaaagtcagtttacatgatgaattaaatcagcctctgccctataaagctgagcaaattggcaagaaatgctaacttatgcatttgactactacagtattcttttaatttttccttttctttcaaacttttattttagatttgggggtacatgtgcaggtttgttacagaggtatattgtgtgataccaagatttagagtacaaaggaatctgtcacccaggtagtgagcatagtactcaataggtagtttttcagcccttgcctctctcctctccttgctctagtagtcctcagtgcctattgttcccatctttatgtccacatatacctcatgtttagctcctacttgtaagtgagaacatgcattatttgattttctgtttctgtgttagttcacctaggctaatacgctccagcaccatctatgctgctgcaaaggacatgattttattctttttattttagggctgcacagtatcccatggtgtacaatttcttatctggtctaccgttgttgggcacttgggttgatttcatgtctttgctattgtgaatagtgctgcaatgaatgtacggatgcatgtgtctctaggtagaatgatttattttcctttggttgtatacccagtaattggattgctggattgaatggtagttcaacttgactctttagttctttgagaaatctccaaactgctctccacagtggctgggctagtttgcatttccatcaacagtgtaaaagtgttctcttttctccacagccttgccaacatttgttattttttgtctttttaataaaagccaccctgaccagatgtgagtttgtatctcattctggttttgatgtgcatttctctgattagtgatgttgaacatttatgtttgttggagacttgtgtgttctcttttgagaagggtctgttcatgtcctttgctcacttttcaatggagttcctgttttgtgcttgatttatttaagttcctgatagcttctggctattagagctttgtcggatgcatagtttgcgaatatattcttcttgattcatttaagttcctgatagattctggttattagaactttgtcggatgcatagtttgcgaatatattcttccattctgtagtttgtttactctgttgatagtttctcctactgtgcagaagctctttaggttaattaggtcctatttgtcaatttctgtttttgtcacaattgcttttgagaacttgaccatgaattatttgccaggtcccatgttgagaagagtatttcctaggttttcttctaggatttttacagtttgaggtcttacatttaagtcttcaatccatctcgagttgatttttgtatatggtgataggtaggagtccagttccattctcctgtgtatggctagccagtaatgccagtaccatttattgaaaagggattctttcccccttttctgattttcactgactttgtcaaagatcagatagttgtaggtgtgcagctttatttattggttctgtattctgtttcattggtctatgtgtcactttttgtatcagtaccatgctgttttggttactgtagccttgtagtgtagtttcaagttgggtaatgtgatgcctttggctttgttccttttgcttaagattgctttggctatttgggctcttttttggttccatatgaatttcagggtagtttttatctaattctgtgaaaaatgacattgctagtttgataggagtagtgttgaatctgtaaattgctttggacagtatggccattttaatgatactgatttttccaatcaggaaatgttccttcaatgcctagtctattgagagtttttatcataaaaggatgttagattttattcaaagtttttttctgtgtctattgagatgatcgtatggtttttgattttagttctatttatgtggtgaatcacatttattgatttgcatatgttgaaccaacattgcatcccaggaataaggcctccttcatcatggtaaactaactttttgatgtgcttctagagttggtttgctagtattttgttaaggatttctgcatctatattcatcagggatatcagcttgaagttttgtttcgttttgtttttttttgcccattgtttctctgccaggttttggtattaggatgatgctggctttgtagagtcagttagggaggagtccttcctctttgattttttgggaacagcttcagcaggactggtaccagtttttctttgtacatcaggaagaatttggctgtgaatccacctgtttttttttgttggtaggtttcttattactgattcaatttcagaatgtgttactgatctgttcaggttttcaatttctttctggttcaatcttggaggttgtgttattctaggagtttatatatttcctctagcttttctaatttgtatgcatagaggtattcataatagtctgaggttcttttatgttttggtaggatcagtggtaatgtcatctgccatttttgatcatgcttatctgtatcttttctgtttttgttcatctagacagtggtctaacaatcttatttattctttcaaagaaccaacttttgtttttgttgactttttagatgtgtatttgcatctcagtttcatttagttcttcgctgattttatttcttttcttctgctagttttgagcttgttttgttcttgtttttccagttcctgtaggtgcagtgttagattgttaatttgagaacttttaaactttttgatgtaggcatttagtgctataaactttcctcttaaaactactctcattatatcccaagtattttggtatgttgtaattctgtttcattaatttcaaagattttttgatttccaccttcattttgttgtttaccttaaaatcattcaggagtaagttgtttgaatttattgagacttgctttatggctaaacatatggtcaatcttagattatgttttgtgtgtagatgagaagattgtatattctgtgattgttgggttgagtattctgtcaatgtctattaggtccaatttgtcaagtgttaagtttaagtccataatttctttgttaggtttctgcctcgatgatctgtctaatgctgtcagtggagtgttgacatctttcactattattttgtgcctgtcttttcgtgggtctctaaaaacttgttttatgaatctggatgctccagtgttaggtgtatatatatttaggcaccatgcctgtgtttccctagccctaaggaatgtcctaatgggctgtgcttccccttcccttaggggcagcctgagctgaaggttagattgccagaaacctgcagaattccggaggtctgctggtcctctgtgcttggcacagtcagaatgggttgtggagtatgtccataggtggtctgttgatgtaagaggtcaagggtgggggatctttgggcagagcagtgatgctgtggctgtgcagatggtatggtgcctatgggccggggttttttgccctgcagacagctgtggggacctccagcttgctctccattgactgatctccttctggtggctactgtagaatctgtccctacctgctagttttttcccaaactttctttgcccagatcattgggctgttaagtgttctaggccatgaggctacattgggcagaggctgcagctagcagatagaccacactgttcccagaccagccccgcagagggaggcatgcccagctctcacactggcccacaaaccgcacatctcactcttctcagtgttcagagtgggtgctctttccctgcttgaggaccagccatagatctcagcttgtcactcctgagccatctgctctaacctggggggttgccacaagcctgaggctttgtcctttagctgcttggcaccagctgtgctagggtagccatagtgctcctaggcctccaggaaagcactcatgtggggccatggcaaggcactgaggctgggtaatggaacctgtgcggtgtgcatgctcttgtgggagcagccaggcaggggccttgatagcggctggtggacaggggagcatgcagtacagatgtgccccagtcctgcagaaaatatagccctactctctcctggcctagcagtcagcaggggttacagctacttggaggaagatggagagccttgaatgatgggtgcttattagagcattttgctgtagctgccctatgtgtaaaacccctgggttccatgcaggctggagctctgtctctttctactctctggacagatgcccctgtcagttcagaagcctgtgggggtcatgggatctcctgtagctaggatcccagaggtccatggtgagagtaggttgtcccacagtcacttcactcacttcttccttaggagctgttcaaggccaggaactagtcctggcattcagcaaccccatgcagagttcccagcttccttcctcatcagccctggtgtttgcattgcctctctattgactctcattgctttctctccaaagatctgttcaaagtatgttggtttactcaatattttggtctctcttggtgggagaggggcttcctggctgcatctagttggccatcttgtccccattcctcccattaaggtatgttttgtggcctggaatgtggtctgtcatgatgactattccatgtgagcttgatcagaatgcgtattctgctattgtgtagagttatcaaataacttgatctaattgacagtactccagattgtcaattgaatattccaatttcctgtagttattttcctgtgtccttactgattttatgcaatggaacatttttaaaattcctgccttagagcactgcatggggcccagtggtttaagagttatgagagctaatcctgaagggggctaatttatgacttgacaacagcagagacattgggtactaaagacattcagaacaggtatatgtggttttggaataatttacgggtgtatcatgcatttatttccctttaagagatgtttcttctgtgtgtgtccataagggtgcaatttttaaatgtaaaatgggtttatatatggccacacaaaattgcataatgagaaaacaagaattatttacagcaaattgttgactgtagttaaaacacctggttctgctttacagttctctatagtttctaaatatcttaaagtgagtgaaagtgttttacttttgaaaaagaactaaaagtatgttatggtttattgagatctgatactgtctcatgtgagcaatgaacctaaggagtggacactgtgaacaaaattgcatgcgagtaagcattgccatggctagtgcttgattacttgtagtagtcaaggaagaacttgaatggaattattaattacgattcatgtaataattttagcaccatttttgaagccacccttgtcatccaagtgactccctagacctttgctagcttcacaataacaagaacatttcactattgcttggtggggttacagggagtgaaataggcactgaccacacgtcataaacacactgtataattgattcctgaatattcagaactcatcccttgaaaaagagtatgaacttttggaaaagataaacctagaatgttgtaggtaagtatagacatacataagtaaaaattagaaaaaaaaatttctaaaattttgttagtctcagttataagtgaaaaagtatagaagagagatttgaacaaatacgtgataatattttctttaaaaaggattggtctaacatcattttaaaattatgttatgaagatgacttctttcttaaaaccttatgaaccaacctctgttagcttcaaacttttcttctacagtttcctcacctttctcagccttcacagaatggaagagagttagggccttgagttatgttttggcttaagggaatgttgtggctgatctgatctatccagaccacgaaaactttcactgtgtcagtaataaagctgtttcactttcttatcatttgtgtatttactggagtagcagctttaatttccttcaataacttttcctttacattcactacttgtctaactggcacaagaggcctagtttttgacttgcctcagcttttgacatgccttcctcgctaagcttaatgtaaatgttaatgcttgatcttcataattattttatctttatgattttttgctatgattttctagttgcgaaaaaaatcatgtatttctcattagattttcactgttatatcaaactttttaaaacttttgatagtgaaaattccaagcacacaaaatagaatagtatggttctttgaatcatagacctttttctagcatgaatgcattcaattaacaatgtgtgtatgttatttgctcttcctaacttatgattcagcagtttacattttgtacaatgtaatcaatggcttacattttctacagcgttactgtttttaaaatttccatagcttaaatatgaatattgaagcatcaacactttggaaaacataaattaattgcaaggtagacacaaggggagccatttctaccgaggtgttaaagacacctattatactacatcctggatattagacagttggaagagttcataaattaaaaaataagctttagtaatttggagtttgtgttttaaattattttataaaagactcagatagaaatgaaaatgatgattttgaaaatgctgccatgaagaaatagaaggcagtcagtgggactgccttttggattgctgtgagactcgcaggtcattgttcagactgttaaagacccggtccacgaattccaaacattttcgaaggttcttcctgttcttatcattgtaactgctctgccgatgcatttgctgactctccaggcacctgcttgttcacagtgagtctatatgcttcctccggcattatatttagaagctgaaggagagagacatctttaattaccatcttctaatttccaagaggagagaactaaggtccattagtccattagatcattagcaacgtttccctggccatgtttgtgttgctcttataaccagatcagtccccatggctgccaagtccttgccatcccttcactgccacttccatggttacttgccagatgagactgactttacttcacacctggatgattgcatttgcttccaagctcatgctcatcttgttgttttaagtcaatcctgtgatccaattcagtaagttcttatgggttgaatagatgttgtaggcaaggctgtggtttaggttctgtatcagtgactggtcaagattcctcaaggagcttttccaaatgtggtgcaattttacatacctaatctcagcagaacctttctactgaattgtggaaaaaaattctggtttttactatggttacatgagaatatgtctaaaacgaatgtaaagctattaagtgtatattgagtctattatatactagcatgatgctgggagccagaatatcccaaaaatagaggtttaaaacataagctctgctctgaacaagtgtacattctcattgtggataaaatatactcataaatgtgcaaggaaggatatatccaaatactcaaatgagcaacatgaacaaaagggcagaaaatcaatggagagaaaactagttaagagattaaagatgaagtaaagcttgagatgaactattaaggttaaatatgaattgtgaggagagaaaagatcattccagagaataatattgggaataaacattgcaatatatatggaagaaaaatttctacttatttgaatttgcctgtaaaactatgcttatctttgctcattttgcatttccctgtcaattttgatagccttttcttttctgaaatgacacgaaaacagttttaattcactcagttccattaaccttgagttggtaatatcaaattggtattattgtatagagatatatgtcatatattattttaaagtattttccacatattttttcatgtattgtttataaaaacaatttaaaagactatactgaaaagtcctaatattcttttttttttaaactcacaaaacccgaaaatttttgctatcatttacctactgttttagcaagatcttattactggttgagcatctgaaatagaaaatctggaatctaaaacacttctggtcccaagcatttcagataagggatactcaacctgtagaagtatttgtggttattccccacatctgagctttacttatagtgagtgaagattttaagtggaagtcactatcacaagttttggaataatcagctagttttaaactaatacagatataacacgatatacaaattaaacttaatttttataagccagctgcggtggctcacacttgtaatcccagtactttgggatcctcccaaggtaggaggattgcttgaagccaggatttcaaggccagcctggtaacatagttgtcaccctgtgattgcctggggccagcattgcagatggtaaagaatttaccaagacaatcgtaggtaaagaaaggcagatttattagagaatgagcaaagatatgttggaagggtgtgacaggcagcacagcagagaaggggatgtctgcaaagaggcaggggctggagggatgttttatagggtcatgctggagggggctatgtgcagaatgaggtcatgctgctggggctacctgtgaagtgagaggtagttgtgccagcgggttgtttgtgataagttgtctctcagagcaattgttctcccccacctggaacccctacctcatttttgcttacttacattatcaggactccacaatagtgagacccatctctacaaaaaattttaaaacaaattggctgatcttggtggtccatgcctgtagtcccagcttctcaggaggctgaggcacgaggatctcttgaggccaggaactggaggctgtagtgggctatgattgcatcactgccctccaccctgggtgatagagcaagactttgtctcaaaaaaaaaaaaagtgtgtaattatgtcttattcactaaatagtgcatgatcttatgtgcatgagaaactcatagtttctagaacctgttttctggttctcagacttttctgacaatggcctttaaagcctgctgaattttaaaaggtgaaaggaacttttcttcaaaggggaatctaaatctttggttaaggagttttaagtagttttgctcattaacatggagtgcttctatatactgtttcacttaaatttagttctttaaatgaaataaaacttgtatatactgagtaaaatagcagatatcttatctctcggttgcttgtgggaaaaatcattccaaagggatgtatgaaaggctccttgtttgttctgattaaatgatatggagcaaatctgcgatctcttttgacattgaacatgttccataattaaaagcaatgtaagctagactgacattgtaaatattgtttttaagatttaaaaattgaagtttcacattttttagttctcatatatgcatttgagtttctaggtggatgtcttaggctaaagtaaataaagtcaactttgttaagctacttgtgactgcagctgccaaatgcccccattatgagaaaaaaaatactgtggttattttacaggaaatactgtacaggactgtggtctgtgcaaaggaagtgcccacacagaaactaaaatactgttagtacttaatggtgtactttatgcttgaagtaaaaatgagttggtataaataaactttaatctcctaggttttatgttcagaattaattctaatacactttaatgtagagcatggtaatgactttgtatttttacatggcttgctgacagaatgcagctaggagaggagcccacataaaagctatataaatcaggggaacagatggttgagggacaattgtttgactttaacaatatcatacagtgagtcaacccagatttaaaatacaatagtgctgtagtaagcagcactatcatcccctttcatttgctctggagactagcagtagatttgtaattgtcctattgtaattcttttcacaaatcatttagtttattttactaacatctctctgtgtaattggctcatcatggcaaatggaccaatttacatggctggaaaggaaagcagagtgtgcatgctgctttccagcatccgtaatttgttatgtgagaagcttcttgttagaattcttgacatttactcacctgcataaaatagggctgaaaggggctttgcaaatgatgtagttcagacttctcattttgcaggtgttatcacagaggtaagttgatgttttcaagattgatcatttgtagacaggataatggcctccctaagatgtccatatcttaaccttgaaactgatgaatatgttaccttacatggcaaaaaggactttgcagatgtgataaagacaaggaccttgagatgagtagattatcttggattatctgggtgggcccaatgtaatcatatgggtcctgaaaagcagagaaccttttccaactggcttggagagagatgctccactgcaggctttgaagatggaggaagagggctatgtgtccataatatctggattgtgggcagtctctggaaggtggaacaggcatagaaaagaattatccgatagaatctccagaaagggatactaccctgccaaccccgtgatttttgtaagtcaaaaattcaacatgcgtctcactggcttaagtgagatgcatgttgattttctgacttacagaaatataagataataagagttgatttaggccatacatttgtggtaatttgttacagcagtatagaaaactaatatactcactatgttagaggataagccaggcctagacctcaggccttctgccttacagcctaggtcttttttcaggtggtaagtgccctttatatcactgaatcttgtacgcttgaaaggcagaaacaacttgactcttcttcctcgatatttaacgcaagaacaggtaaagagagccacccagagagagctttttaactgatgtctgagcaccagatgttccagagaggagctaaatgccagaatgaatctcgctgtgtactatttagcccttcaaattcactcaccaaaactgtcttgattcaggagtatccagaatgctgcccagaatgcttagcaattttgtgactgcatgtcttggggtgtgttgagtctggtcttgactcccatgtcccagatcatctgtgggtggatgtatagttgataggcccttccaagtaattctcaagcctctagttggtctagaataggaattgaccattaactagtatgaaataaattcaagatactaataaaatattttagctcccatttgaattttgattctgacttctcataaggtcctttattaaaaattttaatcactcacagaaataagactgtttcaaataaaatcaatggttaaaaaacctcaaattggataaaagcaaggacataattcctcagaaaacctaatccaggaacttcagatatgtttgatgtcatctgccaatgctatttgttggtaatagctttctggaacattattggaaaggattctgtggccaggtccttgatcgagttaaatgagttctttgatcatgtctgacttgggcagctggggcaatgctaatctacttcctagagttttctctccttgtatcaatcaattgttaatcactgtttcttgggtgtgatatttcagccagttataaatccatctaaatgaactatatcccactcacatttcttcataggatctaggtgggagagatacaccctgatgagtgtgatgagagtttgaaaatgtgaagtacaaggaacagtgacctcatttgtaagttgttctttaaactcacacctggagaataaggaaggaagagggatttgagagaagggaagaactaagtgtcaaatagtgctgtcctttccattccttaatagtagtaagtagttctttcatgttacctctgtctggcttagtcacagaaaattttatttagctcagaggacccttgactgaatgtcgtcataggtagttcagggtagaaaacaggtagataaaactaaaaatacatgcatattaaaattttgtggagaagacaaaaaatacatgaaagaaagtatgagaaactattacagcatactaacttttaggtcattcatatttttttactaaatatttttataagatttatacagcaaatggtagatactattaaaatattatctttttaatataaaaaactgaaacaagtgataatatttagtgcttagatattaagctgtttatctgctttaaaaaatatagactcgggctgacattacaccctttattttccgtttgtttctttctttacattaatactggtttcagattctataagcaaaatcaatttgattactgcagacaggagttcgaagacttcaccttcgtagcctctgtaacagggccttttgtgagagcactttggctgtaatgatcagttgacctgtctgttgagtatcatgaagcttaagtgcctggaatagcccttgactttcgctaacattggaagttcatcagtttgccaactgtctgccagtgaactgcagtacactagagcagtaatgaaagtatgacctcataccttttgtggcaattttcattttttccaaaaacgacacttactttattgcattgagctctactgtgaactataatgcaggagggctcatattcttattatcgctgtttacaaatataaagctcaacttggaagggttgatgactccctaaggctagtaagcaatgaggtaaagagaaacaaatattcaaccttagaaatgtgagttataacttacagttaaataagaattttcaatcttacaggtttcaaatctgcatagcaagtagcgtaatggagcaaatgattcttttcctccagcttgcctattataacctaatcgtgtagatagggatttacaatatagtaaatgtgtagacaaatttacaacattgcaaggcagtatttggtaagtagtagaagttagtagatttagctccttaagttaaatctactaaccttaagacaataacaagataaacttgtacaagtggagaccttgttattgttgattccgcatttcattaagagtacatatgcctctctgtgcattctcatctattactgttgctgaaggggataaaggattataagaaatgattcctttcctccaggttgcctataacctaactgtatagatagggatttacaatatagtaaatgtgtagataaatttacaacattgtaaggcagtatttggtaagtgtcttgacagtgtcagacataataacctgatttgtccagataaatccaaaagtgagggtcagctttggcctgaataagcaggaagaaattcaagtaggaagtgacttttaagctgagctttgaaaggtgacagatttggataggcagatattttgtgagaggctattttattttgatggaaagcagaggattttatttgggcagaggcattggggtaggaaaggtcaaagcatttgcaggtaggggagtagaccagtttgacagaatatttatgtaggagagtggttataatcattacttcatatgggaatgagaaagtagtagatttttctctatcatgagcctgcctacatttccttcctcttaaatttgttaaggaggaataggcttaggcagtttttttttttcccgcgagggtactatctttgacattaatccaaatatttggtaaagggtaatcatatagattctcatttttgtttttatcttttttctctttgtttctgcattccatgattttattaaacaaattaaaacctgtagaaaaggtacaagcatatgcaataaagacccataagtgtgatgatacttgctacacagtcattttagaccaacctatctgtatgtggcagcccctgtttgcatataatctagatcaagggtcagcagacattctctgtaaaagataagaaaggaactattttaggcttgttcggccatatagtatctgctgcagctactcacatttattattgtggtagaaaggcagccatagacagcacataagtgagtgagcatggctttgttccaataaaactttatttacaaaatgttaagacagacttggaccacctgtggtagtttactgacttttagtttagagacatatgggatcacctcatttcgaataatgggaccctagatttcttaccttcttcagcatctgtgggttcttttactcttaaaatagtgttcctgttcttctatttcttttggttaatattgctttttatatttttatattatttctaattcttaataagattctgcatggggcctagtaaatcattgtgactaaccacttagttattactagtgattataaggaatacattatatatgtttatagttgagccatactaccttttacaattaatatattgaaatattttaactgaatttaacattcagttaaatgttttatttaactgaaaatgctgcatacataaaatgtcctcttgctggaagtacagatatagatagtgtatatgttccagtatttttaattaaggaacacctgtaggttgttttatttgtttggggttctgcttacttcctcagaaggctggccgtatttatctgtggatccttttcagtactgagcagaataccttgtacattggttctgaaaatgtacatgtcattatccatttgaacctccgtatggggccatcctcatcaatatacacatgtgttaatagtttccttcactgtaaaacaaacaaacaaacaaagaagttccttgcttccatattcccccgttagttatcaccttattctcatttccctttctcagaaaaatttcttgaaatagcgacgctatgtgcatcttcactttatcccatctcttttgtttttcagtctattccaatctggcatttgttcccatcaccacattacaattacttttatcaacatcactcatgaaatttatattctgtatactgggacacttctctaccctcatcttaatcagctgtttgccagttttctactcagttcacgtctccctgcttcttgaaaccttcttcctctgctgctttgcaatgacactggttgagtctgtttggactgccgtaacaaaataccacagttagagtgacttaaacaacaagaatttattttctcacagctctggaggctagaagtccatgatcaaggtgtttgcaaattggtttcttggagagctgtcttcctggcttgcagatagccacctcctcactatgtcttctcatgacctttcctcaatggatgggcattaacagggagcaagcaagctctctggcttctcttcttataaggacactaatcctgtcagatcagggcctcacccttatgacctcatttaaccttcattactttcttagaaagcccatctccaaatacaatggtactggggtttagggcttcaacataggagttttgtggagatacaaacatttggtccattaacagacagtctcgtgactttcctaccacctcactggccattcttctgtctctttgctcagcttttcttccactgcttgatctctaaaatttggagttccacaggctctattctaatctttattatttttttttaatgctacccagcccacgtggggagtctcagccattcccattgcttcacttatcatttctctacaggttctcccagattttaatctgcacagtaggtctcttccctaagtttcagactcacagtcaatgcacatctcatctgaactcaaatttagtaagtctaaaatggaacacttaatttcaaaattcatatatgtgcttcttccccatccttcattttagaaaatggaagaatcattatctgcagtttctaaaatcataaacctggacactattcttgattccctcatgtctgtcatcactgttgtaagcaagtttttctgattctgtcttcaagagtcatcttgaatttttccatcttcctccttctcctttggactttgaagcgctttctcatcgattggatagtgggtaaaatattacttttcttgtctcttcagcctaagtagcaactctgaatatccattcccacagtcttccctattatatcaacttgttttattgtcttcctagtattctctcatccaaaattttatggcctgtttatttgcttacttgtcttttgtctcttcctttgagaatgtaatattaacagaacaaggaagggtcttgttaacttcactcttcacatgtccatattacctagaaaagtgcctggtatgtagtaggtgttcaagacataattattatagaaggaatgaacctcttttgctactattttagttcatgccaacatcatcttttgcctggactattacagtaaccaagtacccccattttttcgaagagatcatttaattatttttttattatttatttatttatttatttatttatttattttttttgagatggagtctcgctgtctcccaggctggagtgcagtggcacgatctcggcttactgcaagctctacctcccaggttcatgccattctcctgcctcagcctcccaagtagctgggactacaggcacccgccaccttgcccggctgttttttttgtatttttaatagagacgggatttcaccatgttagccaggatggtctcgatctcctgacctcgtgatccgcctgccttggcctcccaaagtgctgagattacaggcatgagccaccgcgcccagcccatttaattatttttttttcccctcttttttctcattcctccagttccttacttcccacttatccctttggaaatgcaaatataaccctttgccttcccttcaccatacattccctacagggcaagttcttctaaccatgggctccaagattgatctctcttccagagttaacaatttacaaaccaaagcatgcccactgtggaactctcacccaccaggagttttgcctcaagagataacagtcaaaaagtatgcctgctgctctctcccacctggtgagtttttgccctagtcctgcccacaaaggcaccagcagtcaccagctcaaccagtcagtagataaggcactgaagctggcataaggaccccaatccccggcttcctcccctgcatgcaatttctctttaaaagtgcccactttctgctccaaaagcaaagcagtacacttaaaggcaggccacctgtacttcttcccctaagatagctttggaataaatcactttctttatacgagaccttgctcttgttaattggactctgcaagcggagagtgaggaaacctgcatttcggttacattactaactaatcaggtctccctttcctgctcttgccttcctgcaatctatttccatagagcagccaaagtatcctctaacagttcatctcacactgtgcactccccagctggaagcttgtctttggcttttccatgcatgtcctggcccctccaacctcctctgtcttccattttactgtggacgtgtcagctgtctaccagctcctagaacacgccacacactttctcccacctctgagtcatttactttgctggtgctcttcctggattgttcacgatcttcacatgactggccccttctctttgaaggttttatgtcacagtgtaaatgacacgtttttagagaggcttcttctatctgagttgggttttccctccttcattggcccagcaccaagaagaatttcttcacagaactattgtctataattgttttatatctttgtttactgtctttcccatttttggcttcatgaggaaggacattcttactcttttttgtattttaatgtctatcatagttctgaacaatcaacacttatttgccaaatcagtgaatacacatgctataacatttatgtttttccttaggtgtctgaaaatagtttgtcttcaggattttgtcttctaaggatatgataacaacaatgattatttaagaaacttgaataacaagattagtaatgtttctataatatcttcttctatagtaaatctaaagtgaggagcttgcttttttatattgtatttttccagagacagcttcatgagtcagaggtacctctcaatatatgactcacataagacagtggatttatactgtcagctgcctttttataccttcagtcatctaggtcattaggcagtttgcattcttttctcttggttatataggtattaaagaaacttgccccttattatacattaaaaaagtggtaagctcctattttttcttctaagtatatggattggaaagacttttaaaaatgggtgatcagagaaatgaaggtcagttttttcctaatttttaatttttatgagtacatagttggtacatatgtttatggggtacatgagatattttgatacagacctataaggcttaataattacatcagggtaaatggggcatctgtcgactcaaatatttatcatttctttgtgttataaatattccaattatacttttagttattttttaaatgtacgatgaatttttagtaactgtaatcactctgttgtgttatcaaatactagatcttattcattctatctaactctatttttgtaactattatccatccctacaccctacccccccactccccttcctagcctcagtaaccattcttctactctccatctccatgagttaaatagttttaatttttagctcccacagatgagtgagaacatgtgaagtttgtctttctgtgcctggctcatttcacttagcataatgtcctccagttctatccatgttgctgcaaatgacaggaattcatcatttttttatggacgaatagtactctattgtgtatatgtagcacatttttctttattcattcatctgctgatggacatttaggttgcttccaaatcatagatactgtgaacagtactgtgataaacaggggagtgcagatatctctttgatatactgatttcctttctttggggtatatacctagcagtgggattgctggatcatatggtagttatatttttagttttttgaggaatcctcttactattctccatattggctatactaatttacattcccaccaacagtgtatgagggttcacttttctccatatcctcgtcagcatttgttactgcctgtctttggataaaagccattttaacggggtagagatgatatttcactgtagttttgatttttatttctctaatgatcagtgatgttgagcagaggtaagttatttttgtatggcaaccccagacttcagaaaagaaaaaagcagttgttatttataacaactgttatcatagattttaatcccacaatcatcatacttccttgatgataaaacagtttgaaggaagagtatttggcggtgtatatatttttaaaggcattatgaaatcctacataaattcccccaatcgaatttttccatttaaaggtttaaaaagtgatatattttcacttttttgaaaaagtgcaatttgaggcattcctgttctcatcaccaagatttaagagatattaacactttgtcatatttgtgtcatatcatttttgaatttttttttttttttgagacagagtcttgttatgttgtgcaggctggtcttgaactcctggcccaaggcaattctcccaccttcagcctcccaagtagctgggattatagcctcaagccactgtgcctgtctctaatatcattttctcttgtttttgaaataagaattaatatattacatatgtaactgaagctttcatttgttattatatgaggttttgacccatgattgtttcttctctccctccccagagctgaatatatatgtatttaatctgcatgatagcaagggaagaaagaatttctgtttctaagaggttgatattgatataattggaaggggaaaagatagaatgttgttaaagacaaaatacttggtttcctggaggcaatctattttgctgtttcatctggagccctgtatgaaaggttcagaaaagttcaaagcttatattttttttccaaacttgagttaaaaacagggatcactaatatttaagataacaaacaaaaaactctacaaattgatacttttttcttttcagcaattcttgtgtcgtaaaactgaattgaataaaactatatattttgactatgagaatcaagattctcaagaaagtcaggcaattgagtgaggcctataatgttatgtttttaaatttgctaaatgatggtagcatgtcgagaggggagggctggacctggtggggggactgaataaccagttatctagagacctggcatcatgagaatgttgtcagctttcatctacatgatattggtttatatttttactacttatgtatatagtcttaaacattatttataccatttgtgtgttttacattcatgtgttattatttacataaatgacaaaatccagcttgttttttaaaaaatgtttttgagagtaatctcttttggagatgaatccctgggggtatgtatacctttagtttattttaactgttctaaataataccatcatattatagtttgtttttctaatatgtgttcctccctcctttcccttcctttcccctcctttcctgtttcctttcccctccttccctcttttccggaatttgcgtctgtgtgattcctaggtaatcattactgaaagcatgatcagcattttatggtttaaaaaaaaaaaactgcactgggtgcatttccactaaacgtatagagaatatatctgagggaacacagtagagctccatgtggatactgattgattagtattgggcccgtggagactgctagattaaacaggaggcagatagtctttcctctgggagtcttgcctctgggtgtgtccatcatctgctgaattagcactgcattcagatcagctctaggggaaggttgcttctatcacatggtgcagatgaacctgccctgctctcctcactctggaaacttggctgaggtgggaatctgatcagagcagttggcccagttaggagtccccatgtgccatttaatgacaagtgtgctccctggtgtttgttccgaattaatttcctctgtgtgaatggtgtctacagcttgtggaggtggcctttggggaattagtctcctaagtctctggttgccagatgaaattgtgaagttgagtccagagagcaaactcagagcagtaaattgcatttttttccgctctgaaaaccacttgtctactatgagtttcttgccttttttttctcttctgtcttgagtttttggccttggcacaactataggtttatgctagctctgactgatgtggtcctgtctggttgtcagcatcctctcatgctctgccagccacatgggaagggctctcctccttgcctcctcacccccctgcctatggatccctcttctcttgcagtctgggccattgctgggcatcacttaacttgtttggtttccctgattccctttgtctcccttccatttgagtaatttcaaagcttagctctgattctgcctctcctctgctcctcatgagcttttgatggcttttcatgctacagagaaaatggctcattctccttaacatagcctggaagattttttataatctgactctaaccagcttgtccagtttcatgtcttatcttttccaacactcagccttgctgtggttgatgattccctgttacccagacctgctgtgcacatctcatgcatctagttttgcctctacctgtacacccaatgcccttctctgataatggaaatcctcctctctctctgcaagcccagcatgcatgttcccttctctgcgaggttccccagtaccatctttaggagttaaccaccagcccagttgtgttcctttagatctttagaattttttgtctgcctactatcataatgcgtcagatatgtgtctttccccagtaagtagtgaactccttcagagcaagagccatgaatatgtccttggaaagataccttagcacctctagagtctcttgcatcttttaggattgaatagctgttattggaggaacactgttgtgggtgcttggtgtgagggtgtgtggtatactgaactggagtccagagacccaggctaaagccaagactctggccgtgttcaatgatgcttttgcctaccaatgatcagtaaaggcttattaatatataaaatgatgaaatggtgttctgtgtgatttggggaccatccctgaacctctctgtgttttagttagctcatttggaaaataagagggtttgaataaacattattatagatttcttttagctctaaaaggttcatatattccttcttttgtgtacattttatattttccaaattatctacaacgagaatttattactttaaaaatttgagctgtcaggttaaagttcttataactcctagcaaaaataaatgagtcaagagacaagcattaagcctaaataccaatgaacccctataggcaggcctatttagcattggagtgaaatatattagtgactgattttacagtgctgggagttttgcagaatcaaggtcagaaatgagattgtgtaagccaggactgctcaagactgtataagactgcatgtggccagtattaatcaattaagaaatcaatagtgatttaattgatcaccactatatgcttggcactagatgagagctttttcattatctatctcatttaatcttaaaaatcactttgtggaattggcatggttattttatcactttatatgagaaaataggctcagagaagtgaagtaacttgtccaaagtcatccaagtactcaattttcaagtcattattcaagtatagattcatcaacttttaaagctcatgatcttttgtttatacatcacattgcctttctgttaggccagaggtcctcaacccctgggccacagacaagtaccaggtccatggcctgttaggaaccaggccacacagcaggaggtgaggggtggatgagcgagcattactgcctgagctctgccccctctcagatcagtggcagcactggattcccatagaagtgcaaagtgtattgccaactgcgcatacaagggatgtaggttgtgtactccttacgagaacctaatgcctgatgatctgacgtagaacagtttcatcctgaaaccatccccccatgccccctccacaccccgccacgggtctggaaaacttgtcttccacaaaactggtccctggtaccaaaaaggttggagactgttgtgttaggcaaaaaaatttgtgcatatatgtggctaaagaagataatgggagttgggagatattgctactaggtacctcatattttaaacaaatagtgccgtaattattgatagtgcttgaatttcattccaaatatcctatcttctttaaagaagcagtttactactgttttataagccattctcattagcatctctatcaataaggattcttatttgtaagccacagaaacagacactggatgatttaaattggaaaggaataatttagagcatattgagcaatttacagaatctctgcaagggccttagaaccaggcagcctggaacagtgcgtaaaatcacatcattgaatttggtgatgagagttggccaggggcactgtccgtgtcacttggcaattatcctgtacttcagcctccactctggaactctgatttagctgctgctgccagttgctgtgacaatgtgtctacatccctttcccctcactaactcccaagttagtctggggctggtatgcctgattgacagaaagcaggtcttgagtcaaggtcatagctacaatggaggctagaatgtaaatgtcggatatttttatttttagagtgggatgtgggattttcttcctaagagagacactattcatgcatgggaaggtgattcagatacacagcagccgaagtgaacgacagatactgcagcatctatgtatagattgtaattcatttcaataacatgagttttctcattttaaaaataagaaaactgatatggaattttccattcccttgggctaggaacttttgggggctctctcatacattttctggaatcaattgtcaccaagttctattgatgcttataaatcaggctcaggtataccacttcctctctattactgaagatataaacccaatttgagttttcaagatgttgaaattggagtttctcaataatctctctttccttgttctctctgaatttcttctcttggatctgtcctgcaaattgctgctagaatattcttccataagcactgttttcatcatacctctgcattgctcaaaattattatggtttaggggaaatactgtaggccactaatcttgcaaaaattttatggctaagacatcagaagcacaggcaacaaatcaaaactagaaaaatgggattatattcaacctaaaagcttccaaacagcaaagaaaacaaagtgaagagacagcttgttgaatgggagaaaatatttgcaaaatatatattcattctacaagggactaatatccagaatatactgggaactcaacagtaagtaatctcattaaaaagtatgtaaaaacatgaataaacatttctcaaaggaagacacaaatggccaacaggaacatgaaaaaatactcaacatcactaatcatcgggaaatgcaaatcaaaaccacaatgatacatcatctaatcccatttagagtggctattactaaaaagacaaaaactaatgggtgctggcgagaatgtggagaacaggaactcttatacactgttggtggtaatgtaaattagtatagccattatggagaacagtatgaagatttccccaaaaatagaactattgtgtgatccagcagttttcgctactgactgggtatttattcaaaggaaagaaaaaaagtatatcaaaggaatacctgcacccccatgtgtattgcagcactattcacaattgccaagatatggaatcaacctaaatgtttacctgtcaacagataaatgggtaaagaaaacatggtgtgtatacacacacacacacacacacacacacacacacacacacacacacacactggagtactatttagccatacaaaagaataaaatcctgtcatttacaacaacatggttggttctggagatcattatgttaagtgcaataactcaggcacagaaagacaaatatcacatgttctccctattatgtgggaaccaaaaagttgatctaatggaggtagagggtagaatgatagttaccagatgctggaaatggtgtatagggggtgggggttgaagagaggttggttaatgggcacaagcatacagttagatagaaggagtaagttctaatgttcaatagcaaagtagagtgagtatagttaataatgcattacatttttcaaaatagctagaagagaggacttgaaatgttccaacacatagaaattataaatgtttgaggtggtggttattataaataccatggtttgatcattatccattctatggtggtaacaaaatatcacatacataaaaatgtaaaaatactatgtatcaataaaacatttaaaaattattatggttaaccatagcaattggtttattcaggaattagtgacctataataactaatatgccagtatgccaatttggatccctttgttgctaagaggcaatatggaggagtaagtttgctttgctcatgctgtctcctgtctagaaggccatctctgttctttcagatatccaaattctaccttttcttgagtgtagcttgtctctccttttccatgaagtccccatgcctttccagacttacttactgatttttctatttgatacttaattatttgtaatatgcatttcatagcttattatttagtgacattttctaattttatcaagagtttttttttttttttgagacggagtctggctctgtcgcttaggctagagtgcacgcaatctcggctcactgccagctctgcctcctgggttcatgccattctcctgcctcagcctcccaagtagctgggactacaggtgcgtgccaccacacctggctaattttttgtatttttagtagagatggggtttcaccatgctagccagggtgatctcaatctcctgatctcgtgatccgcctgccttggcctcccaaagtgctgggattacaggcgtgagccaccgtgcccggccttatcaagagtttttaattcctgtattcttatatctcttcctgcttcaacccccatgccaaatccttaagggaaaaaaacatgacatagacttatttttatcctattcctagtgcttgacccctaataggttcttggttgatgattaactgaatgggaaataaaccttggatgtagatttctagtaggtgttatattttgcaacgtgatttaacagttctagaccaattgttacttgggcttctgagcactatacattattcaccatacggaattgaatgccattgagtacattaaaaatagtcctgtatatatgacttgaaccacagctgtttccatctagtattgagtaggtgcatagttaacctccactattcctattctttggaaatcagcttaaaaaatgataataaataaaactgcagttatcagagttttttaggtaatgaaaacgggcacacgtgtgacacaaataggagttagcaggatactcttcgtaatatttttttccttgtgtctattataggattttccattatatatttctgtggcatctctccatcaggattctcattgtgcatgaatctatctatgcacaagagtgtcaactctgccagcagtatctgacagcattgtaatttaatgtattcagctgctgtgttaagtttcaggaagtttcctgtaagccaaaacttgtaaagctttgtctccctttaaacttttgttaatgatattatttaaacatttcttttttaagcctaaattttctaagaaaatgtgatttgtttacttcagtgcttgctgttatagaggctgtcattttttcccaaactagactttattgtgaggtgtggcatgcttaatttgtccacttgtagaaaatgatgtgagcgtatggctgcctgttgcaacttgaaaaaccttaaaaccaaaatctcaggccatattatttaatctgtcaattttccttgttacatagaaattcctactagaagtccaaagatagttttcggaggagccctgagttgcaggatgtttatcacctcttagtgttcacctttgatttgttctttttcttcttgctttgcagttgtttgatttgtaagaattatttagatattaaaagcatgaactgtttttaatatgtttacttttgtttattatggtgctatataatagttctgcttttttatgaattccagttatcgaagtggtctattgtgttttcttcccatattttaaatcttataacttttgaaaaatttttaataacctagaattgttctggtgtaaggtaaggaaataattaattttaaaaatgtgataatttcagccagttttggtaagcattactcccagttctcttattttgtattaatgcctagccagatttttccctcatttgcttttctatgtgaggcttttccagagcgtcatcctattttaaaataaaatgtcagcctgcttctttcactttgcagattgccagtcatgcccagtatcttaccctgtgcagatctggtggtcaagctcattcttcctttccccaggtcatctgtgagtgtaaagcatcggagtcctgtaggcatcacttgaggtgatcctctctaaaagatacctgttcaacttctaaccagcttcagaatgataagacttttttttctgagtgtggaaagtgattaaaaaccaacaaaacctgtcaatgttatttctttcatcttctctgtgccttctgtgtctgttttagaaggaaattagactgtctgttaattcagagcaccttcatgagtagagaaaggacttctgaaagttgaactatccacatgtccccaaaatgtaaagaccgttttgagagtatcttctagtctgttatttttgtttcttaccactttttgacctttaatgttttcctttttcttttaattttcttccattgtcttggtggttctctatgctgcctttgccttattttccatcttcctttccttacaactggtcctgtcgcgtattgtttctgtttttcacccatttttctgctgtcttcttactgttcattgtgggatgatctcaggatatcctggatgaatggaaaaagtgtgtttggagccttgctgtaacatgattacctattgggtgattatgcttgtatagaaaaataggattgttcagctcaaacactgagggaaaaactatctcctagatttccttactgaaaaatcccaaatcataagagacagattttagtcttgtcatcagaacataatgactaagggaaaattcagatgggactgtgatgttttataaatttttgtgaaatagtaaaacttccatgtctcatagcaattttaaaaattatcataatttctttagttatagatataaatagagtatgtggaattgaaagtatgactggaaagggacttgctcagttccctgggcaagaacttcactttcttctggttccaagaagaaaacatacaactcctgtcactcctttctgtgtatgtctcttctgtcctcattgccttgtggtcttctgtggctctgaatgtgtagaaaatgctgatggagagatgtgaactctcccataagagcagtaatgcctgagtgacaccccacctctgtagtgaatcttcccagcccccaaaggcaaggttgaaaatcctggtctaggctgctgctgttcgagtccaagtatctctaggatttacccaatcagtggcaatttatcagcagaattctaatcagtcttttcttttgttgaaaattgtttgttaaaaaaggaagaaattatttcaaaatatatggtctttataaacacataaacttctagaaacatttataactgaaaatgtgttgtttttacaatgtatcattttctagtagcagtaagttatgctgtagctcaactattcttaaaaccttcctggcaacgtttctctaggaaattgagatccttaaaatttttagttctctttgctataatgtacaaaaagaaaaagttgttttgtaaattctgtcattctcagtgtcataatgtttggattatttgagaaagaactacagtatgagtgaaaatttggtattctaaggtatagaataaaatgggatttgcctacaaaaatgcattgtaatttgcacagtgtagtgcctttgcatagtgattttatgctattgttttggaatgttgtttgaatatcttctttcatctttcagtgcattttgaatatattttctggtcctttcccttaatgtataagttcattggtttacaaattttagttttctcaaaaatatttatgacagggttttgcacattataaacgctcataaaatatttgcaatttgacttggctataagttagagctatattaaggatttccagaatccagatgatgcctgtgccatgctgactgtactatccaaggacaaagaaatgggtgctgatacagtaatgctcttttctttctggaaatgtgatcttccttgttgaacatgttaaatattttattcattctgtgttcttcttttcattgggagttagtgttgatttctcagactcttaggttgtgtctaattatagtgctgattccacctcaaaatattgctgaactgacagtggtcaaaggaaaccaaaaaagtagtccaaagaaagaaatgatgaggctttgcttatttttcagttgccaagaataacataaaaatctctttaggtgggagaaaatcacaagagcatctcacaatacttcttaaggagcagacgcatgatctgataatataataatacccttccttttgggcaggttgcgctcagccttgtgaatagtttagaatagcttatttctagggaagttataaaaaatgccttcatcgattggcattatttatcaggaacttcaaaaatgttcttactctttggtccagaaaattattcacttctaggaatttattatcaggaataattaggcatatggataaatattttgatacagcagtattattttcattgattgtaattgttaacagttggaaaaaaacttcatttgttcaataacagggtattgactaaatgcattgtagcctcttatactatggaatattgtggagctagaaaatcatcttatgtggcaaaaaatagagtatatactctgaatcattggggcaacacttcagattatagaagatttagtgtcttgtcttacattttagtgttttggaattgaaggtgacttgtgagggcagctgatcattgatgggtatttgaatcatgaattgagatttagggtcaaaagtaaccttccaatttaattaaaataatagatcatttgttagtttttatactataaaatttccttttttctagtagtcttgaaaaaatatataccaacagaaatattatgttgtaagaaaatgatgtttggagtttgaaaagcaatttgaaaaagggtgtgactcttttgagttttagtattctatgcacattcattacttttgccttatctttcctaatcacatttcattaaaagaactttcttcttaggcctgtcatgttcacttcattcatatttgtcatttctgtgttcaataatagcccatgttcatgagcagtttctaagcattagcatttcttagcccatatgtatcccgtatttctactaaagatggaaatgttagtgttaaaaccttgagaaatatgtcagcaaagcttcccaggacattgtataaaatatctttgttttgagacttaattaaatatgtatgtagaaagcatcgtttctatgcaagaatttggattccaaaatcaatcatcattggtcaggtttatgaaaatagccgcaattattatgttttgcctgataatctgagcattttatttctgtaaattgttaaatctcaatacttgctacttatttgtaaatgtacaagtttctttagagaaacagtaccatttgatcagtttctgttcctgctggtcctggacttgtacactgaaacatattgctgccttcactgcaaaataggaaaaaagatctaacaagcatgttatattgcttttaaagtaacatgccataagttacattgaatttcaaggtaaagttaaaaggtcaaagatgtatatggattgctagcatctttttggtctcagatgtttgcaaagctgagtcagacttaggaggtaggagtgtgtatgaagcagagtggggctgggctatgtgctggttataaactgtgaaactctaggggtatgctgcacagggatttgctatgtgcacattgcacaaggccaagtgcagtggccctggagcactacgaccctgctcttgtttctggcttgttccccttgagtagcaagtgtgttatgtggaatcaaatcagtgctgctaatcaaatcttttaagagtatctctaaaagtcctgtttccaatataagagcaaaggataaatcagattcttttaatgtggggagtaataacattttctactatataaggggagaagcagcagagttgggttctaaatactgagcctaactgcaaagaaaagaaagttgctgtggcttccagctctactctttcaaatatctattttaaatgaaatatttgacaaaggaacacgaggaaagggttagaatttgcagtggaatgacctttcttagagaagtaccctgatttgaaatgatcattttgacacctagaaaccaagaatttctgtggctttaatgtacagtcgtccttctgtactgaactgtgggttttgcgttcttgggttcaaccaaccagagatggaaaacatgaggaaaaaagcatctgtactgaacacgtacatcctttttccttgtcattaatccataaacaattcagtataacaactatttacatagtatttacatttacattgtattaggtattataagggatctagagatgatttaaagtatatgggagtatgtgcttgcttatatacaaatattatgtcattttatatcagggacttgagaatctgtagattttgttatctgagggaggtactggaacaaatcctccatgcattctgaggaatgattgtagttcttttttttgggtgatgagcctagaaaataaaatgcactgtacattataacatttgtggttatgttaggtttggtctacaatgttggactgagcaacacctcatttgaagaaaactggtggttaggattgttcactgtgctttattatagaggatttacaataaaaatattggtattttcacagcaagaaaaattgtaccaaatattccaacgtatgttcttaccctcaagggttgaagatagtaaaagccattattggagacttaaatttcaaaatggtggcatagaagcaagctggcttcaatggcccccacagaaaaccaaaatcaaatgtacagcagcaagactaacaatatcccagaactcagtatgaggatgagtgagttcctggggccacagagaagtaaagacactccaagcagatggtagactataacttccatatctgtgatgccttttcccccagtcagcccagcagcaagcacatggaaaatgttccacaactcatggtttctaacactggaaaaagtgagattgaggtggacagccatcttccccattgtcttgtgttccctcacaggagacctgccctgcctaaacccataggaagcagcacaagggcctgaagggagaaatatccctgaggacaactggagacaaaaggcagaggcagggctaccatctgtagccctggaaactctgctttgtaacttggccaaaggagatgccaagtcagtggcttttcagtaccatgctataggtggtacattccacagatatcctgggcacaaaccctgagccagcctccccacactgctagtatcccttttgagacctccctcatttgggactagtagcacactaattgtttgcttgagccaaggaaaacctgggtttaaggttccatctaatgctggaaaggaggccacaacctagcaaagaaaaaagaatgtaacaggtaaattacaaagaatctataagcaaacatacccaacaaaaaacaaaacaagccagacagagaagactggaataaagacacggagatgcatccacaagaaacaatagtaaacagggaaccatgacctccccaaatggacaaagaagggaaccagtgaccaaacctaatgaaacagcaatatgtgagctctctgaacaagaattcaaaatagcaattttaaggaaactcagtcatctccaagataacacagaaaagcaattcataaatttaccagagaaatttaacaaagagattgaaatgattttaaaagatcaaacaaatttggaactgagaaatacatttgctgagctgcaaaatttatcagagagagactcaacagcacaattgctcaggcagaggaaaggatcagtgagcttgaagatgggctatttgaaattacacagaggagaaaaaagaaagaatggaaaggaatgacaggtcacgtatgagatatagaatattagctcagaagatgaaatataagaattattggtgtttgagagggagttgaagaagagcgaggagtagaaagattattcaaagaaacagtagacaacttttcaaaacttgagaaagaggtaaatttaggcacagaaaggtcagagaaacagcaaacagattcaaccccaataaggctttaccaagaagcataataaactctcaaaggtcaaggacaaagaaaggattttaaaagcagaaagagaaaagaagcaaataacatataaaggaactccagttggtctggcaacagacttctcaacagaaaacatacattttcaaagtgctgccaggggaatcaaaaaaaaaacccaacccccaccccacccctgctgccatccaagagtattgtttcaacaacgctatccttcacatatgaaagagagataatctttgccagacagacaaaagtttagagaattcaccaccaccagacttgtcttacaagaaatgctaaagagagtttttcattctgaaagaaaagattaatgtgcaaaacaaacaaacaaaaaaaaccaaaaatatttgaaagtataaaacccactggtaaaactgaagttcggatacagccccagaatactttaatactgcaattatgatgtacaatacactcataactttagtatgaatcctaaagcacaaagtatcaaaaagaataatagctacagaaacctgttgagatagtcaatacaaaaatgtgtaaattgagaaaacaaaaatgtggagagaatggagttaaaataaagattaaagttctctcttgtttcttttttggggtgatctgtgataagttgtcatctctgtaaaatgacttgttatgtctacaagatttttttgtaagcctcatggtaacctacatgttaaaacctataatagatatgctaaaattagaaaaagcaatgaattaaaacatgttaccagaggaagtcacttaaccacaaaggaagacagtaaaaaaggaagaacggagttacaaagcaaccagaaaacaagcaacaaaatgacaccagtaagtccttacccatcagtaatagcactgagtataaacagatgcagttctccaattaaaagacataggctggatgaatacataaagaaacaagacctaactatatgcttcctagaagaaacccacctcacctatgaagacacatgtaggctgaaagtaatgggatagaaaaatatattctatgcaagtaaaaaccaaaaaatggggggaataattatacttagataaacagattattagtcaaagactttagactctgcctaatagagaaggtgactatattaataatataaggggtcaattcagcaggaaaatataacaattataaatatgcatccaacactaaagcacacaaaagcaacattagtaaatctgaagggagagatagattgcaataaagtaacagtcatggactttaacactccactctcaataatggattaatcatctagataaaaaaatcaacaaagaaacagcagagttaaactactacactagaccaaatagacctaaatgacttttacagaatgtgtcacccagctgttgtagaatacacattattttcattagcatatggaagttcatccaaaatgcaccgtatcttaggccaggaaacaagtctcagcaaatttaaaagagcaatatatcacatgtatttttttaccacaatgaaataaaactagaaatcaatcacaagaagaacctctctgaaatgagacaaacacatggaaattaaacaacatgctcctaaatgaccaaagggtcaatgaataaattaagaaagaaatttttaaaattcatgagacaaattaaagtggaaatatgacataccaaaatctgtgggatacagcaacagcagtactgagagggaagtttatagcagtaaatacctacatcaaaaaatataaagacttcaaatgaactaatgcacctcaaggaactagaaaagcaagaacaaactaaacccagccttaaaaatgaaaagttggttttctgaaaagataaacaatattgacaaacctttaaatagactaccaaaaaagagagaaggcccaaatgaatacaatcagaaacaagaaaggcgacataacaactgagaccacagaaataaaaagaatcattagaaactattataagtataggccaacaaattgggaaaactagaagaaacagataaatgcctggacacatacaacctgacaagattaagccacgaagaaatagaaaacttcagcaaaccaataaggagcaacaagattgaagccgtaataaaaagtctctcattaaagaaaagcccaggacctgatggcttcactgctaaattctaccaaacatttaaagaactgataccaattcaactctaactcttcaaaaaaaaaaaaaactgaagaggaagaaatactttcaaacttattccacaaagctaacatcaccctaataccaaaaccagacaagcacacaacagaaagtagactacaggccaatatcactgataaacacagatacaaaagtcctcaacacaatattagcaaactgaattcagcaacacattaaaaagaccattcactatgatcaagtgggatgcatcctaggatatgatagttcaacatatgcaaattaataaatgtaatgtatcctctttacctaaccaagaacaaaactataagatcttttcaatagatgctgaaaaaacgtttgataaaatttaacatcactttatgataaaaatcctcaacaaacgttaagaatagaaggaacataattccaaataataaaggccatatatgacaaacccatagtcaatagcatattgaatggggaaaaattgaaggcctttttgctaagatctggaaaaagagatgcccatttttattcaacataatactggaagtcctggccagagcagtgaggtcagagaaagaaataaaggccatccatattggaaaggaagaagtcaaattatcgttatatgcagatgacatgaacatttatttagaaaaatctaaagagtccacaaaaaaaaccctgttagaacaaaaaaagaataagtaaagttgcagcatacaaaaccaacatgcaaaaatcagtaccatttatgtaagccaacagtgaacaatctgaaaaagaaatcaagaaagcaatctcatttgcaatagctacaaagaacataaaataactagaaattaatttaaagaagtggaagatctgtataatgtaaaccttaaaatgccgatgaagagatggcacatgtatacctatgtaacaaaactccatgttctgcacatgtaccccagaacttaaagtataataataaaaaaaagaaacacataaaaaaatgctgacgaaagaaattgaagaggcacataccaaaaaaaggaaagatattccatgctcatggattgaaagaattaatattgttctgttaaaagaaaaacttcaggtgaattaaatttaaatgagtttagttgagcaatgaacaattcatgaatctggcagcccccagaatcacagcagattcagagagactccaggggtgccttgtggtcagaacaaatttatagacaagagaagtaaagtgatatacagcaattggaagtgagatacagaacagctggattggttacaggttggtgtttgccttatttgaacacaatttgaacactcaatagtctatgagtggttgaagtgtggcctctgagattggccaacactcagctattgttacaggtgcatacttctaagttaggttttccatctcatctacctattaattcaggttgcagttcatccacaaggactcaaatatagaagtataaagtccttctcaggccatacttagtttgctttaacagttcaaatgacagtgctactcaaagcaatctatagattcaatgcagtccttatcaaaatatcagtgatattcttcacagaaatagaaaaatgttctaaattttatctggaaccccaaatgaccttgaatagctaaagcaattctgagcaacaactacaaagctggaggcatcacagtatctgacttccaaatatactacaaaaatatagtaaccaaatcagcatggcatggaaacaaacatgtagaccaatggaacagaatagaccacccagatataagcctacacatttacagccaactcatgttagacataggctccaagaacatacagtgggcaaaaggtggtttctttaataagtagtactgggaaaactggataaccatatgtagaagaatgaaacgaaacccctatctctcatcatatacaaaaagcaaaatggattaaagacttaaatctaagacttgaaattgtgaaactactcgaagaaaacactggggaaatgctccagaacataagtctgggcaaatattttttgtgtaagatctcaaaagcacaggcagccaaagcaaagatagacaaataggattatataaaggcaaaatgtttctacacagcaaagataacaatcaacaaagtgaagagacaactcacagaatgagaaaaaatatttgcaaactatccatataacaagagattaacaaccagaatatataaggaactcaacaacaaaagaacaattactgatttaaaaaataggtaaatgggtactatgctcactacctgggtggtgggatcatttgttccccaaacctcagcatcatgcaatattcccatgtaacaaatctgcacatatacctcctgaatctaaaatatgagttgaaattacaaaaaataggtagaatatctgagtaaaaatttctcagaagacatacagatggctaatatttatacgaaaaaatgttcagcatcactaataatcacagaaaagcaaattaaaaccacaatgaaccatcatctcactccagttacaatggcttttataacaagggcagggaataatggatgctggtgaggatatggagaaaatggaaccctcatatactgttggtgggaatgtaaatggtaaaactaatatagaaaactgtttggagattcctcaaaaaattaaatattgaattattatataacctagcacttatattactgactatatatccaaaatagtggaaataaatatattgaagaggtatctatctgcactcccatgtttagtgtagcactattcacaaacaccaaaatatggaatcgacctaaatgccaacaatagatgaataggtaatgaaaatgtgatatatgtacacaatggaatattattcaaccataaagaatgacatcctgtcatttgttgcaacatggatgggactggagatcattatgttaagtgaagtgagccaagcacagaaaatcaaatattacatgttctcactcatatgtgggagctgtaaaagtgagtcttatgaagacagagagagattggtggttatcagagtccaggaagggaaggagggagggagggatgaagagaagttggctaatggctacagatatacaatttgatagaaaaaataaatcttagcctgtgatagatcactaaagtgactgtagttagcatgactctatgtacatttcaagatggctggaagagaataatttgaacattcccagcataaagaaaagttaaatatttaagttgaggtatatgccaattgccctgatttgatatttacaaagtatatgaatgtatcaaattacagcatgtactctggaaatatgtacatctagtatacatcaataaaaatttttcaaggaaaaattattggtggaaagtaagttactatattaatttacatattattctatatttatgccagacaacaatcacccaccttcttttttgacttggttcatatttagttaagttaccattcttacaaatatggatatgaaaaaattaaattggggaacttcgtaagttatgtttttgttacttcagttttagatattttttctacgtgatagaacctggtgtcttttttttttttttgataggtgaacactaaaaacagaaaaggcaaataaagaaactgattttgaattaggaagcttcttacaattaattgagttttcagtatatgccaggggactacccaaggtacaaatatgaaatgaggtaactaaaaagtgaaatccacaatttacatagctaaatgaaaagtactctttcaaagttctataattatcataggaaacagtaaggttgtgattgctcaaagaatttttgggtctctcatttctatattaccactttttcctgataagctgtgctttcatcacttttaagttttggacttctgatagtattttgtttgaacaaaaggctggttccacagaggaataaagaaaaaaatttgaaaatcatttctgcttgttgtacaactctaaaagcatctttgcattaaaaaaatcttcttctgaataaaagtttatgtatacctatcagtaaaatttctaacagtatagaaatgttaaaaaatcaatagaaaagcgcaatttcatagcagtttcacctcctagatagtcaccattgttgacagttcggtgcatgttcttcttttttttttttttttttttttttttgagagggagtcttgctatgttgcccaggctggagtgcagtggcgtgatctcggctcactgcaacctccgcctcctgggttcacgccattctcctgcctcagcctcctgagtagctgggactacaggtgcccaccaccacgcccggctaattttttgtatttttagtagagatgaggtttacactgtgttagccagaatggtctcgatctcctgacctcatgatccgcccacctcagcctcccaaagtgctaggattacaggcatgagccaccacgcctggcctcggtgcatgttcttcttgaacatcctgcttattggaggcacaaacagccacctgcctgggaattgggaaggggtgtgtgggagcaggagccaccttgagcagtggtcaggtgtgagaacacccctcctatttttacacaggcatcgtcctttgtacagagtgggggaaggccaagagaccatcttgaacaatctagcttttggatgttgaaattagaataaatattcaaaaattcatgaattatgaattcagcctcgttagaattttcccttgttggtttgtgttcattccacaagactacatctgataaacctgtatgtattattagttactctttatttttttaaagtcaagatattatctagattaatatttaggggaaagcagaaggctaaaagtaaataaactttgaaactatggtcttgtgttaatctcttcatggcttatcgctctatgtcagtggttctcaaatatggtacctggaccagcagcatcaacagcttctgagaacttgctagaagtacaaattcttggtccctactgagttggaaaatcttgtggtggtgaagcccagcaatctattttaacaaatcctccaggtggtattggtgcaggataaggtttgaggacactgctctatataaaagccaaaggttaaaaataaaatcaacttggtatttctcctctctcattctccactaacttttaccccaacctaaaggtcatgatgttactgaggcataacatgatttttcttaagagctgagattttttacatctctgctgttagaatgccattctccaccattgtctacataacccattaataactattctttaaaattttattctagcataactcactggagaacctcccttgacccagaaatccagctggacttgactcttatgctttttggagccctatgaatacctgtttgtagttcttcaaatttgattgcagtgatttgtttacatgcctctctcttttccagggtattgataactccctaaggaaagggattacatctttcccttgccctttcatccctgacacctagtagaatttatggcatatgcagatactcaataaatatttaagtgaaggatgaaatgaaaataaaatcataacttctccaagattaagaattactaagaggcaaactagtgttataagaaagctgaagtgacttgagtttgaattatactgactgtatgttagactgcttgggtaatttctctgacactatatagtttatatagctttttactatataaaattgacataattcctacctcacaggttcacgtagaattcctgacacacagttaacactgaaaaatggtagctgataatcaaataaaaaatagtaacttcttacatattgtagtaatttgaggactgctatcttattttgaagtcatatagttattataggagtattttcacttatttaaaaaaattattttactcattagaaccaaaacaaacttgattgaattaaactatttaatattttgaggagaaagtaacaaaatgattcagatatatggatggcaaacattttaatcagtatgcacttatgattttaaaaggtccttgtatggtaaatttgcatatatatatatatttttttttttttttacaaataacagcatgtctatttcttgaactccacttgtgagactaccacataacttattgactctgtcatgattcccaggaatttattttgtgagttaaaagaatttatacctgtgagcataataagtactcttacaaatatttgatccttatttaggccccaaacagattcatatatttttaaaggagccaggtgtcagaaaattgttgccatcatatattgagaaaatttaatatttatacattttagtaggaaaaaatatagtgcctgtccatcatattagggatggaatctataatctatcatcaacttctggaatatgaatatatatggacagtcaagtacattggccccagtatacatgtcttgttttttctaagagaactgatccctaaaaaaaggaaaaaataaccaatgagactggttcgctgtttgctcactgataggagttggaagccgggcagcttggttgggtagagttgaggttagagatccaaataacccatgccactcagtttagagatgagagcctggggcccagagaccatgtgacctggccactgtctcactgaaagtcagggctgcagcaaagattagaaactctgtgcagtctcatgctggttgcatggcattttgaggcagtcacattggcaaagcagctgtccaaggagtcactttgttatactgtttgatactagggactttttcatgtgacctgaaaaaaaaaaagattaagcttttctgttttactttgctgtaattcaagtaatcagtcaccccactcttgagcttttacccaatcttcttcaactctgagaattaggatttaatgggatgggcgttagcaatgaggtgagatcagtatgggaatcaggaattggatgggggatatctttcggtccattactttctaataagctcagcacttttgacctggcctcatcagaatggttgttttgaaacaggaaagtcaaaatgtccctctggccaaatcaaaaggattcatatattctttatatagggctcttcacatcagctcacatttctgtttctaaactattaaagccctaacgacttatgcaaatgtttataactggatataaatgtttgagtctgggctgcccctgtagggggttttccctcttgattcaggttgttatcaagtattctctgggggaaataaccttaaaagatcattcagattccaaaacatcttacatatgccatattttgacagggcattcattttttttcctggggggaggggagataggttaagagagaagataataaaaagaaaacagacaatagtaccaaaacagaaacattgtattacaattagatcacaaataccattgcacagaagccaatataaggtagatctaccctggttctttctgtccaaagaatttcattgtttgatagtcctgtaagagtttttatatagcaccgaggatatgttaaggttgccattgtggcaagggtttaaaggacatagtttactaagttatttagatgctagttatcttggtaacttcgtccatttaaaaatatttcttcattcaggatttctgttccattcctggagactggcaggaggaaaatcagcttggcagatgagaacaagcattgttgtctgccttcagagtggctggcaagagtatctcagaagcagtttctaaagaaggggatggtggcccccaaatacctctgatgaaagaatttgggacttcagtgccctcctctctttttgtcaagtaaactatatccattcttctaggtgcaatacttcatctgaggttaagctgaaatgaaataacaatgaaaaaccgtcagagaacaatgctgaatactcttcccaacctagtgcatcagtggcacaccccacactcactggggtcattttgcccattagggctgagctacttatctacatcctttgagaggattattttctctgtgccagttcttggtaaatactcagaccctaagggaaattcaaattatcctggattaaccacatacagtcagaggagctaatgactgaaaaatgctccttgttcgttgcaaaatacccaagacccagaaaaagaagtcttccagggctcctaaggtggaaattccttttaggattttaaggccacaagtaacagagtcctaaagcagtagattttatcacagtttcaaaaaatagctatgtaattcaactacagttgctccttaagacagcaaagacttagaatgaaagagagaagggaatctcaaaatgaaattaatcaaaataaaagtcattcttaagctttcttcttaaatcaaaatcaagagaattttttaaagctgattaaatttaatgtatttaggtcaaaaggaaaaaatgtatcataatcagacatagtcctcagcaaaggctgaaaagggcaaaagcaagatgaagggagaaaatgatgaatcaagctaatttccataatcctgttttattagtactggcccatgggtggtacagcacacacaaaccacaaatagtgtcaaattcctcagtggaaaccaggctactcctgggccagcccagatttgtggatcttgcctgataccagttcagggcagccaacttgatgtggcatgtcctactcacatggatctttgagattcttgacagttctgggtcagttttcaaccattgtcagccagagctatctttggtcccgtctggaacagaatgaaatttctaaataatgcccggatttaatcctccctgtgaagcgccttctgcgcagtaattaactagagtcagatcagattttctaaagtttgctcaagctagatctgcgtctctgggatttggcgtgtccagcagtacgcaagtcaagtggatccctgttttcataatgcttgtcctatctgcttcctttactatctcccagatttactccctaatcaattcagagcttaggctattgttaaaacaactttctcagtttaggcttctttctctgatatagctactagattagggttcttaacatactcctgtttgacagttcattctccagctaaaaatatctttattggcttatcataatataaataacaaaatctagaccccttagcctggtgtttaaaactgtctacctccaacctgcaacttcaactgtatctcatatccctcatcctgaatccaagctcctcacctccaagtgtttgcttgcattgtgtctgccactcagccgttcccttgttcagatgtagttactgagcatctgtgtgccatgtggtggtctaggtgctgcggatactgcagtgaataaggccgacacactccctcctctcatggaacctgtgctctcattctgggagacaatatataaataggtgatatttcaaatgtcagaaattaggacaagtataaaaaggtgacggaatagaatgcagacaccctttcaactctcatagccctacctggctctacaatttatgtagcgttcatgacaggctgttttggtttttgtggttttagttacacactctggggcagatcacccatgatgaaggtattgaccctactactcactgcctcagtgaccatgggcaagtttcttttctctttttcagtttagccgtctctaaaatgaggataatatcattattctgttcataaggttgtcttgagcattttatagtgtctgcagaatgctcagcacagattctggtatgtgtgtgtacatgtgtgcatgcatatgtataacatataatgacacttatttatcgtcatttttgtttgggtgaggtaaattttaaataatataaatatttatactgataaacagataacttttaaaccagaatatcattacagtcctgtaatgtcctgtatattattataatgtacgattgaattatacattactgtttccttacagtctacttaattgcaaaccagaaggagggtacaagctggtagcctctaggagcaaccatgcatttctgagtctggttgtgttaactgtttctttcgtattcaatttgatagtacaaaaatattttacatatacattaattatttctcctagctaaacactaagtccctaagtttcaagcgaatacaatgtggaaatagattagaattaactgagatcatggtaattttttgacattttattttacataaatttgtacccaaatgctacagactcaacttactagtaaagttttcttaagtaattaacactattatgtaatgggccttcccactctagtaaacagtactagtggctttattacctgttgaaatttatatgcatagttgctggtagctgcagtagtatctgtttctggtgcacacctgtagtcccagctactgaggagcctgaggtgggaggatcacttgagcccgtgtgtttgaggctgcagtgtgccaccgatttgagctgtatttttaaaggaattattttaggctatgaatagacagcatctatatttccataatacttaatgtattttaacactgaaaagttttcttgtaataatacagttaaggtttctattttggcaaaatgtaagaaaaaaaatactcaacacttgctttagcagtgtgatggtgaagtgagtaacagatgagtttagatgctgtagttgttcacagggcctgagacccagcagagggttcagtggaacaatggggaatgttagctattgaagtacttacattccttggaattcaagatatccaaggattaatgagtgctataagtcaaattgtaattaaagattcaaatccaaaggtgctggcagcattgcctgcttttagcagatctgaatattgaaagctgggttcaaatgtaggttgtcatttacctgccatcctcctagaagtcactttacttctctgacccttagaaggttctcatttcaaaatgaaaatacagaaatcatgggttttgtgagattatataatactaatcacttaacctagtgcctgataatcataagcactcaataattatttgctgagttaaagaatggaaaaaaacaagctgattctcttggacctcagggtttcaaaaagctattctatttaagcctgtgattttcaaccctggctgcatactagaatcactggaaagctttaaaaaaattctcatgctaaggccccatcacagactatttgagtcatattctctgaaggtaaggtctagacattagtgtttttcaaaagctccacagatgtttctaacattcagccagggtctctgccatctgacaaccatgtttgtgcagttgtctatcttgccctagttgagtatgctctgaaatgcccttgaatgtatttcctcctttacattgtggtgccttgggttcacatgtgtactctatcacctgaactattgcagcagtctttttttttttttgatatcaccaaaaaaaacttccttttagttaatctattgaactgccagcacagttctcctagaaaacaaattagaatgtgttactaccctccttaagaaccttacccgtagcctgttgaatgaagttctgagtttaatggggcacacaaggctattggcaatctgaatctacaccatcttaagatacatgggaagtcattactgtaacttgtcaagtttgataaatgcagccaaatcacagcaaacatgcccagagttaggaggtatatattttggtgtccatttttgccacacactggccctcaaactttggtgagactatcgatgtatagaactcagcatctttccctgtttggaagaaagaacaagaagaaatacagcttagaaataagtggaaggggccaggtgcagtggctcactcctgtaatcccagcagtttgggagtccgaggcgggcagatcatgaggtcaggagtttgagaccagcctgaccaacatggtgaaaccccgtctctagtaaaaatacaaaaattagctgggcgtggtggcaggtgcctgtaatccaagttactcaggaggctgaggcaggagaatcgctttaacctgggaggcggaggttgcagtgagccaagatcatgcaactgtactccagccttggtgacaaagcaagactctgtctcaaaaaaaaaaaaaaaaaaaaaaaaaaggaagacatttaaggaaggagtgatgtaagacactggaaaacatttgtacttttgtatgaaaatgctgtagcagaaggcttaatcaccccatttgtcattcagacctcaattcccctgtccctcagagaacttacctggaacccttagatggagacatattccttcttctcctctcctctggcactgtgtgccattcctctgtaacccttctcacctgtgtaaacacgtatgtgcatttttgtgactatttgcttgtctgattcccaactctgccatgaatactttgcaggcaaggtcttgtccagttttctcagtgcatgtctacagggctgggcctggcatgtggtaggtgatgaatttccaggtgggtgaccattgggttgactgactgagaaaataatcaaacagttgatgtgtgtaggcagtggggaaatgggaagcacataaggcctgtgtggaaggatattttcctcttccctccagggctggccaccttttcagggtccctttacctttcttctggttccactgaagaggccatgggcttctagaagtgtaggcttttctctgctttgcccatatcaagctgggggggctttgggatggcatgtcacgctatgctaccacctgcgtctgtggagtcttctagccagtgtgcatctgttttgtttcccattgtgttctgggtgctctgaagggttttgtgtagacttgtaccactcagtatggttgctattaaccacatgtggctactgagcactcaggttgtggctagtctgtattgacatgagctgtaactgcaatagacacatgggattttgaagagttaatataaaaaatactaaaacatcttgattttatattggttacatgttgaaatgataatattctaggtatcttgaattaaataaaatatatgattaaaattatttttacctggttgtatatttttctaacatggcttttaaaatattaagttatgtatgtgacttacacatttctgttgactagctctggtccagaaactacatttcttacatcatgaattcatttatctgcatttcatttgttcaggcacatatgaaaatgaacactttcaagcagtgtatgaaatgaccactgttaccaaaccagcgagaacacagactttaaggactgtcattttattctcctagtctggtaggcagtcataacttctgttagatggtttgaaacgtttacagatgcttcatgattttctttgagcagtcctgaggctgggacaaaagatggagcatctttgggctggaaatccatggcatgttccccacgacgagatcctatcgttctggccttttctttctgagactttctgcatttcatcctttgaagtggtaatagctacggacaacattcaggaagcagtgatctttgccagtgagttgtgtgactttgacagcgagctgagtttggaaaatgtgttgactttgtcccagctgtgtgattgtgggcagctctgagcattcgttaaactttctaagtcctttaggtcatatggaactctccaagtctatttcagatcacatcaacagtttctcctctggcctgacatgagcacatggggcatgtccattcaaagggagttcatgtgaaagttacagtggctttccaatcagctggtgatgatgctgtctgctgtatccccagccactctgctggagttgctactgtaatggttcagtgactaattggtgtttacctacagagtctgtaaatacattcccattcttggtattgaacatattaaaattgccatgtaatctttgtagcttattctctctactatctgcttaaaggcagagaaggatttgcaaatatgattacattttcaaaatgaaagtgtttcttttacggttgtgtactaacaattctttatcatttgcgtactaagtttaacacactctaacagaccagcataaatttaggcagagcagggaatatttctatctagaaaactgtgctttcaggcagctaactgcatggatgagttccaggttttatctactttgctatttggaccgggggatggtaaaacagtgtatgaggaaagtttcttactgtctttcacttggtgagagaaaattagtattgctggtcccagtttgcttttttctgcttgctctttagtgggaaagtgttaattttgaaattgcatctgtaaattatagtcatgtgaattttgtgctctgctggaatttctatgtgttggcctggagtctgtctggagcacagcaggcaaagcagttgggtgtggctgaacatgggagtgtgtggagagtgggcagagtgagggtggaaggggcagggcagcagctcctggggacttctctgagtgtactgctaagtaactggcactctgcatttaagaattttggggctggcatggtggtaatggtggtatgatcacattaatagttttgaaatgtcatacaacctctatggtagccaagtagaggatgaaattgaagggagtgaaattgtaggcctggagacatattggaagctattccaataattgaggcaagaaatagagagggccgagacatagcagaggcatgggaggagagaagggattggatctgagagagtctgaaaaggatgaattgactgataggatttagacctggcacttacttccagaaagtttccccaatgtctggccaggtgaaggagaggagtgggattgtggggtcattgggaatggggaggaaaagcaggctaggaggaaaagatgctctgtttggggtcttcagaggcagagtgttgaggtcaagaaggcagagacggcaggaccatagtggtgcggaaatgcctaatgaggcaagtgcagtcctgtttgctttagaaaaaatttgctcaatgaccttctttctctcagaatctgaaaaatatccacttttaatcaaataagaaatatatcattcagaaaatggcaaccacaaaaagcttctcagagaataaggtgcaagtgaatctacttagaatacacaagtattctcactggagtacgatgtgatgatgagaggggtgggccagagactggtcattcttgcccatcaaacctgtatcaacctgaagaaagagagtctggcaaatgtccaggtgcccatcaagatgcagactaggatcacctcttttaaagatgcctttgaacccctctagctccctctgcccacgaaggggtgcaactggccttgctgtctcccctgggcttcagatgttgcttgtcatactagtctgtgttttccctcagtacccttcattgttatggtctttcctaatagactgttggttttttgagagcaggaagcattgtatcctcattttgctccctgaagcttttggagtgtgtgtctggtgtatctagcacagaatgaagtgttcagtaaatacaagaaacttatagaaagggtagtgaagtggaaagagcaataaccaggacagaagaaaagggacctggtactaaccctgctactattagttgtttaacctggagcaagccagtttttctgggccatggtattctgataggcaaaggaagagatttagtgagaatctggaaagtccataaatggtccttcagaggtccctggatttcttgatattagatgcagactttatatgtgtttttgtgtgtgtatgtgtgtatgtgtgtgtgtagataggtgggtttaattttttgagtaaatgagtgatagctttcatcatactctcaaagggatctataacaaaataataaccactgaataaaacatgatatctctagaatttgtaagatagagttgtggggcctgggtataggcattcagctaaaggacttgtctggaaattgctatgaacaaacacaccctagttacacagatttttgtgtttatttggagtagagaggtgtggcttctctgagcccatcctgtgtactatcctttcttagaactctttcagttctatgtgaggtcacactcacattttgttttctgaagtactttacaaagaccaaatctgactttaccgatgatgatgaggatgatgacaatgacaacaaaggtgatgatgacgttagaaatagcagcagaagtataggacattcttctatgtgcatatatctgtctgtctgtcacctctttaacgctgaaagtaaacttgtttgataagtgatgttttaattgtaatttcgtaggtaagggaactaaggcacagagccttgatcatcttgactcccgtccttaccttgctagtaagagatggagctggtctttgaacccagaaaatctgacttctgagcctgcacttctaatcagcccagtatatggctttttttttaaaggaagttcttgttctctgtagtttcacttttgaagattcaaaaaatagtaagtatagaatacttcttaaatttatgattgttaccaaggacagcacaaactataatttggatccatttaacctatatagatactctactctcttgaacaatggaaatgtatttcccatagtttacagtcttcctgacatagaaatgttttgttgatcttatctggctgtactgctttgctttgcccatagaggaggtgctaaggacatttttcaacagcatcccacagatcaaagcaacaagcaggtgcttcaggaaatccctaagatgtgttgctggaagtgacactaagctgtagtgtatcctaatgggggtaatttactgtgtgaaattagagtttcgaagaaaattatgataatgagttctgttgatttcctgggagagttaaggtgaaacatgttgttagtctgaaatttaccatctggtctggtttagaattagacctaattgtcagataacctggtgtctgggatgcctggatagtatcaggtctctggggtgcctctagcttgcagttgacctggtctacagactatgcttctgtctgaatttctccacccagcactcatgcccacactcccagttccctcttctggggcccaagtttttctccacaaccccacagggcacttgctctgatccttcagaaaccaggatgcaacatctgtgccttgagcctctgctgctagatagcaacctaatgttgtaggggtgtgatgccgtggaccccttcttgaacccccaagctcgtcttgcatttggggctctagcatgcagctgcctgattgcccttgcagagcccacctccctgtaagtaccctttccctcggaattccttttgaacccaggttgttgttactgaacccggcctttccttttgggtctggtatgggttaagtggtgagatttcagaatagagaactcaagaagataaatccataattaattagcaactttttggcagacctacatgttggtctcatggcttcctctggttactgtggctgtgcctttcttaactcaggaccttaaaggtagccataacatactgctcctgcttagatgacttgttttaattacaaataacatcaacagcactaatgtgctagagaagcaaagagtggacatttgcccgaatgtctcatgaagagaatagtttaaaatgggtagttttatcagtgtacaatatcaccagtctgttttcaaaagctgttttattttgtggtttttaaattaactaagggatgaaaaaaataaagagctaaaacaaaataaaaatcatcattggttgaaaatgtttcataggggaacatgtcagtatgtttgttggctctaggtttgagtaaatagacaacactgtctcatatttaatgtttaattttcacaatggattcttcaactattcattctccacttgtgccaggttgagccctttacatatctggacacctattatccctaatctttaaaacaatttagcaaggtattactcttttatttgtttaagccagaaatatttttgtgttaagtggttgctgtgagcctgtctgtgaactaggtgatggaaatacaacagtgaagaatcactttgattctactgcccttaagaaattttccgttgtcagattgaaagaccaatgaacagatcactggcacggcttatgtttttatatactcttcaggggtgtctaaatttatgcagatatttttcatattgaagcaatatttatgcaaatatattgaatatcatgccttttgtcctagtcatcccatttaaaaatctttcctatagcaaaatctgcacataattgaaaagatctttggcgagaaaaataattgcagattttgcagaaaaatgttgaaaaagctcattgacaagagaatggctaaatcattgctgtttatatacactgaaatgttacacagcactaaaatgaataaagtagatgtatacatatgacatgactctgctttattgttaatgacaaaagcatgctgtagaaaaatctgtataataggaatacattacttaataaagcaaaggaaaaaagaaaaactctgccagagtcataccagatttttagctatggtcccatttaggcagaagagagaggagaggtgtgaagggcatcttttatgtattactgtattatttcagcctgacaaagtaaacatgtattcttttgaaatatatatatatatatatttgagatagggtcttgctctgtcacccaggctggagtgcagtggcactatctcagctcactgcaagccccacctcccaggttcacaccattctcctgcctcagcctcccaagtagctgggactacaggtgcccgccaccatgcctggctaattttttttttttttttttgtatttttagtagagatagggtttcactgtgttggccaggatggtctcgatctcctgatctcgtgatctgcccgcctcagcctcccaaagtgctgggattacaggcgtgagccaccaggcctggcctgaaatatttttaaaagccaataaattttcattttaaatgaggtgatagatgctacggtggagttatgtccggggtcctatggggacacaaaggggacacagaccatgggccagagaaggctccgtggaggagtgggtggcctcactgggttcaggatggtacatgtccaccatgtagaagacacagagagaacaagggcttcttgcttggaagcatcctggaggcttttctggtaggcggccttggggctgtccacctccagagccttaacagctagcccaggtcatcctgggttcttcttcccttagccctcacagagcatcagctactattcctgaacactcctcccatttccactactttcctgtctactgcagccatcttggttccagtgcctcacctctcacttgggtggttgagacagccccctcagttggtctcctggccccttctctgttccctatgtcctctaccccagtctgcccttcactttgctttaaaaaggcagttttgaccctgtgattgtcctttccacactttctcaatggtccttcctagcttctggaatataagccacccttctaaagcagatttgcagaaccctttgtctacctttcccacctgcctcacaaagtagctcttatttatgctatccaggatgattttcatttctttacagatgccactcttcttactcaccaaaggatagacaaagggaaagaaagaaaattcatgacatggatttactctagttgattgttggcctattgacctgcaggtattgttactagctatgtctgtttctgggagttaatgtatctcagaatttcctattattttgtggtaacaagttagaaattaatatattgcaggaaaacagtcttcttagtgtccttggagatgttttcttttgtaaaaattcttgaatggatgtttccagtggcaggtcagaatccccacaaagaggatttaagaatctggcattagtttgtatacttgtctattccaaatccggatacgcttcgcctttatagaatacacattgttctaaaaacaccgcattgactaaacagtctttatttgctttggctaaacttagagttaacggatggactcagtgtacaatagcatagacacaaaactgagtgccagttctcactcactttgggatacactgcatgctgtctttccattcctcctcatttgctgcatttgtatatttgttatttttctgttagtgaatagtaataaataactcctgttaagcagaaaataggagttggtctcagcttgttgattttcagaaatgtttgtccttataaaacacattcaattcaggactaaactaatagactatcatctggctccctctggtggacactcatgaaaaaaatcaagctatagttttctgaaagaggcggtgtgtaggggaggggttgtcatttttctggtttttggtgggggaaaaggaatagaaaatgcattctgattttgtagatacatcatagttattatagaaaatatcctcaaggagtaaaatgcattgctatataaaatacataatagaatagcaataataaaagacataaccgtagtactgctattgctatttttcttgttattaagtagtgatatatgctgggaccacagtgtaaagtagaatcagaggcagatttcaccccatagctttctaacagtgatatattaggataagatgcatgctaaagtaaagcaatgtagttaattcaagggtctggatactgtactgattattccagaacctccccaaagttagacttttcgcttaatagtgaataattttggtattttagcaagtgactatttttattttgaattagttatttttgataaatttattagtatttgttcattcttgatcttctgagtttacaaactcactgacaatgttttatctttattatggggaattaatcaatatcaagttttatctgattggttgtatatgttttgacattagatgttcgacatagttgaccaggaagaaattgcatgaagggtttcaattgtattttcttttctttttctagtctcacagcagggggctacggttagaatatacaattttggggtcagtaaattagctcatctagtcaccatgtcctttgcttctttctaaccctttagaactatcctaaagagttttgctcccttctcttttgtttatgtaacaaattttcttaattttttaaaaattaacaaataaaaattatatgtattgatctgtgcaacatgttggtttgaaatatgtatacattgtggaatggttaactggagctaattaacatatgtattgcatcacatcttttttattttattgtggtgagaacgcttaaaatgtaacctttttgcagttttcaagaatgtaatacattgtcgtcatctatatgtaattcaattaaatgttatctttgtataataactttattttacatgataataaaaattcacatttactgagttaagcatatgataggcatgatctcatttaattcttttagtaactccatgaagcagttagctattatctgcattttacagaggctagtaaaggtgagcatagctgaaaacttgtgagtcagggctccaggtattcttactccaaagccaggagtttctaactacaaccatatatatatatggtaccagttcctgaagtgggtgagatataagtgtatgtgtggctggtactctcatgaaccttctacagagtactggagagacttcatttttatgttcctgtctctgaagtaaggaattagattaccttaatttagaaacagatttttgccttttctcgctttttactatcattctgaataagcctcatgtagaacctctttaagttgtgtttgttaaaattttgagagttaggatgcattatatctattatcataaaaataaactttatggccgggcacagtggttcacacctgtaatcccagcactttgggaggccaaggcaggtgggtcacttgaggccaggagtccgagaccagcctggccgacatagcgaaactgcatctctactaaaaatacaaacattagccaggcatggtggtgtgtgcctgtaatcccagctacttgagaggctgaggcatgacaatcacttgaacctgggaggcagaggttgtagtgagccaagatcgcaccactgtactccagcctgcacaacagagtgagactctgtctcaaaaaagaaacaaacaagaatagactttatgagaaaaatacattttagataaatggctttctcactaagtcttcgaaagagacaatcttaggacaaaagattgaaggaagggtaaagttgctagcagagtatatttaacatttagatttaagtactgaagatctttataaggaatctttgaaacataattaaggttaatttagaaaactttttctgaaaacactcagaattaaattaaggcaatttccttaaagttggtgattatacagaatagctactatttaaatagtttacgtgctagcttatttaatcctcacgataatgtaatgattgttaataatctaactattattataggcattatctagaagatgaaacaaaagctcagagaagttaagtattttgcccaaaagtacttggccaataaatggtaagctgaggatttagactcaggtggtctggcccaagagcccgcccacagtctcacctgctttgctatatagcaggactgtccaatagaactttctgtgatgatggaaattttttgataactgtgtagttcattacagtggccacatgtgtgtggctactgaacacttaaaatgtggctagtgcaactgcagaactgggatttttgtttttaaaatttaaattaatttaaatagcctcatgtggctagtgggtactatactggagaatacagctttccagaatctttcagattctgtaaaagtagagatacaagttgcttggggccacccaggctaactttgtgttatactgatatagaatctgcaactcaaatgggttagtaatctacttaaagtaataaagtaatttattactttaagtaataattataaaattataatccaggtgtttatacttcccaatcacagcccttctcattctgcacatctttgacacctgcaaatttatgtttctgctgctatggttaatattagattgaaaaaattttggaaaaagaaatcttatattttctgaactacatatctaattagtattttcctcttttctcaggttatagaaacattatcacgactttctcgaacacctatagcattggccacaggaatcaggtaagctctgttttcgttgttcatgtgtcccattgagttcagtgtaatgattctttattaaatggttactatttgtgaagcatcttgcacacaggtactatgtctcattcatgaagagtgcctggtatgtaagtatcccgtacacgtttgaaattaattgagcaaggtagaacttattgatagagttgaataacacattggctaaacattgttctcaattcacaggtgactgtcactggtgtggttcttctttttttttttttttaactttcctccaacatttctgtacatatgattcattaaagtaaacacaaatgcttaagtaaataaatatttataagatgttgtaatatgtttatttcctatagagtagatcataataactcatagcttttaggagtttaagaaataatcaaacaagtataaaacatgtgtacaagaatgtgtattgaaggttcagtagtaaattaaaaacctggaagtaaattggttaaatatagtatgtcatctccttgcaatagagtattatgcagttgataagcataaaaatatagatgtgtatgttgtgttgagccttttctgtttcagatactacatacttaagttagatcagtcagcaaagatgtattatataagtaacattaggaaataaagcaaaacagtctctactcagcctggtttcatggaaatggatcaaatttgttttttaccttctttattcagtgctccatatttctgtctctggccatcacagccatttttctgtgtccagctcacattcacattctaagggagagaggatccaagcaggacttagtggggttctctgcactggctacaaagcacagtgagctcaggaaaaatgccctgctggtacaggacctttctcagaaatgggccatgaatttggcagctttctatgtatatggtctgtcggctggataaatgtttaactcctaatttgctcttcaatacatgcatacctttcatgtcaatatatattttatgttattatatgtaaagatttttttaaagcatgatcaaatttttatgtattgattctgaaaaaacgtaagtcaaaatttttctcctttttttctcatctatattttctacaatgaacttgcataataaaatgtgccttaatttataaaaaatgattatgagactacatttctcacacactgatttatttgaaaaacctagtctcctcaaatgtcttcagtattaaattaatccataagtcaatgtgaaactctgcttttaatataactagtaattatttaaagcttatttattattttgatggatcctctggtttttatgaaacatgtgatatgctggctgcctgaaaagagtagaatttttggcacagtatgcttactgtgattttgttagacataaatttaaggcagttatgaaaaaaggacatagtaccatgatgcaaacaaggaagccacacagtgggaataggagatacattaaaggtgattttcttgaatagggaacaaagaaaacactctattcaccccaaggtctggttgactcatttgtctaataaacgaaaataaaacatacagcttaaataccctaaagtctgagcagaaatgtcagggtcaatgaccgtatatgtaaagggcacaatgtttttgtcttctactagttttcatctacactagtgaacggagccatggaaggatgattgctaccaaattatttgttatcagatcccacagctgaaaagagagggtgctgaaggcaagggtacatgcacagctgtttgttgtctgacttggggtgctgcagtgggtgaggtgaccctgcaggtatgtggcaggtgggagatcagataagcacgttattatgaccccctgcacatgtgactgtggtgaccagctgtaattgcttcagatgatttcaggtggcaggtgttacagcctccctaggggaaccccagacaaagccactgagcaggcactttagggaaagccctagatattgttagacatggtgactgatctgaccattttggcagcagacaacttacatatttagtgagggttaagtgcgcagcctgattgttgctcgttcactcatgggtttgtttttttgtttttgttttttctcctcttcctaggcccttcccaacagaagaaagcattaatgatgaagacatctacaaaggccttcctgatttaatagagtatgttgaaaatttcaagcaaaatttagccactgccaatttatgtgtccattgtgggttttaactgtggatgttaaagtaagctatctgaaggaggaaaagtggcttaattactgattaaccttaaactggcgatggaaagctttacaagaaaatgtacttcaactggtttttagttcctgttttgtgtccccatgaagaataaagaaacttactctaatgaagtaaaatttcaaagtttctcaaaggcataacagaagtagtagataaaactggagttagggaacaatttaaaagaaatagaatctgctgctggagttgtgggacacatagtgcatgccttataagttcaaggaagggagagataagtgtgggttggagctattcgggatgttttagtaggcggtgtttgttctgaacagagaatctttttgggctctattatttaatagtcaagagaggcaaaaggtccttgcagccgattatcttctgctgattgagtgacttgtacagattacaaataaatatatgcgtgatcgttactcctcaaggaactgatgacatggatcaggcatgtttgcaaagaatcataataagaaatagattatgccccaagacagattcaaatgctatggaacttcatccattcattcatctatccttcctcatacacccaacacactgggcttgttttagccttgtgacctttacacctgctattctttctgcctgtttgactgatccctcagcgttcaagtttttgcttagatttccctacagagaggccttctctgactatcctgtctaaaattgccaccacccccttacattgctgtgtttttacagcatttgccaatgcctgagacagtcttggtttgcttcatttattgtttgtctcctcattagaaggtacacttttgtgaggtgtgggactttgccttgttcatggctgtattcctagaacttcacagtgtctggcatatagtaggtactcaataagtatttgttttccaaattaataagtcaaaactgcatctagcatctactgtttgccaggtattacacctggcaataataataagagcttactgagtttccatttgtgtgctaaccaggttatatgcactatcttatgtaataccacaatattactaggttgttattatatcttcacagtttaaaagtgagaaaactgaattttgaaaagcctagttacttgctgagggtaatattgctagtaaattgtagtctttggatttgaactcagacacctcttattctagagcagaggttgttagtcacagccccaacttccagatccctctcagagcttttagtagaagagtagagggggtgagcacacccactgcagtcacacgatggatggccagcagctctttccagggtaggtggccttgagaatgatctttcagtcttatattttaaatatctattaagagtagtttcttatctcttaaaatctctaagaactcaccaacagtaagcaagatagtgccagttgttttattgaattggttgtaatcttcataaagtgactaagattattggtaatgtactcagattgtttaaggggaatatttaatttctagtgccgtgatgctattctttttttttttttttttttttttttttgtgactgagtcttgctctggcacccaggctagagtgcgatggcacgatctcagctcactgcaacctccacctcctgggttcaagtgattctcctgcctcagcctcccaagtagctgggattacaggtgcctgccactgcgcccagttaattttttatttttagtagagacagggtttcactgtggtagccaggatggtctcgaactcctgacctcatgatccacctgccttggtgtcccaacgtgctgggactacaggtgtgaaccactgtgcccagtcgatattcttttttaacccataccagtggtgacttacacctataaatttttatagcttccccattttgttcttttcactgttatttaggcagacatgatgtcaggataaatccagtgaggatgcattcctagctaaatttggagaaaaccttggtttcctgaattggctgctctgagatgccagcccttgctctgtgagaggcagtctgctttaaatttctacctggtggccgaaggtccgaatgtatttgcaggattaaagaaattatttatttaatatgcccaggctggtctccaactcctgggctcaagcaatccacccaccttggcctcccaaagttctgggataaaaggtgaagtagggttatcttaaaaaaaaaaaaaaagcaaatgtattatccctagacatgcttggttttgagtttgctgtgacagcttgatttttattctcagctttattacaatttctatgggtaaatatacttaactctaaattttggggctgcattcacccaaacggaagcccttggaataaatactggcctggtccccactgtggaggcaatcattgtttcctaagttggggagaaagccacaggatggagtggagagggcaggtaatggctacactgtacagtgtccttttagtatcagggcgccagacatgcccgtatgtaggtggccttacatgtcgattgtttttgatttattgaccatttgaaaaatatcacagcttttttctttcctggctcagaaatcaggaattgttgactaagctgttagcaagaaaagcagctttagtaaaggattgaataacaaaagccaaacagttctagaccagtcttgtgtgtgtgtttgcgtttgtgcacttgcatgcacgcatgcactcacacatgcatgtcattcttacaggtcttaaaatagagaaaagtcagccaggcgcggtggctcatgcctgtaatcctaacattttgggaggctgaggtgggcagatcacctgaggtcaggagtttgagaccagcctggccaacatggtgaaaccctgtctctactaaaaatacaaaaattaactgggcatggtggtgcgtgcctgtaattccagctacccaggaggctgaggcagaagaatcgctggaacccaggaggtggaggctgcagtgagccaagactgcaccaccgtactccagcctgggcaacagagtgagactctgtcccccaaacaacaacaacagcaaaaatagagaaaagtctgtgctaatttatatgattcattcctttactgtcatgggaaatagtgaaatgtaggacttcagcaaggttgacttttttgcaggggtggtgatgttagggatgacaagcaggagttctgggattaggagtgccagggaaatgaatttcagtccattttgcttccaaacaggatcccctccaatgcagaacctgttttttcatcattttatatctcagctccttcatgaactcaccagaccttcctatcctttgatgtggtacagagaatgtgcaaaccgatttacctgccctaatgttctctggccagattgccgcctaaacccctcagtatggaaattatgttactgccaatatggatcaccatctccctggtgtcccaaagtagaaagctccttcctcttccttcctcctccctcccttattctcagtgttcaccaagtctggttgtcccagtctcctatctctgtctgttcctctcctcatctgtctttatgttagttatggccctgaatataaaacagataaaggaagggtctggttgatgggggactggtgggtttcctctgaatgggcttgaaagagcatgggttgaaaaccactggattagatgctgattataacactgcagtaactgatgcttttataagaccacttatgacatattagatacaatttaactctcctatcttctccatattatacccattaatacagttgatgaaactgaggtcttgaaatatgaaaagtgggaggcagtatgatagagtgggtaaaacactcagcgttaagacagacttggttttaaatattggatctgccagtgactacctgggttatttgtaaagtcaaatagccttttggtctttcaacttcctcatctctttaatggattaaataataatgcacacctgatcattaatgttggatgaattatgtaagataatatatgtagaataattatttttgtgcttatacatagtaactacccagtaaatgatggctgccactgccctcgttattggattctgtagttgtcattgtacctattaagagggacaaagttgtaatgtaaaccttttgaactctttccactaattccattttatttcctttctggattttttactaaaatccagtaggctatttgtagctattgcatttactgcataatagaaaatgaccttatatgatatcctttgttgtagtgaaacccttgtggaagatgaagaagatctctatgactgtgtttatggggaagatgaaggtggagaagtctatgaggacttaatgaaggcagaggaagcacatcagcccgtaggacttttacttgtttttaaagttactctgaatattttattaggaaaggctaattaacataataatttatgtaacatctgctgggattttttttaacctttgcttgcttataactatataattatgacttgttactgcatttggagacatatgcatgacctttcagagttcaaaacaaccatagggaatcttttgtctagtcttttcatttcgctagtaaggaaacaaagtctgagagagaaatgaagtgccacccagttaaataatggcagggtggtagtagaatagaattttagggaatcatgaaattatactcttataaaagtaaatttcttacaacacaggtaaatttttccctttaaatttgatataagataaaatatatattaaagagtatttcttcacatttgttaagtgttaatatgaggtaccatttttcttttgtttcatggtaagtctcctggctttcctactcatttataaatttagtttcagatattgtcatagccaatatgagccctcaaaaccttatctgctattaatatatccagaacattcagaaaggattactttggattattttctcatttacaatttgaaacaacaacagaaaaagtcagttgcttaggttcttaataactttttcttgtatattaaagacttttctttaccagctgcttggtaatttttgtttccacagtgctttgatgaatgcgcttagctctctctatgttcctactgttaataaaaggctgatgggctgtccagtagcttctgtggaatggaaacaagttacctgcctgtgtttgaggaatataacgcaagtgtggtttaaccattgcataggctgacagcccatctgtggcagcattttcagaacatttttaggtgaccgaatatcatctgtgcctcctgtaattgttaactgcattgagtgctagtgcattcttcactgtctcccgcaagggcagtcctcactcagctgatggggtgaacagtgataataatttagatgggtaggactcttcttgcgcacttggaaaagtgctaagtgctttatactgtttatcttatttaccattccttggggttggtactgtaattctctctgtttgacagataagaaaactgagtcagagaaatttagtgattcattcacagttagaaaagctaacaacaggccgggcgcggtagctcgcgcttgtaatcccagcactctgagaggccgaggcaggcagatcatgaggtcaggagatcaagaccatcctggctaacacggtgaaacctcgtctctactaaaaaacacaaaaaattagctgggcgtggcggcgggcacctgtagtcacagctacttgggaagctgaggcaggagaatggcgtgaacccaggaggcagaggttgcagtgagccgagatcgcgccactgctgtccagcctgggcgacagagcgagactctgactcaaaaaaaaaaaaaaaaagctgacaagaaaactggtgttgaacccaattccatcagattccagaatctttgattttagtgttgtgctctatgacttccaatcttaaatacttagttaaaaagtcaagcagtaagatgttaatgttggaaaaaatatttgaaggtctttacttactttgccaaatacctttttattgtttttgcagttatttctatagtatttgttaagtgtgctgtacattaaggaaataatcatacaccatttatggtgtttccaactttatgaacattttagtaagagatattttagagtgtctacattcagaggcttattttttaatcatctaaatctttgtcattacattgttcacgatttttataaaaacagcaaagatgcctcacaaatgcagttagatgtctttcaattatgtgttgtattagaaaggaaagtttaagaaagtcagcaatgcttttgatctctacttcccgataggttaatatatgattttattaaatcattttattttgataattctaactgcagaaatgtccagaaaatgatatacgaagttgttgtctagcagaaattaagcagacagaagaaaaatatacagaaactttggagtcaatagaaaaggtaagtcatcaggtattatttttgatgcccaaatactgcctaatatagttaatatattagactcactgtttcttctgaaggtgtgtatgtgtattataatttttaggagaactttgtacttaaagatctcaaagcagatttattcattttacaactatttatggatgtcttagtacctgagtggcactgtttcagggactaaggatatagtaataaatacaacagtattctgattctcatgacactttttcccatgggaggattagaatgtaagcaaataaatatgccagatggtcataagttttctgaagaaaaataaggcaggggcataagatagagagtgatggggggggagggctggtggcattttataaagagtggtagcagaagccctctgtgacaagattaagtgggcagctaagtgaactgagggtataagccgtgtacatatgccaatgaagatcattcccgagagagcccctctgattggaaagtgttcagcatgtgcttcaagggcagcagcagtccagtgtggctggagcagaatgagggaaggggactgagcatgaggtgggagagctggtgggcttctaggccatgcaaggacattgggaagggttgtgagcagaagtgacatgatgtgatttaagtctttaacctctcattctggctcttctgaggcaagagtggtaactaagagaagaattagaagaaaattgtgttaatcgagatgacaaaaatggtggtataggtggtcagattctgagtaaattttaaacatagaaccaaccggattggatgatgaattaagtaaaggatgtgaaaaaaagagaggagtcaaggatgactgtaggttttggcatgagaaactgcatgaatggtgaagattacaggggtggggaaggacaggcttgggaatcaggagtctgttggaacaagtgaaatttgtgatacctattagactttgaatgggatttgttgagaaaggtgttaggtatatgaatcaggcattaaggggaaagactgaattgacaaatagattgggccattatcatcacacaatggcattaaggccctgggactaagtgagatcaccctagtgaatgcatgttagggaagaggtttgaggccagctctccagactctcacatttagaggttagggaaagaagtgaaagtatgcaagcattatttagaagagtagaagagtagattgactagggaactgtagtagcactatgtagcgttacaggcccagttgagttttgtggtcatattgaaaattagacgatcggtaatgtccatgcttaacttcttagatagagtcacaaaatatgtggcaagttagacttgatcagggtgtttgtttttctagaaaagcacaatggaagaagagaaggtaaggggatttacagggaagtgattcatggagtataaactcggttaggagggaaatgaggatatgatggaggtgggatggttagtggactggctgacccaattccttgaaattagtgctatgaagcatatgaagttgttgataatgacaaggtctgtgagtatggccataagatttaggagttgagctagagtggagcacaagattatttgtggtcaaggaactgagagaccagtactagaaggatcctctgcacagatactgagaatgccgagaatgaaagagatatggtaggccagaaactaaaattctcaaggaataattcataaattgcatacatagattattgatctcagggatctagaatctccacaaaacatttgggagatattactgtgtaagtcttcatatacatctccaaaatgttgccattttttggcaactcagacaataatgttcttttcttccttccttttggaagcatttattgtctaaaccattttattttatactttaaatgtattaatattagctcgtatttatgtttttatatatctattcaagtgtaaagtctttaagttagagaaaatagtttctacaattttggtgtttataatgctgatcaacaattgactttcaaaacgtatttgttgtttgttgatgaaaaactattatatagattaggacaagttatacttaattactattttcttcttctttcctggtagtatttcatggcaccactaaaaagatttctgacagcagcagaatttgattcagtattcatcaacattcctgtgagtaaaaatatgctagctaaaattgtggtgtacttcaataaaatcttcatttccttagggggttccagatccctattttaatactcttttgtattatttaagaatattggccttatttatttattttttgcttttccagtttttatatccttattttcttgaaataactgatgtatcatatcttcaaccaaaagtcagtcaacatgtacgaagaacacaaatggaaaaataactttcatgtgttattcttaactctttgtcatgaagaggtagtctcaaataatctggggatccacttccatccccacacttccctgcggagctctgttgctcttccagaccctcagaccttgtcttgtaggtgatgtcctcaccatatcagtttcccctactttcctccattcctccacatctttgacttctactatttggtgctttctacttccagttgtatcatatgtaactcccatttatgaaataccctacttccttatgatttaccagactattttaattgtaaaatttgaggagatatttttcgtttacatttatgtaagcatttcaagtttcagggcaccttaccagaatcttacaatcttaaaaggatatttgcccagaaatctagaagcaagctaaatgtcatgccaagtgaggtaatgctaggcaagattcaagttctcagacctctaggacttgctttggtttatacatccccacccccatgcacgcatgtacacatacactgataaatgtatataagcttttattcacagacctgcttgtattacctgaacagttctttgtgttttgattctattgtgttctgtgttgctgagtagcagttggtaagcaatggcatgtcatccttgtccctgattttggccgaatgaggacattcttgttgatttataacatgcacaatatcagctgaaggtttagcactaaataaactgcacatttggggaagataaggatcttgaaccacttaagtatggtctttataacttagagcccacatcttcatgtttactttctacaccactaaggagagagcatgctgtggagtcaatgtgtgctccaaggtacacaggatgagataatgggagaattggcacctagttcaagttgcctcatatcctggctatgacatgtatttactgcctgactgaaaattagttgcttatcgggaaaaatgtgaaattctgacattttgagttgctctggtaaactgtcgaatacaatttatttgctccttatttatgccattagttgcctgatttcaagtaatttagtctgattattgttagcttagcaccaggacaccactaattgaccaaagtacaaatttacatgtttgtgtcacaaggacatgagtcattattttatcctgtcaataaaacattaggcacttggacagttttatttaaaaaatttacagtgattataaaacaaaaataagctatacatatttttacacaaggaataaattatcctttaataactagtgagataatttcttttttcacaggatgctgacatttcaactgagatctgaaattgctgtttcccatctgcatggcctgtctccttctcttctcctccctctcctctgccttccccttatcttccttcttttttctcctttccttcccctgctctccctcctcctcttctaccctgtcctctcccgctgcttcctccccttcctccccctttctctccccactctccttttccctctctctttattggtggaagcagttttatatattgagagcattcagcatatcctgagtggcaagtctagcaactaaaaggattctgggtttggggtgtattttttggttgttattcctactttcctttcacattgttttcttttcttaggaacttgtaaaacttcatcggaacctaatgcaagagattcatgattccattgtaaataaaaatgaccagaacttgtaccaagtttttattaactacaaggaaaggtaacttttgaagtttaagttttgtgggtcttagcttgtaattatagtgaggattagtattaaaatagctaacaaatagctattactgctgtttattacattactacctgagcagtaattagaacgtgggacaattactttcagagtagtagtttgagttctatatatgtaattaaaaaagaaaaaaagaagaagaagaaggaggagggggaaggacccagtatggtgcttatttttttgcatcgcaaatcaaaaggctaagtttcttttacaggctttatcattactgagcgatgtaatcttcagtaagtcattttaactctctgagcctctgtgtccccatctgtaaacaccggaggtagattagctggtacttaatgcttcttccacttttcttccaattctggtattttatgacactctattttggagtattagattcgcagagtcagtttccctttctaagttaaaaaaaaatctcctgacaacctataggaattggagtatcaagaaattttgcttaaaatataattatctctcttttcaaatcaagcaacgtatttcctagtactaagaagtggctaatgaattactttgcatcaagtcttcgataaatattcacattttattagtagtgtcttttttccagtggagagttaagagaagcaataaaccaactgacctctttgcaaaatatttgtgctacagagataccttccctgaagtgggtcagattccatgtgatatgagttatcttctgtccagaacagttcaggtctctcgttttcctctcttcagatgatttatgttccttaattaaaaagtagcaaggagtaagaggtttaataatgaaggagttatatgtagtgattggcataaaattgtaatagagaaaactttctgagtgtttagagacaaagtttatctcttgtaagagctttaacagaaatttttaattttgtttttggaatgcatttatgtctactcaaataacattaacagtcatcaagccagtttgtaaattctgcctgctataaaaatttacatagaattaatctcattcaaagttggaactacaaattagtcattactataaaaatgagtgacccttattctatgactgtgtatgtggtatgtattaaaaataatttctactgctattttggttatccctaacaatggttttaaagagatgaagattctgcttgtttccccctccagttcattcttggtttttgtcttagagatttcttgtcttttttccctttcagattggttatttacgggcagtactgcagtggagtggagtcagccatctctagtttagactacatttctaagacaaaagaagatgtcaaactgaaattagaggtgcctatttatttttagtttatgacataaagcaaaataaacctaaaagcaatgtgttcctctttatgatcagtgaagcagtacatttcccattattttaaatataatttcatgtcaattttataaaatatttaaacagctctataaaatagtaatatggtagtaatagtaacagtcgttaaaaatctaacatttatggccctgtgttttacatgcattatctcattaggtccttctgactctgtgaaataggtacaattaattttctcatcttatgagaaagctgaagttcagagagattatgaataacttgcgtagatagtaagaagtgcaggacgagtgagatacgttagataatgtatatgtagatttaaaatgtttactagttagctgggcagggtggctcatgcctgtagttctagctacctgagaagttgaggccaaggagtatgcacttgagcccgagagtttgaagctgcagtgagctatggttgcaccattgcactccagccagggtggcaaagcaagaccctgtatcaaaaacaaaataaaaaagatgtttactaaaaatatgacatttagaatcagatgtattaaaaggccatgcatattgcccacaggaaggaagagaagacgaacacaaatatggtaggattaaataacatgtgataagcactgtataatagggctctgtaagactgaatctacccacttcagtgtgggtagattgtagaggattcatctgaagaggcgcatttgagttaggtcaccaaagaatgggatgagctttgacagatgagattctatggagagcattcctgaacaattggtatgtattgaccagaacagttgggaaagtttgagaggtggcacgtaggccgatataaacagagtgcatgatcacaacagtatataagtctagaaacctaggttaagtcgtgtttttttgtacatcatgtttttttttttgttttgttttttgttttttgtttttttttttcctgaagaggagttcgaggacttcatgctttcaaagaacttttgaacaatgtttgttgtatcagtcactgtattatccatgtattttgaattttattaaatttcaggtagagatatatagccagctcttaaatttaacagcgtgtggcttatttgcctgtttaatatcccttttccttttctttgttcagtgtagcactgaggtcaggggagaaggggcaggtgattttcaaatcagaagcccttcactgttttgcctctctggcatgatttcatagctcacaactcccacaaagggaaactattgcttagacagtttgcacgttaacaggccaccaagtaactgtactagatacgtgatctttttgctttatatcttaatattccttcattatgttgactttaagactggaggtagtttgagtcacccctaaataacatccttgtaacattgttagtgcaaagacttcctgctcctctttgcagaatagagcctcctaagtgtagagctgggagccactgtgactcaaaatatgatgataaaattaaattttacaacttatacacctacttcctagtagggcaacattaaagcagtttttcttaaaataaagatataaaattgtgctcccagatagtagtcagcaagttgtcaatcacacctccattatattctcagtcttgtttgagtgttgttcttccttctttcagagttattgtcaaagttttgcccaatgaccatactctgggactctaagtatgtagtttttgcagtcaatgctcgacttagggaaagagaggacatcaggctgagtttgaaaggcacagggtgaggtgcccctgctgtcctttcttcagcttaaaagcccacacttctaaccatagtcctgatttggaagtattaagtcggatacttagtgtaacacttcaacaaatactcagtgggagctgcgtgccgcaagccccagcatgatagaaggaaaactaccttattcttggtgtctttctgccttctttgtgtcttctgttttgtggttatttttgttcttgttgagttttttgtctttttcttctctactttggaaccaagataacatggggtgaagggcgatgaatctctttatcttgccctatcagcctggctcatcctacctcattttattttccattacaattgaattgaggctaagcaagtgactggatgttttggaaggattctttctacccattatttactttcaacacgaataagcattttacatttgagtctctatctcccaggtgtagctaattccagcaatgttggtttctttacttcctgagcctgtaacttagaatgtaaaggaactgactttttttcttcaacattttgaaactaatttccataatatagtgaattttaaatatataatatttctgttcctaccactgtgttgggatggcataacataagaaatataagctacaaccttaattccaagggccttaaaatgcagcagaggagataagacctactaattatagtaatattaacaatgtaactttctgtttgagacccatgatccagagctctctacaatctgtagaagtaagaaactggttgaaatagttatccttctaatgaactgcagtaattgatgacacagctagcatgtcaggatgtgtccccaattcattttgactgatagctgtagacagacatactcattaagtcacggatcattagagttaatggtgtttttttggagctcctcataatatatcattccatgtgccagaaaaactaagtgtgggcaaagaagaaacaaacttgtgagcaacagtgtattttcttaagcacaactccgtctatgaactggaaaggtccttgtgctgggatgtgcaattgtgtcaggattttggacttatgaggttgctcactaataataatatttgtatggccctttttttttttttttttgaagaacaccatagttacgtgagaaacagtaaaatcagaaaagtgacttgtccaaggtcacaccgccaacagttgccaaatcttggctttaagttcattctttgacacttcaaagtaatttactcaaagtcataattattatcaaaagaacaaaccagtcaatactattttaaaataaacctttaggaaagaagagggtgaaattaaatacaatccaaggcttctaaatcttggagtttagtagtaggtttatacttgagcaaagttttaaagtcaaatattccatttcattcagttcagtaaatacttattaagcaaatactacattcttaggggcatacagcacaaatcatattggagtagatattacatatgataataattaaaagacccacaagacagagagagagtacacccaattgtgattgtaattgttacgaaaggcctaggattgtagttcttaaacaggaagatgtattttgctggaggctggacaaagcacatcatagttgagggaactgaataaaccatagttgagggtgggaagactattgacacttttgatgagtagggatgtgttcttgatgcctgttctataagtccactgggggaaattggtgggaagtacagcgataaagataaactgaagaagaccctggggggccatgattttgcactagagaaaataattttctttttcttttttctttttttttttttttttgagacggagtctcactctgtcacccaggctggagtgcagtgacaccatctcagctcactgcaagctccgcctcccgggttcactccattctcctgcctcagccttctgagtagctgggactacaggcacctgccaccatgaccggctaattttgtttttgtattttcagtagagatggggtttcaccatgttagccaggatggtcttgatctcctgaccttgtgatctgcccgcctcggcctcccaaagtgctgggattacaggcgtgagccaccgcgcccggccaagaaaataattttcatacacaaaatagttctcttttattcatgtttagagttaaagtactacaagatttgtttttttaaattgaagatactttctgttatttacagagaaggattgttaaggaaacaaacgcactcatttattgtataataactgttctgcctagggcctttgcatcttttaatgtttatgactccctaacaaagtgtttttaaaacatttcattaggaatgttccaaaagagcaaataatgggaaatttactcttcgagacttgcttgtggttcctatgcaacgtgttttaaagtaccaccttctcctccaggtatgtaacttaaaacagtttatttattgtccatttattcactcaacaaaatattaatgaagcatcaactacattgcagatattccatgtgttgggcccaatccccttaaaattttgaattattattatagttaagtgggaaataacagaacagctggacattttttcttccttttagcagagatggtcagtagctgccataaatcacattttgtgtccttaaaacaggactgcctagaaaataattaaaaacaagtcaaaacaaataaaaatattttttcaaccaagtcttctgtagttatcagtatttatttatgagcacctcaatattgcagtgcacttgaattttggcagattaatcatattagacctcttcccttgtaacagtaagccaaagagaattgtgtgacattccatattgctttctactatactaaattataataagactacatttattttgaagtgattcttgttatagcccacaaagctatggtttccacggttagtcttctaaatgagggtggagagtcttataaatttaatttgatagctataccaggagactcattagttctgctccaaagaaatgtcttagtgtattagtctgtcaactctgctgatgcttgtgaaatgtcattttaaaaagatctactacctgtatgtgaaatacaattttgcgtcggctgtgctttgtatatcttgtatattaaatttcttgaactgtagctgcaaaattattagtcatctctatttttgttctactgagaaatcagaaaaattcaaaccctgattattccttaaaaatgcattaaaacatttatgagacctaaactcaaagcaacttagtcaaattggattttatgaaaaaataataaggacgactcaggcaatcagtttccaaggcatcctggaactaaatacatgtccaaaataaggtaataatttattttgtaactttggtgtagtcaagtatcgattgaagaatttagaaggtacagctttttaaaaaaatacctattttggtccttacagggttttacacagacttataaaagtataaaatacaactatacttttttgaaatttagtaaactgttccccctaatttcccttgggttgttttatatttaaaattttaagagtatgtttagttccatgatgactttttaaaatagggaaagttttatttggatactacacataggtaaaaattctagaaatgtttttccctctcaaaattctatggagtaaaatttatttgttgtctagaaatttgttgaacaaatgtggttatcagtttagacttttttacttactactatactttagtggcgaaatcacttgaaatgcttgatgatttgaaaccacagattcacaaagtgagaatattttatagtgggtgattgggaactttaataacatgacttttatttaatgaagtaaaagtaacttttaaggaataaaagaatagaatttttatggatttattatacttaatagattctgtctttaagttcttgtttatagcagaaacactggtagtattggattcattaaagatttttgtatggcttctctgtgccaaacatagtattaggcactcgtgatatacgacagaccctactcggataaagctcataatttagaaaggaaaaatgaagtataagctgccaagtataacacaatatgataggtacatgtaaggtacagaaccagcacagttaaaggcctaaataattatgtatagggaagctggggacctgagtagaggcctctgtcatagaagactccccagaggagtaactcttgagttgggctttaaaggaagagtaaggggtcaataagtagatcagaggggaagagctttgtaagcagaaaaaataatatttctaatgggattagatattagaacataatttaagaattgcaattaatttagtatgaatagaatataagttgtctgggtgaaagtggagggagaaattgagagaagtttgcagaattcagatcatgaggagtctaggaggtatgggtgacaacctgaagcttttgtggggcatcacagaagtctgagtagggtagagacaggatctgatttatattatagaaacctacccctgatgacaatagagtgactggactgtagtgaggagagactgcaagtcagaaggccgatcagaagctcattatgattacctggttttgttgttttttgttttaagagagggtctttctctgttgcccaagctagagtgcaatggtgtagtcatggctcactgcagttgggctcaagctgtcttcctgccttagcctcccaagtagctgagactacaggctcatgccaccttgcccagctaatttttaatttttttttgtagagatggggtcttgtcatgttgcccaggctgatctcaaattcctggactcaagtgatcctcccatctcagcctggaaatgtgctgggattacaggtgtgagtcaccatgcttggcaaataattatctgtttgaaaaacgtgaggatctgaacctaattagtggcaatgaggatggttccaagggggcaggatcaaagttaacatcaataggacatagtgagggagagagaacagggagaagtctgggacaccttttaggttttggcttaagtgatgacactgatggaagtgccatcattcaataaaacagaaataggatccaagaataggattctgggtgaagattgattaagtttggggaatgttggatttgaggggactttgaaataatgaggtagaaccatttagttggacggatgagtccgggactcgtgtgaattttgggttgagcacatacatttcacagtaattggcccatgaggtgatagttgacattatgacagtggttgtgatagaatttgtagagtatgtaaaatcaggggaaaaaagaggactagggtgaaaacttaaggaacaataactttctaagaagcagataaagaagaaactatgaaagactgaggaggaggcagaaatttaggatggacagatgaacaattttaacagcaataacaacaacaaatagaacatcctgatgtccctgaaatgaaaggagggatgcagttaaaagaatcaaaagctgaagccaagaataataaatgagtaaaaagtgtgattttaatcattatggaatctttcataacaatagggatcaatgtcagtgtaatggtggtggatagaattcagattcatctttgaaaagaaaatatctcatattgtgtctcatgattttttggtgtctagttggtcttcttacagtttgaaatttttgatggaaatggagcccagacatattagatttatcacattatagagagaaaaccaataataatggtttatttgtaaaaatgttttctttagtatgtcttagttttaatttgatgaaagtagtactaaaccatatcttccaaataggaactggtcaaacataccactgatccgactgagaaggcaaatctgaaactggctcttgatgccatgaaggtagggcagattcatcagtaatttgtttgtattttttattcttgcctaaagacaatggaattcaaattgcatacacacacacacacacacacacacacacacacacatatacacacatatatatacacaaacatatatatatacacataaataaaatattatgacatgcctatgtataatacacatttgtttttagtggagaaaactggatttttttttttttactggaatagttatccttgcatggatttaattgttagacaacgcataaaactaagaagtatattaaaatcacttagatacaagtataaaaactttcataaccatggggaattatttaatatcatatttttttcccattcttttcatggtgactaatagaaaacgttggcttgtgtaagtcgtaggccagctggtggcttcagaaccccatgtaacttattttcctcatatgaggatatctgctaggtttacccttgtggatgctatggcttcatacaagtgaatttcagtttgttcagttttcaggaaaatacgaaaattatgaatagaaaagacagacattttgaacatactggggaatatgtaaaacctcagtttccacattatgttaaataaaaatgactttgaaacgaaataatatttgccaataacttaaagcgtaggcaaatatttgttctttaaaacaaaatggcaaggtgaccctgctcagagcagtgcataattacttaactgtgtccttgtaccaattcgtgttagcttcgctgtttggctgattgtctaccactaacaggaaacaccacataattatttattattattattaaaaagtcaaaccaagttccaaattttaaagaagtcgtttatggatctatcctatgaaaagtcagacttccatttagaacaaagttaggaactgctttttgcagagttctgtccctactgttgcagatgaatttaagagggtagagaaaaaagaaaaagagctcagaaaacaggaaaatctggagcacatgtaacaaaaatagctagttacagtatggaaagattagctaatgtttcctcaaatatgagaaaagacattttaaaataggtgaaggcacatggaaagacacggccagcattttatgttcactttaattcatgaattaaatttagttccagcatgttgtgctatttagttcctcacctctcctttacttctcctgaatccataaacgggttaactctttaaaattgaaccggtttccttgaccgaatgctctcaggaaccaagaagactagccgattgcaaaaataaaacagtcttgctagattcattatctaacttttggttacttttctcatgctaatcgttcatgattgcccttcttctaacctgtgtaaaaatatcatgctctcaaggtcagtaattaacgtgcttggaatttctattcttccgacctagttttctttttgttgctctattgtggtatattttgttttgtcttttaaggcaacaacatcctgactcttctcagtggtgtgacaaatgacagctcttcagtcttcccagctgtacttcagacattttaaaattgcctctgtgatgcagctttgattgactgggcattcattttactgtctttgaaaagttacagtggttacttttaccactaatggaattaatgatgtgttttctttcaaagcagtttgcatctctaatcttagtgtgccttctttttctacccttttctttattgtctaggacttggcacaatatgtgaatgaagtgaaaagagataatgagacccttcgtgaaattaaacagtttcagctatctatagagaatttggtatgtaattatctttccatccagcttcccctcacccccacatcaacgacattctaggagttgttgttgaagaaaacatagtttaccttcaagtttctactgttggaggttgttgccagtccctttgtttggcagtgttcatgtgggtgtctgagggcacctgcaacctgcttgtgtctagggactttgtgatggcttgtccctcttaccttagtcacactctgcctcttctcccagcagtctgaatctaaatataggagtccactttttttttcttttctttccctcatccccctacatactcatggctgattcctattcatttattcattttacatatatttgctgtgtgactattatgacccagacactttgcttggggctgggactgtaactgtgaacaagatggtctcaagattgaggagacagtttaaaaaaaaaagagttaaaaatgccatattgagattagtgctgtgaactggctgctataactgaggattacaaggggagtcctagtttagataagttggttggaaaaagtccttttaagtcatttgaactgagacctagcagataagaagcagccagccacacgaagatctaggggaaagtgacccaggcagaagccgtagcaggtgaaatgctcagagttgggcaagaaccaggtgtattcaagaagctgaaaggtaagagtggctggaaatggagagtgaagggaaggatggtgggctctgagccatgaggaatgggcagggcaattacataacacagccttgtaggccaatatgctgaattgggattttattgtgactgcagtgggaagctattaaaaggtttctatcagggagtattacaacagactgattgacatttcaagaagaccctgtgagcaggcagcccagccagcaagctgttgaagtggtttcaagagaggatgcagccctggattaatctgtgggcagtgcaaatagagatgagtgaatttaagatacatttttggtagagcagtttcatcgctgctttctctgaaacattgtgaacctgtctctttcttttcacacatgcagccacatacccatttcaggacaccatcatctgccagttttccagtcacagtagcctctcatcatctcttcatatagttgcatttccaaaatgtggatttctcaatttactctctttctcaaatttgtcaagatttttttgttgttgtcttcaagattcagtcaatattccttggcatgatatttaaggtcctcagtgatctggacttaagctattttcctgaacccctccagctaataactgcccgtaaactttacattgtggatattttgctgtattacaaggtctccaatttgacatacgtttctacagttctgccttcaattgtaatctcagagcctagaatgtttttttcctattccctatcaaatttattcaaggtgcatctaaaataaatcccttttcctaatctcctattatttttcctctttagaattccatagcatatttcttggacagctgtgtagcctttaaaaaattgtggtaaaatatatatagcattggccgggtgtggtggctcacacatgtaatcccagcactttgggaggccgaggcgggcagatcacctgaggtcaggagtttaagaccagactgaccaacatggtgaaaccccgtgtctactaaaaatacaaaaactagccaggcatggtggcacgtgcctgtagtcccagctactggggaggctgaggcaggagaattgcttgaacccaggaggcggaggctgcagtgaaccgagatcatgccactgcactgcagcctaggcaacagagcgagactctgactctgtctcaaaaaaaaaagtgtgtgtgtgtatatatatatatatatatatacgtatatatatatatgtgtgtatatatatgtgtgtatatatatacacacacacatacatacacacacacattaatgctataaatatatatagcattaatttgccattctaattattttcaaattagaagtgcattcatgatgttgtgtgaccgtctccaaaacttcatcttgcaaaactgaaactctgtactcattaaacatgaacttcccattcttctctttccctggcccctggaaactaccaatctactttctatctctgtaagcttaactactctgggcaccttatataagtgaaatcatacaatatttgccatttcatgactggctttttttacttagcataatgtcttcaaagttcatccttgtagtagtcatgtgtcaacattttatttttttgatttccatttgtttaaagctgaataatacatcattttatataaatacctcactgtttttcattgatgaacatttgggttgcttccttctttcagctattgtgaataatactgttatattattattgtcacaggtgtaccaatatctattcaagtgcctgctttcacttcttttagttatatacttggaagtggaattctgggttgtatggtcattatgttaatttattgaagaattgctataccattttccacagcagctgccccacttaactttcctactaccaatgcacaagggtttcagtttttccacatccttaccaacactcactattcggtttgtttgggtaacagccatcttaatggttttaaagcaatatctcatcgtgggtttgatttgcattttcttaatgactaatgatgttgaatattgtctttgtgtgtttgctggccatttgtatattctctttggaaaaatgcctattcaaatgctttgcccatttttgaatcaagttgttttttgtctttgtgttgtagaagctctttatttgtatcccagatatcaatcccttataagacatatggtttgcaaatacttttcttgtgtctgttggcttttcactctgttgatattgtctgtgaggcacaaaagtttttaattttgacaaagtcccatttatcaatctcgaagaaataattgctgaatctattgtcataaagtttttccccattttcttgtaaaagttttatagttttaactgttatgtttgggtatttgaaacatttttagttattctttatttatggtgtaaggtaatgaagggtctacctttattcttttacatgtggatatccagttttcccagcaccatttgttgaaaaggctattctttccctatttaatggtgttaaccttgttggaaatcatttgaccatatatgtgaggacttatttctgggctctctactattctgttggtctatatacctgtttgtatgccagtgccgcatgattttgattattgtggctttgcaataagttttggaaacaagtcagtaagtatgagacttccagctttgttccttttcaagattgttttgactattcagaatcccttgagattccataagaattttagaatggaattttctatttgtgcagaaaacatcactgggattttgataagatacatttatttttatatttatagtgttaatcacacatctctgccctttattaaaatggaatttctgaacgttagtgattttcagtcaattcttttttcctctagcgtgtacagtaagtgttcataaacacttaaaaataatttagttatcagcctctgggaaaatagctcattattttaaataattaactcagagcttttcgtccttgaggtcctagctcaagaaagccagcctggactttatagaccaaattagcgcgcgcccccccgcccctttctgtactccttcatggcaattgtgcgtttgtaattgcatgcttctgtgaatatttgttcctccactgcgcagtgtgcttcatgagggcagtgtctgtatcattttgccgtacacctgttatggtggttggcacgtagtagatgctcaaaaaatattaattgccgaaccgtctcgtaatttggacccttccggttgagtctttcttttcatagctaatttcccctttaagaatatatactaattaaaatcaattgatgtccttgacataccccctgggattacagaggacagacttatttgtcatgtagacctgagctttttagagtaagtatgctttaaaagtataaaaaatggtaacattttaatgtaataaggtagttgtcttgagtaaatatctctactaatatttgtttttattttcatgtgattatgaaaaactctgacatgtgcattttatattttagaaccaaccagttttgctttttggacgacctcagggagatggtgaaattcgaataaccactctagacaagcataccaaacaagaaaggtaagaaaagaagaatactattttcaaaataagtaattagtgtcagaaaactgagaaaaccttaaagacaatttttccagtgtgaagtagggggaaaaaaggaagaaatacaaggagacagaccaacccatgatttctaaattttttaaatctagattatcttaggtattcccacctgggttctggtatctattagtttgtctaagttattaagaaggaagtaacaagtatagatgatcagctaggatacattaaaatgagaagagcgataaagtaagaacagataactaccataaaaacataattgaatttttggaatatatttttaaataaccaaaaataatagaaaaatgccctaagaaagaagattaagtgagaatcacgtagtaatattttcttgagggaaatttgcagatgtagttcttgaagattagtaagcttggcccggagtccttaattatgtatatatgtaatcatcaaacagaggtttttgtggttgacaatgattgttttctggaatctttggagaagcgaaagccagtagggggcagcatcagctcttgcttcttcctcgataaccctggctccataggtcctttaaacctctctgggagaaatagacgttaaaagtgatgcaagtgttacagccctgtgaatgtgtcattatcattgtgtataaaaaaaatgtgtgttaatcactgagagtttataaaaatacacaagtattggtattggatgatgtggttataaggtttattttctcccccaagttacgttgttcttaataagaaaaaagaaatattaacatggaaatttcaccataacgttttcagtttacacttggctcatataccattcagtttgggtttttaggtggccaattaaatcatgaggaacaatatagagggtaaaagcacagtttccaaaattagacctgtttgtgaatcctgttacatgcctcactagcagtgtgatcttgagcaaattatctaacttctctaagcctcagtttcctcctcaataaaatgaagatggcaatgataccttcccagcatgtggtcttggggatttaaattgagtcatgtttgtgaaagggatgaacacttctcaaggcattctggctgattcctagtaacttcagtagaagctgctacggatgtcattaatattattctataggtttttagcttttaaattaaaaaagataattgctcatgaacaaactttatggcttatctcacttggccctttcaacaactctgcagtgtgcattttactcttactatgatttttgcccatttttaaaatgagggaaccaaagcacactgaggccatttacaaggtaaagggaaattccacacacagttcttataacctcaaataccccgttgttttcagtgtatgatactacctgttgtctttaatgcaaagaaaaaaacatttggttgctttatacccaaaaaaattaataacccatgtttctaaaccatttaaaatcaatcaatcaatctctttttcccaggcatatcttcttatttgatttggcagtgatcgtatgtaagagaaaaggtgataactatgaaatgaaggaaataatagatcttcagcagtacaagatagccaataatcctacaaccgataaagaaaacaaaaaggtgactttttggaaactaataactgtaatttacttataatcttgaacattaaggaaaagtatgataatacattaatgtgagatatggcttatcaatccagatgtttttgtttctagagattgattaggtacataactttgtgagaaataactggataatgccacagccagatctgatcatttctaatgccctaatgatccagataataaaacgcatttggcatagaaattgttatagatatgaagttgactacaataagcttgattgttcagtttgtacattgataatattgtgaggagtttttggatagttgtggtattcttgtgaatttagaaacatgttattaatgatacatattaatctaaggaatattaattttaacagtggtcttatggcttctacctcatccatacccaaggacaaaatgggttagaattttattgcaaaacaaaagatttaaagaagaaatggctagaacagtttgaaatggctttgtgagtatttctatttttaaaagtgcttttatttttactagttaaatcacttatgaataatgaacaaccaataagtgtactctaatgcttgtagcatgtataatgtgtacagcgacgggaatgtttttgctgtgagcaggagtgctactaggctgctggctgcttgataactttggtctcctaggagaggagttttgttgaattccttcaaaaagaagaaagagggagctctaatcttctgtttgactttcttataggcatgttttagttctttagctctcagcagcccaagaaaatattaattattctaatgataaactttttatgtaataactatatttttaaattatatacctttaaatagaaatgcctccaagtgtacatacacaaacagatatgtaaatgcatatatcttatttttaatagaaagattgaattattctgttttaactcgcttatttgaatcttggctaaaatgcttcgtgtatttaaggaatgctttaagggcttgatttctttaagtggcttttagttccactgaggaggaagctcaacaaagaggtagaaaataaatcaaccctgtttcaaaaggaatggcattctgagacgtaataaccaagaacaggtcattataggtgtttctttttagttttgatgtttaaggattgaaaggtacacaatgaccctttttgtagaaatatataggataccctgaaataaaactgttagcaaaaggggaaattaaggaaaactacatttggaatttgtttcatttgggttctaagattatataccatttgttgacaaattctgtcagttttttttctttgttttaagaaatgctcatgttaatgtaaactagaggtaggaataggatgttttattgtggttctgaaattaggaaaataaagattctcaaggttattttatctaacattttaagagacaggattctatagccaaactatttacgcttataaagattatttaccagttgttgacaaattctatcaattttttttccttgttttaagaaatgctcgtgttaatgtaaactagaggtgggagtaggatgttttattgtggttctgaaattaggaaaataaagattctcaggattattttatctaatattttgaagacaggattatatagccaaaatatttaagcttatagtcaattctgggttcatctattatcactgccatgaactggctgcataatgaaagctaagttatttaacctctcacagcctcagtttcctcatctgtaaaataggaatgatatttatttcaaattctaggtaatatgtatcagcagagagctagccaaatagtacaatagcagctacagctatgtgatattgaacaataggtgatacctattattattgctattattattaataataattgcatttgggattctagtatacttacaagacttataaaactacataacatattctagtatactattttttctttttaggaagtcacttggagttaaacaatttgaattggagtgataggatgattgggttagtggtaatatgcaaagacagagctgatctcgagcctttgctcttatatgctaggcttttttttttatgggtttcgtttggctatataatcttcagatgagtgaaggaatgtctgcagagaaggaaattgaatttcatgtcctagagcaggcaggttccttggactgtatgacaggcatgtcagttactattttgttcagttgccataaaacaaacagttaatttgtggatatgagagacttgatggccaggtgtgatggttcatgcctgtaatcccagcactttgggaggctgaggtgggcaattcacctgaggtcaggagttcgagatcagcctggccaacatagtgataccccatctctactagaaatacaaaaattagccgggtgtggtggcacatgcctgtcgtcccagctactcgcaagactgaagcaggagaattgtttgaacctgagaggcggaggttgcagtgagctgagattgtgccactgcactccagcctgggtactagactgagactccgtcttgaaaaaaaaaaaaaagagatttgacaagataaatactattgtcagcatttgacttctctccttaagagtggttaccttgtagtctgagatagctgctagagctctaggtataaaatttatgttctaggtagcagaaagtaatcccacttttatggattccttgtagaaataccactcgcttctgttacataatactgaccaacgtatagtcatgtggccgcacctgccgagggaggctggcaaataaaacctttattctaggtaggattcttcctggctaagaattaaggttcttttactatggaagaagggaggaatgggtagttgtaggcaaccagcagccaccgccttacaggtttatacatataggggtatgtacggatttaaattgttccaccacaataaggatggctgcagcacatgcacagaacctgggtttcttaatctttgattgttttccaagcatctcagcaataaaataacacaccagtagaagtagtttttgttgttttagagttccgttgaatgtctatgcagatattgggagggtagaagtatctttttggagaattgctcagagttgaagttgagggcttctataaataagggttatattatatatggttaaataaaatctgagcaggcatcagaatattccattgttttatttccttcttctttgaagttcatcatgtaggaaagccctgataatgtctgcttccagctttgtaagacaggttttgcctgtctgatgctcataaaaatagaataatataggtaaatcctgaagtttgattttgcctatggttcaaattttgctgcttatccattattaaatctgtagtactcctttttgataagtcatggagaataaaagaaaataactcctgcagcatccatgacaatgcatgaagaacagcaagccttgtgtatctccacaggatggcttcttcccagtgtctttagtatcaacacgagtcccttgagttcccctagagtgctctggactattgctttaaggaattctgaaaaggaaagggaggcattggtgagagggtggagggaaatcaagggagctgatatttttaagagtgttgaaatgcttgccatttctatttacagaagatggcaattctgtttataggatgattggatcatttttatttaaaattattgcaaatcactgttaaggcacttaaaatactatgttaagcctctaaattagggctcttaatttagaacattaaataaggccatggaaaagcatgaacactaatgaacagtaagtatctggtgaacataaatattctccccagaggtgacctaaatctcagcctctgtctctcgcagtcatgttctctgaccttctttggccataaccacttccagcatttaaaatatgcagtgaaccacattagaacctgacagacctccataggaaaggctgaacaaagagaaaagtagcagtgacccacttggatacggcaggaggattcccccccgcttttttttttgtgataagtggtagcaggactgatatgttcttgaggttgttggaaaagttattgagccaaatagaccaaatagagtgcaagggctgtagttctggggggcataatgtaaataatgtatttaaatctttaagaggctgatcgatatgcattgcttacttttatttattccaaaagggttttattttttttttgtcactaactgtctctcacaattccatttagtcatatgtgaaacaggacggcaaatggttttattgggttaaactggttttcataatcatgctggaaaatatggatataactgcctatagcaatgttcaaaattttgttaagaagctatggatatgttttccccaaatccaatatatccattgtgcttttatgaatttttctatgagatttaaattaataaaccttgtcatacccgttttgtagctcaggaaactagcagtcacaggagcatttgagcaaatgtgtacaagtttgatgctgtatcatttacagtacagttgaggatctcagttcacaggagtttctttatccataagggtgctaaagtaagcaactggactcagatcttggcatctaaaactggagtccaggttttttgtgttttttgtttttgttttctcactgtgaataggatctagcaatcagacagttttcttaaatgtcccaggaataagttaaacctgagtaaaaaataaagaagtataattgtatttaagttggtgcaaaaataattggggctttgccattacttttaatggcaaaaaatgtttgtttgtttttttaaaaaaagaaaagttagcaaaagaaaaggtaaaataagaggcataccataagcatcacatgtggtagaaacaggtagattcagaattagccttcatagtgttttttgaagggaaatgaaaggtcctcttgcctagaatttcttctgaccgaccttggcccagtttttgaaattctaacaattctcatttacccccttgaatgaagaaagactctttgagatgcatatgccatcactactgtgaatatctaagatttctcgactgtgtaataagtgcctggcacagttctacatggcttacctaagggaaaatagcatagaggtcaggcctgtctactgaaatattagcccaggatgtttatcttttaaacacaaggactaatggtagtgggacgaagagaatgagaatgggggatggagattctagagctctggagggactctgggaccaggatgcactatcctgttggtcatccggagcggcagcccctgcctgagctttgcatttcccagaatgagccctgagaggaccttcactgttgggatggagcagggagtgagaatgtagccgttaagctccacaaatcacatttaatctgaggcacagtgtttctttctaatttattccccatctacttccagaaggaatttgaagtcactcacaataaaaagcacacatgctgcagaattaaaaagaaaaatttaaataatccgaggtcaaatagaacagtgtttccaagtattatcttcaaactcaggctccactagacaagaatattttcttgaagtttactttctgtagtttatatgataaaaacaaaaagcatgtttctcacatttcaaatctagagttatatttcatcaaacataatttgttttaatctaaagatattgctcagatattttgaataccagagagagaattaccagaggaaattttattcattctgcaaatatttatcgtgcacttgccttgttgccagacactgttggaagccctgggcaaataacaatgagggagccattgcaattgaatttaagtattattatttctaaatataataatattctgttaatatataatggattaagtttcaggactgaactcttgatatttctattcaaatcatctcttcctttaaccccatttacttaaggatcaacatacagagtcccaagaattacgcttgatacagccccctctctccacttgtaatcaatctctcaccagtctctgcacatcaaatctgaatagctgcctgaactctcccttgccacccctggtttacgtcttctgcatgtctctttagctattccctacctcttcccaaccagtccttcttcacaagcatcagagtgatctgcccctcttagaaagctctgttgggtgtttattgtacttgctataacaccagagttttcgctaggatggaagaaggccctgactggttttatcccacccatctttccagccccatctcctatcagttttccctgtgcttgtttctttttttctagttagattgtgtgtttcagttcttagagaatgcccaggcctcagatattcacacataagctttccctgccaggcctggtctttcctcctgttctttgagtagctggttctatatcctgcaggtcttggctgtaaatgttactttgtgagggagatctctcctgacccctatgctaagtgagtaataccaccttttctatattctctcacaattgtatttatattgccagacaaaaattatccaagcatcctgtttactgccttctcttcatccaacaatccctctgcctgttagaatctgaggtcgtttcagttttacttctcttttctcctaaagaataaggattctgttttgtttattggaagggaagttaagttgaacctcatggttagagatgtgggaaaggggaaaagaaagcctcgtggatctgggaatggaaagaaagtattgggtttgtttggtgtgagtaaggctctgggatagctatggcatctgagagatttgagaaggggaaaaggccttttgagatgcaggtgtttggaatctcaatttatctttcctttatgttctttgaaatgctaagtaaagaatgaaattatcttttgtttattttggtgtacctttagtggcccaaggctgaactgtctgggcccatggaatatggggttgccattagatctgtttgcctatttaatgtctgtttcttgcatgagggcagggatcttgtccctgttgttcacatgcgtgatctttcatagcacagtatcatatttttgttgtaaatttgaaattttactctgtaagttttctgacaaccaagacaagtgggaaaaaaaaagacttgatgagttgtggcattcttattgtgtggcaaaatattacaacagccctttggaggagagagtttttcctgtatggtaagaaggctatatagtgtggatccttaggtaggagacattgaaaaacatgttctctaccagcagcattagattttttgatattcttgaagttgatgccatagatgagtatttctcttttatgtaagccttcaactatgtaattgcagttttgctaaggcatttttatagacacctaacctgatgctagcccttccagatgtttctttctagtagtctggcttgcttggataaaatttttggaaccaagcaggatgggcaattctcattttatctagcctgtcatttaagtagcactgatctcactcatttgtatattgaaaattgtagaaaatatgcaagtcatatggtatttggggcctccttgctccttggagatgtagacagaggttagcccagattccagttttagggtctgaggtgctcaaggcccacctacattctcatatttctctctctgtccatgttcttgattcactgtggcttttttggtttttgtgtgtgtgtatatatttttttaattttcccacctgtcagacccaggagaaaggatctatgccttttccattttccacctgaaatccattcacagtctattttttgtaatgccaacaggcgtcacagtggggcttatgtcatgcatgtgttccctcggctgtttcactggtctttgacaccctcagcagcacctggagcatgaccctccccaccctgcactgctccctgcagaggaccagcaccccttgcctcaccaccccttcagggagcggctagtcaggccggacagagtgcctcccacacccatcctgggatttagaggaataaagccatgtcatgttacccagcaattcaaaattaagctctccagtgagtgtttcaaaagaaattggtctttgttgttaatttttgaaagacccatgtttctattattaaaggtttggcaacaaatttgacattcaaatgtgaaaatttaaaagattcactttgttaatatttttgcccagatggagatgcctacagtatctgcatgaagctgtcggagttctaaagcaggcctaagaaacagcaactactaccgctatgagtactgctagtcctctcttcccttcctgtcccctcctctctcctctttttcattttcttcatcaggaggtttgtttggatcttctcaaatgtttaaataagtttctgttgagacaacaaatttcgtctcttagaacaagggccagcaacattttgttgtagggggccagagagtaaatggtttaggctttgtgggccatatggtatctgtcagagctactcaattctgtcatagttaactacgaatgcagccatagattcacataaatgaatgagtgtggtatgttccagtaaaacactagtggttgtatttggcccgtgggctgtagttagtgacccctgtcctacagcacaaataagatgacttaggcctagagaattagttaatatatgttaccacaaaatgatctcagctataatgaaaccacgctgtggccttttgtagaagtgtgattttttttttcttttatttttagtatcagtgattcctgcttaggctatcatgatgatttagctccaaaatgttttttaactccaccaaaaaaaactataaacctggatgaattatctatatttgtcattattattttactgtctaattgaatattaaaaatgtctgctcacagaacagactgtatctattcaatttctagtttcattaagttttatcacatggtttattgaaaaggacaggtcccacggagtccaggccagtagcagccatgtagtaactttttctctattcagtagtcagccatatcaacaagaagcatttttttttttttttgagatggagtcttgctctgtcgcccagcctagagtacagtggcgcgatctcagctcagtgcaacctccacctcctgggttcaagtgattctcctgcctcagcctcctgagtagctgtgattataggcacgcaacaccacacccaggtaatttttgtatttttagtagagacagggttttgccatgttggccaggctggtctcaaacttctgacctcaggtgatccgcacatcttggcctcccaaagtggtgggatttcaggcgtgagccaccatgcccagccaagaagcattgtttaatcagtgatgctctttgtgctcttgatgcattttcttcccagcagcaataccatttgtgcctgttatttactctgaaatttcctccctggagggcatactaaggaaaaccagaaggggtagaggaagcctgtggtggtatcaagagttggccagagggggagccttcctggatgagctggatgtggggatgacattttgtcacctgctttggcattttcttagtgtccaaagcccgtcagtgtctgtttggaaactggaggccttactggcataatggccaaaatatgtctataaactgtctgtatatttgtcagcccttttggattgttttttgttgagaaattattttctctaaaaacctcacattcttcctccttaaaatgcttgcatgaccagtttttaatgtgaagaatttgtttatgggtgcagaatccatgccggcaccatcagttgcctctgggctgtgctgagagtctcatggtgctgacctattcacattaatctcccaagttgaagccagctcaactctccctgaatctaatgtattgtctataacctttcaaaattggcagttaagtcaggatagggaactatactggcagcaataaaaggaagtaggacacgggacagtgctcagaaaaatcacagctgtcatgaaatggagtctttcaatagcctgtttgatccggaaacatgcgaaagtatttcatgcatgacaaaggattagtaaatattaaatagtattcttgttttgttattgcctagtgaggatcaagctctctcatttttctctggttatgtttaatatgtatttgatacttcttggcattcttgaacatgcttatgaggaaggagaagtcacaggcaggaggaagagcaaaggatgatatcgaaatttccatcagcaaataagcattaccctggttaaaactaaatgcaaataaaattagtaagctgaattagtgtttgtttccctgaggctttataacagagcctttcatctgttgttgtttttttctttttctttttaaatgaacaataatagtacagccagagagtttaacctgacagtggtggttactgtgctactgtctccggcttgtctgagtagtgtagagatttgctcaaagagtaagattgttttggagttgtttgttgtactaagtcaacttggtatatggtttcctccaagtatatgacaaagtctccactgcagtgaattctatgataataatcaagctttaacctataagtctaaacctaacagttagtgtgacatgtactatttttaggctgcttcttgataagaaatgattagatcacaagaattactactttgggctatacaacacaaaataagctgcgattggaaactggcaatccttgcaatggaaacgatgggagaaacttagttttttgtctttatggggcagtagacaatagcaggctagttggggagatggcaaggaagtcatacttgaaacaatttttgaataagactatgtattgtgcatttcacaatacatgcccaggaagtgttttacacactaggggtagagtgatagacaagttcacttctcttgtgaagtttgcattgtaaaaagacaatatattttcttttcttttcttttttttaatatgctttaagttctagggtacatgtgcacaacgtgcaggtttgttacgtatgtatacatgtgccatgttggtttgctgcacccattaattcatgatttacattaggtttttctcctaatgctatccctcccccattccctcaccccagatgggccccagtgtgtgatgttccccacccttcgtccaagtgttctcattgttcaattcccacctatgagtgagaacatgcggtgtttggtgttctgtccttgcaatagtttgctcagaatgatggctccagcttcatccatgtccctacaaaggacatgaactcatccttttttatggctgcacagttattccatggtgaatatgtgccacattctcttaatccagtctatcattgttggacatttgggttagttccaagtctttgctattttgagtagtgccacagtaaacatacatgggcatgtgtctttatagtagcatgatttataatcctttgggtatatacccagtaatgggattgctgggtcaaatggtatttctagttctagatcattgaggaatcgccacactgtcttccacaatggttgaagtagtttacagtcccaccaacagtgtaaaagtgttcctatttctccacatcctgtccagcacctgttgtttcctgactttttaatgatcgccattctaactggtgtgagatggtatctcattgtggttttgatttgcatttctctgacggccagtgatgatgagcattttttcatgtgtctgttggctgcataaatgtcttcttttgagaagtgtctgttcatatcctttgcctactttttgatgggttgtttgattttttcttgtaaatttgtttgagttctttgtagattctggatattagtcctttgtcagatgggtagattgcaaaaattttcttccattctgtaggttgcctgttcactctgatggcagtttcttttgctgtgcagaagctctttagtttaattggatcccatttgtcaattttggcttttgttgccattgcttttggtgttttagacatgaagtccttgcccatgcctatgtcctgaatggtattgcctaggttttcttctagggtttttatggttttaggtctaacatttatgcttttaatccatcttaaattgatttttgtataaggtgtaaggaagggatccagtttcagctttctacatatggctagccagttttcccagcaccatttattaaatagggaatccttccaccatttcttctttttgtcaggattgtcaaagatcagatgtttgtagatgtgtggtgttatttctgaggcctctattctgttccattggtctatatctctgttttggtaccagtaccatgctgttttggttactgtagccttgtaggatagcttgaagtcagctagcgtgatgcctccagctttgttctttttgtttaggattgtcttggcaatgcgggctcttttttgtttccatatgaactttaaagtagttttttctaattctgtgaagaaagtcattggtagctggatggggatggcattgaatctataaattaccttgggcagtatggccatttttacgatattgattcttcctatccatgagcatggaatgttcttccatttgtttgtgtcttcttttatttcgttgagcagtggtttgtagttctccttgaagacatccttcacatcccttgtaagttggattcctaggtattttattctctttgtagcaattgtgaatgggagttcactcatgatttggctctctgtctgtaattggtgtataggaatgcttgtgatttttgcacattgattttgtatcctgagactttgctgaagttgcttatcatcttaaggagattttgggctgaggtgatggggttttctaaatatacaatcgtgtcatctgcaaacagggacaatttgatttcctcttttcctaattgaataccctttatttctttctcctgcctgattgcccttgccagaactttcaacactatgttgaataggagtggtgagagagggcatccctgtcttgtgccagttttcaaagggaatgcttccagttttttcccattcagtatgatattggctgtgggtttgtcataaatacctcttattattttgagatacgttccatcagtacctagtttattgagagttttcagtatgaaggactgttgaattttgttgaaggccttttctgcatctattgagataatcatgtgatttttgtctttgattctgtttatgtgatgaattatgtttattcatttgcatatgttgaaccagccttgcatcccagggatgaagccaacttgatcttggtggataagctttttgatgtgttgctggattcagtttgccagtattttattgaggatttttgtattgatgttcatcagggatattggtctaaaattctctttttttgttgttgtgtcactgccaggctttggtatcaggatgatgctgacctcataaaatgagttagggaggattccctctttttctattgattggaatagtttcagaaggaatgtaccacctcctttttgtatctggtagaagtcggttgtgaatccgtctggtcttggactttttttggttgttaggctattaattattgcctgaatttcagagcctgttattggtctattcaggaattcagcgtcttcctagtttagtcttgggagagtgtatgtgtctaggaatttatccatttcttctagattttctagtttatttgcgtagaggtgtttatagtattctctgatggtagtttgtatttctgtgggatcggtggtgatatcccctttatcattttttattgcgtctatttgattcttctctcttttcttctttattagtcttgctagcggtctatctattttgtgatcttttcagaaaaccagctcttggattcgttgattttttgaagggttttttgtgtctctatctccttcagttctgctctaaccttagttatttcttaccttttgctagcttttgaatgtgtttgctcttgcttctctagttcttttaattgtgatgttagggtgtcgattttagatctttcctgctttctcctgtgggcatttagtgctataaatttccctctacacactgctttaaatgtgtcccagagattctggtacgttgtgtctttgttctcattggtttcaaagaacatgtttatttctgccttcagtttttaatttacccagtagtcattcaggagcaggttgttcagtttccatgtagttgtgcagttctgtgtgagtttcttaatcctgagttccactttgatcacactgtagtctgagagacagtttgttgtgatttctgttcttttacatttgctgaggagtgttttacttccaactatgtggtcaattttggaataagtgtgatgtggtgctgagaagaatgtatattgtgttgatttgtggtggagagttctgtagatgtctattaggtctgcttggtgcattgctgagttcaagtcctggatatccttgttaaccttctgtttcgttgatctgtctaatattgacagtggggtgttaaagtctcctattgttgtgtgggagtctaagtctctttgtaggtctctaaagacttgctttatgaatctgggtgctcctgtattgggtgcatatatatttaggatagttagctcttcttgttgaattgatccctttaccattatgtaatggccttctttgtctcctttgatctttgttggtttaaagtctgttttatcagagactaggattgcaaggcctgcttttcttttgctttccatctggttggtagatcttcctccatccctttattttgagcctgtgtgtgtctctgcacgtgagatgggtctcctgaatacagcacactgatgggtcttgtctctttatcctatttgacagtctgtgtcttttaattgggggattaggccatttacatttaaggttaatattgttatgtatgaatttgatctgtcattatgaggttagctggttattttgcccgttagttggtggagtgtcttcctagcattgctggtctttacaatttggcatgtttttgcagtggctgttaccggttgttcctttccgtgtttagtgcttccttcaggagctcttgtaaggcaggcctggtggtgacaaaatctctcagcatttgcttgtttgtaaaggattttatttctccttcacttaggaagcttagtttggctggatatgaaattctgggttgaaaattctgttctttaaaaatgttgaatattggcccccactctcttctggcttgcagagtttctgctgagaaatccactgttagtctgatgggctttcctttgtgggtaacctgacctttctctctggctgcctttaacatgttttccttcatttcaaccttagtgaatctgacattggtgttcttggtgttctctgtatttcctgaatttgaatgttggcctgccttgttaggttggggacgtcctcctggttaatatcttgaagagtgttttccagcttgattccattctccctgtcactttcaggtacaccaatcaaatttagatttggtcttttcacatagtcccatatttcttggaggctttgtttgtttctttttacttttttttctctaaacttctcttctcgcttcatttcattaatttgatcttcactcatttataccctttcttccacttgattgaatcggctaccgaagcttgtgtatgagtcacgtagttctcatgccatggttttcagctccatcaggtcatttaaggtcttctctacactgtttattctagttagccattcgtctaatcttttttcaaggtttttagcttcgttgagatgagttcgaacatcctcctttagcttggagaagtttgttattaccaaccttctgaagcctacttctgtcaactcatcaaagtcattctccatccagctttgttccattgctggcgaggagctgcgatcctttggaggagaagaggccctctggtttttagaattttcagctttactgctctggtgtctcctcatctttgtggtttttatctacctttggtctttgatgatggtgacctacaaatggggttttggtgtggatgtcctttttgttgatgttgatgctattcctttctgtttgttagttttccctctaacagtcaggtctctcagttgcaggtctgttggagtttgctggaggtccactccagaccctgttttccttggtatcaccagcagaggctgcagaacagcaaattttgtagaacagcaaatattgatgcctgatccttcctctgtaggcttcatctcagaggggcatctggctgtatgaggtatcagtcagcccctactaggagatgtctcccagttaggctacatgggggtcagggacccacttgaggaggcagtctgtccattctcagagctcaaacaccatgccgggagaaccactgctctcttcagagctgccagacagggacattttagtctgcaaacgtttctgctgccttttattcagctatgccctgcccccagaggtggagtctacagaggcagacaggcttgttgagctgaggtgggctccacccaggtcgagcttcccggccactttgtttacctactcaggcctcagcaatggcagatgccccttccccagccagtctgccgccttgcagctcaatctcggactgctgagctagcagtgaacgaggctccgtgggcatgggaccctctgagccaggcgtgggttataatttcctggtgtgctgtttgctaagaccgttggaaaagcgtagtattaaggcgggagtgtcccgattttcctggtatagtctgtcacggcttcccttggctaggaaagggaaatcccccaaccccttgagcttcttgggtgaggcgatgccctgcccagctttggctcgccctctgtggccgcacccactgtccaaccagtcccagtgagatgaaccaggtacctcagttgtaaatgcagaaatcacccgtcttctgcgtcagtcacgctgggagctgcagaccggagctgttcctattcggtcatcttgaaacggctgcccaagacttatattttcaagtcagcattataatgttgatgcaaagcagtgataaattgcaaggtatatgaaacagattatactacacattgttttgatctgtggagaatgggattagaaatttcaatgtagaaaagtcctgtgcatgtgatgctgatggacaaattttcagagttattgggctcctgggcatctaagaaaggcatttgcaaccaaatattttttctcttcacttagaagtaagttgttgtaagttaagtgtatatgctttcgcttcaaataattaggaaaaaggtgccatttgacaccaatatataatttagaaaaactgatttgtcatagttgttttttcccatcgattctgaataccttttcataatggtcaaaatcttcagaaactatacagttttataaattcatacattctctgaagaggagattaaagctcctccattttaacaattcactgcttgagtctttcgtacaacttctttccaagtatatgctgtgcttggatgcctcttgtgatgagggacggactgcctctgaaattgcttgttttatctttggttagctttcactgtagaagattcttccttataatgaagaagattttactatagaagattcttataataactggagaagattcttccttataatgagtttaaattctttgtctgttaaagtataatttcctaatatcacttcttgggcccaaatagaacctatctaactcttccttacctggaaatctttcagatatatgaagattgctatccctctaagtccaggcttaaaacatattgttttatgaataaatgaaaagaaacttaatttaggaagattctttcattaacgtagcttaccagtgctaatgaggatcaggtaaaagtgtggatacattgaaagtttcatttcacctcagaattataggcagggtacaatgaatgctagatgctgttgtcctcacaaagaaaagtaaatagaacagtttatctttttgagatgtttagaagtcagtttggagacttctgattgaattgtgcatagcattttaatattctgcttttgagtatttaaaggatggcttcagattttaatactttaatgttaagagtatttagagtctgggacatgtagtgataattctttgctgttatatcgtgctttacaagtagtttccaaagcatttttggataatgcccaatctgattcttaaagagtctggtgaggtagctaagaaggtattattccttttaaaaaatgagaaaatagtagagagattaagtattttttcatttccttagcaaatgacagaagctgagcttgcatctcaatctggggctttttctctcataccatgctgcctcatttgtagcaagaacacctactgttgttttctaaagatgaaagtttccttttcagtttgttttataagcaagaggtattcctgtgtagcatattcattcactagatgaaaaatatgatttagagtttaaatacttgcacttatttttcagtgattgctgttgggtaagaatttgatatttttataaaatcaaataataagtaacattgtgtatattattaacaaccatctgtaaggataatttttgcttcaaagaatttccttagagcaaagtaaaccaaatcttaatttacaagttaatttatttcaagattttttgatcactttattttatcacagtctaatatgattttgagccttatatgattaatgcaacggtttgattttatttggttttgtggtgttttcttctcccagttatttagataagattttagtctcagagtttaagttctgcttttagaagtaaaggaactgagaaggaaagcctcatggtctgaggctaagccctggccaattatcagggtggattcagatgatcgttaaataaatatgtgtgtttctttccatccagaactttggtaacattggatgtttttacataagttgctgaaggtatggacacagtatgataatgctgtcatccttctccttcagggtacactttagactgaccattgactagcttctccttcctggggagaaccaaatttgaagtggttatctaaaccatgtgtttgacccgtcacttattaaaatagtagactttcttctaaaatgttcctctaagaaaacactgaagtttgggagttcaaatttttgccctcaaagtagccagactattccattggtcgatggtggtccctgattgtttagtcctgtccacatattgttatttatctgtaacatcactatctgtacaaagcagctggctctttgaataaagaaaggtaatttcaaaagccacagtgccctacattaatgatctctaaaataaaatttttgactaaaaacaatactctttatcgtttgttatggtaaacaacaaaaaataatttttgtatttattatttttccaatctttccttgtatcagtccaatgagataattcatattttctgacattagcattgtattccaagcacaatgctatgctttggatgctcatcttgttaaataatcacaaaattatgatggagcagtttatcctgttttagcaaatgagaaaattcaggaccagaaatgtaagtaacttgcctgaaccacacagctcatcacagaacagggattccgtacccatgccccttcagtgcaccatgtcgtaggacatccttttccattcttttctttagagagtttgttgtccaaattgctggtaaggaataaaactcatgtttttttttaaactcaggttttctatctcctaaccccaaactatagactttctgcatttttctttgtttcttttcccttggataacaacagcaaccagaaacacaattctctcatctattatcatataccaaatttgccttatgtagtctttgactaatgacttgttggtcagaatgaactcagggatctgttctctgatagtacattaataatatatatgcattaaagcttcttctcggagaatatttgagctttgacatattgaacactggcattttaaattaaagctgttgctgtcagtgcattttaaaaactagatagcttcgaaatagtgtttcatacataacaaaatatacctgaggtcataagtagtttgctaaggcaaaactatgcctggcctggttaattgtagtaggggcttgaatagagttttccaattatcatgacctaaacatctttcagactgagaaaaaaaactaaactgttttgcagggctttgatttactagaagaaacaccatagagcaacctaatggattttctgcatactgtcggagctaggaataatgaatttaaaactattctgaatccttcaagacaggagagtatcaagattaaaatgatacttggtgacaattataattctatagttgcgccctcggcttgcattattgtttcttgtcttgcaaacacttttgtatcagattatattagctaagcagtctttttgcttgtggcattagactcatgcaagtttataagtagtgtgtgttaagcctttccctttgtagagctgatttggggacacggttttacacaatacatatacatatacatatacatatacatatacatatacatatacatatacgtatacgtatacatatgactgtcctcatgaagattttttctgtagggcagtgtaatagaaagaatccccgattggaaccacagaggtcatgagcaacacccacccaccctcactcctgctattttatagatagatcaattaacagattatttttccctcaaatgccactatactggatggtctcagacttcgtatccagtcagacccagaagacttcctctacagagtaatttgcccaaagccacaggagtagtaaagagtggaactgagactattaaaggaaccaggtcctttaatccctggtgattcctcttcatttagaacagatcttgtgttagtgagtacctttccctaaaatgggggtctgactctttgctctatatctttgtcatgaaaatctgccaattccctgtccaggagccagtggatttgggacagaggaggaagactcaaccaacctccagtggatattagcaataggacctgtttttccaccatctgtttgacattaatgtactgctcgctgttgacattgcagatttatttccagcaggccactcctgactcctgaatacttgatactagcatgaaactttctaattgcaggatacagtgaaatccaaagtgagttagaaatttaattaaatttcttgcttgtttaattgtttaatgtgtcgcacagtccagcttgcaattccatattcaattataatgaaactccccttagattgagtttgtcttggggtttgatggtgagtctaaaaagggtattgatgctttaagagaatccttggttttataaaatttcagtgtaagggattgagtgttttagtattaggtttgtattgactcttgatattgacacaagtctaaatgtgcaaagcccacaaaggctaaatcccataggcttatatttaatttaaaatatggctagctggccattttgaatatacttgctaggttgacaatctgaatacttgactgattgggaaatagtcaaatattaattttaaatgttcattagtagactgtttgtaattggtttttaaattcatttggcaaatgagaattcacatttatttaaaattgccaataaacctgatttcataaaggtgtttggaggttaaatgcctaataattaatttatgcctaagtaatatttttaataatttagaggaaagttaaagcagctgagaataatgttaatgatgaaaagtaatgaaggcttcaagattccaagatttaattgtggagatcatattcatcatcttaaaaacagaataggaaactggatggaaaagacattttagtggagcttaaaaaatgctggtcaaggagaacaaaattacgaaagaacccaaaccctatcactgacttggccatgggacccaggcaagcctgtcttcttctctgaaacttaattcatccatacttgaagaggggtttgaaaactatttgtaatctatttttgttttgcatggcaaaagaaggtagaggaagtgtggaggttaatttaattgtgatacaaaaataatgatgtaatcaaatcctcttttatttctacccaaccgttgttatgatgtttttctcttgggcttattctttttttattttcaaaaataatgttagatgattattactcattgtgtgagtgtgtgtgtatatgtgtatacatgtgtttgtgtggatttacacactagacaatgatagcatggtccctttgggaagattaaggtgatgacatgctttaaactttgtgtacccactctgtaaaccatcagtaaaattcaattagcaggctttattccatctgtagaaatataatgatgctaaaataatcaaaatctatttaatcaatttcattataaatgaagggattgcttgcattcaaaatcttaataaaggaaacgaggttggtagtctatgctgattcagtaaaacatatcgtatcttgcaaagccaaagaaattaactgtaaacccttgatcaaaaagcacagaaagtgtgtgatccagagagcttgataactgctagcttttagtgaagaaggctttttgatgttacaagcacaagaagccagagcgttattatgtagataattgattgattaatttaatcaatgactttctcaaagatggttctgagacatgactgggaaaactgaaatgagccagctggccattggcggtccacacctctccatgaaaagtatctgcagagcgcctctgccggagcacagaggactttctggcggaattcctgtagcttgtgtgaggatcaaacctaagcagagtttaatgaaattctactttggagtgatttgtttatcttctgtgagcaatttctttctttctttttataggttgattgatttatctgtatgtgtattcctcagtgcttttccttgtctgaaccaaaagtgctttgcaaatatcagagctcagatttttaaaagatcattgatttttttcaaatatcctgaaggtaggctgtcacacattattatttaattctgagatagggatattgatagcataatattaaaatctttcattagagaatttttttttggtctagcaataacctaaattcgaaggagttttgttttccttcatctatcagaattgttatttaaaagtacccactacccaggacagtatggttactttgttgccttcaggaaagggaatattgtcattggcttaaaacattctactgtgactgccagatattataggtgcccaggagacccaggaaacaggcctttggttagctactgaaatttgccatctgggcacggtggctcacacctgtaatcccaacactttgggaggctgaggcaggcagatcacctgaggtcgggagtttgagagtagcctggccaacatggtgaaacccatctctactaaaaatacaaaacttagctggtgtggtggcacatgtctgtgatcccagctactcgggaggctgagggatgagaatcacatgaacccaggaggcagaggttgcagtgagccaagattgtgtcactgcactccagactgggcaacacagtgagactccatctcagaaataataataatgatgaatttgcctagcataaccagctcttcaaaagtttggtcaaaagccggtaaatgcttagtattgtgtagacgttccacagtgtccctctcactctctttactttcggctgcatatttccacttgttatcaccatctctgtggaaagctccattcaggatcagcaatcttcttgattcagaggaccattcatgatgttaaggatctgctagtgatgacaccagtcacacagaacaatcatgaggaggaagaatatggggaagtctttaccatttcctcctgggctactgttagcttcttacctggtctccctgctgccattgtagccacctgactcccaactgactgttgtaagagtgacctctctaaaccgacatgcccctctccatggttttatcatttctgattcctttattcactcctgatgtcactgtcttgctttaggtcttcagggtcttctacctagattgctatggtcatctctataactgtctccctgtctctcacctcaccccttcagcatggctgctagagtttcctaaatacaaatatgatctggttatctgcatacagtcctttagtagtcactccttggccacagaacaagatcagatttctggagtatatgcacaaatggcatttactatctggcctgtgctcagctctagccttttttttttccccccaccacatccagtgttgcaaccagactgaattccttcctggcagcttccagaacatgccaggctcctttatacctctgcacctttcatcatagtgttctttactggctcgggatctgttctctgctgaggtgtgctagggaacatctatttatcttttaagactcagattgaaagcagctatgcccttttcctgtgccaccccccatcctatactgtaggattgtccaatctctctttcattctccaccatatcttacacctttgggaatcactttattaggtttacttcttttcatgtctctatcttcatcctagattgaaagaactgtaaggccagaggccatgtattttttgtcccagtacaatgcttggtactcatcaggcatttaataaacacttattgaataaaagaatgtctgaagcagctgaataatagtataagacaactttcagattgtaagtgccatataacttcagagaaaggacagatcattatacactacagtaatctaggatgctctcaaagaaaaagtggggacctatgttgcagggatagatcacatttggagtggtagagggaaggaagactattcatgactaggaataactgtttggggctgagacggaggtgaacatttaaagagtactttgaataaatgggtttctttacttatgatgaaatactatgattggagataccattttcctaattaaaatgttgctgttgttcttcatgactcacatattaatttctatactccttaatattgggttaagagtcaaatcagagttcactctgttagtcgcttcacgagccttggacaagttgcttgacttttctgagcttcaatttagaaatgaaaaaaatggagacataatagctacctcaaaatgtgtattgtagcatttacgatgtgttctctatttatccaatgtcagatatagtacaggacactttatgtgtattaagtcttgtaacctttatgtcagctccattttgattaggttattgtttttgttctaatttacaacagaggaaaaacaacggtaccaccaagagaaatatggaagtatggaagacatcatctcagattgttttggaggttggaaggaacagctcctctgtatagggtggctggcagcagtacttaatggtactagcgcagctttgagttcaagggagagagagttgggtctgctaagttgcgggttcatccatgaagttgttttgtgccctgtgatctaatatagcttcaactcagaagctggaaacattactctggaatcctgtgtctggcagtgtgtcaagcagccaggcccagatggagaatccaggtgtatgttggcaaaaacagggtaggtccaaatggagggtggtggcagactgtggaggacttacttgagggctgagctggtggctgcagcatttttatgggatgttccctatttgtgtgggaagacaaccctgaaggtgaatttgtgtggagagaaaacacagaagggcagcaacacagcataagcacaagtcaggggaggctgtgacatcagatgggcgctgaatgcttgtggctgggaggacaggcaaggcccaaaggagtagctctctttttgttgttactgttgttttgctcttcatggataaatttgttctacagcagtttttaagattctattatatgtggagtaccatttatgaggatacaaaatacaaataagaggatgtcctcaagttggatacagatagtgaaacaaagtttacaaataattacacaataacatgacgaagtctatagtggagccaaacaaaaaggactgcaggaacactaaggggtaagctaaaaatcctgcctgagagaattaagaaaggcttctcagaggagataacatttgagctgggtcctcaagaatgaacaggaattctccagtgggaaaggtcactatgaatgcaatgattagaactacttagtaagcgtacaaaaaaaaaaaaaaagagaggataatagggctttctgacactacttttccagattcgagggtatctagtttgtttcatcactctttaaaaagaagcccaaggtatcttaaaggatgaaacagcgcctcggtgctgctcttcatcatagaacctcacctcatgccatggcttggaaagctctgcaggcccaggcgtgtcctcttatactcagaaaacaacccttcaaggtcatcaattccatttgtattcttattggacattgtttggagcatagtaggcattcagtaaatgttctttgaaataagtccatttgttggaatgtcttgaaaatattttttgagggtggttgtattttctttcttgagactcactggcacatgtgtctgtttcaagtcagcaaggctgttccaatttttgtcttaggagttttactttctgtatgcttttttgcctcatttgggagtttacattatttcaaaatggatagagactgtagaatagagaatcccaaaatcacaggacaattgaagttcattgacaaggatagtgagaaaagtgtgctctgcagaatattttactctgagtttctctaatgtaattagttttgagtggggaagaaaacccaacattcagcagaaaggcaggaatagaggatcaatctaatacatcacagtggagaatgaggctgtgttcaggccattctgcatactccgaaactcttaagcacaactgactctgcagaaaatatgtctgtctcaaacccccgtttactgtcagttcttttggatacccagatactaaccaccagaataaagtccagcccaaatctcagggtttctggactgtaatactagttagctccattaatacttgccttcatctgccaagaagatatttaaaagtcatttgcaattatgggtccatctcaggtttggattcattttcttaagggaagtatttggggactactgtcaccccatattgtaaggtgaagacacaaggcaacaggttgagtgaatggtggccctcagtcatgctgggtctggaggaagctgaaagctaggctgagattgctacttagtttgtgtagtttgatgttaaagcatcatcacgtttttttttcaggcccaggaacaggatttagaagcttcaggttttcccttcctgtaaggtagccttgatacctagatgttgtgatttcctttgtggagagaaacaaacttctgggcctgtttctacccatctgctgttgggttgaaagcacagctctcatcatgtttctttccttccgaagtgtctgatgtgtttctctgctgcctctacaagcacccattttcttctgtatccagccttgtggcccttatgcctaccctgttttggttctaaacatgggaatacctcattttctcagtgcttttcatccattccttccatctcaagtgctgaaaatgtctcagaagtcctagaccttgataaaggttattggccatgttattctcatctgtctgctcctgctctgctctgaacagttctggaatactaagacagccatacagtagcagccaatatctttggatgagtcttcttactttaattattctgctgaatggacatatgctcccctcactttcctcccccaccatagctgtccaaatctatttgaattccgttaacttcacgttttctcatgccctgattcagtctcttatgcctaaatttagtctcgaagcatgaaaccataaaggattctccagtccaccctagaactctggacattaacttaaaatctgttcacccatatcaagcctgtgctgtgctcagcttatacctgtaaacactgatctcttctctcctactctaatacaagttttatttgtatcagctctgccctgggtactccaagaataggatagccaattatcctctcataccttatcttctctgacagagaaatcagagttcttgcattttggtctccactgagaaaggcaattctgtgactgcttgccacatggctccccaagtcctgctcaagttctcacctccttcacaaattgttgatgtatgtgggccttgtctcttcaactttatggcaggctcgtagaggatacgtatcttcataacctgtaagtcccactgggcctagaatgttactaaagcactacactttttctcttgagatggagttttgctcttgttgtgcaggctggagtgcaatggtgcgatctcagctcactgcatcctctgcctcctgggttcaagtgattttcctacctcagcctctcgagtagctgggattataggcatgcgccaccccacctggctaattttgtatttttagtagacacggggtttctccatgttggtcaggctggtctcaaactccttttttttttttttttagcaatattaacagatggaacttttatttatttatttatttatttatttatttatttatttatttatttttgagacagtgtctcactctgttgcccaggctggagtgcagtggcatgatcacagctcactgcagcctcaacatcctgggctcaagtgatcctttcacctcagcctctcaagtagctggcacttcaggcatgtgccaccatacgtggctaattttttatttatttttatttttttattatactttaagttttagggtacatgtgcacaatgtgcaggtttgttacatatgtatacatgtgctgtgttggtttgctgcacctattaactcatcatttacattaggtatttctcctaatgctatccctgccccattcccccgaccccacgacagggcctggtgtgtgatgttccctgccttgtgtccaagtgttctcattgttccattcctactgatgagtgagaaaatgcggtgtttggttttctgtccttgtgatagtttgctcagaatgatggtttccagcttcatccatgttgctacaaaggacatgaactcatcctttttaatggctgcatagtattccatggtgtatatgtgccacattttcttaatccagtctatcattgttggacatttgggttggttccaagtctttgctgttgtgaatagtgccacaataaacatatgtgttcatgtgtctttatagtagcatgatttataatcctttgggtatatacccagtagtgggattgctgggtcaaatggtatttctagttctagatccttgaggaattgccacactgtcttccacaatggttgaagtagtttacagttccaccaacagtgtaaaagtgttcctatttctccacatactctccagcacttgtttcctgactttttactgatcaccattctaactggtgtgagatggtaactcattgtggttttgatttgcatttctctgatgaccagtgatgaggagcattttttcatatgtctgttggctgcataaataaatgtcttcttttgaaaagtgtctgtttatatccttcgaccactttttgatggagttgtttgattttctcttgtaaatttgtttaagttctttgtagattctagacattagccctttgtcagatgggtagattgcaaacattttctcccattctgtaggttacctgttcactctgatggcagtttcttttgccgtgcagaagctctttagtttaattagatcccatttgtctattttggcttctgttaccattgcttttggtgttttagtcatgaagtccttgcccatgcctatgtcctgaatggtattgcctaggttttcttctagggtttttatggttttaggtctaacatttaagtctttaatccatcttgaattaatgtttgtataaggtgtaaggaagggatccagtttcagctttctacatatggctagccagttttcccagcaccatttattgaatagggaatcctttcaccatttcttgtttttgtcaggtttgtcaaagatcagatgtttgtagatgtgtggtgttatttctgtggcctctgttctgttccattggtctatatctctgttttggtaccagtaccatgctgttttggttactgtggtcttgtagtatagtttgaagtcaggtagcgtgatgcctccagatttgttctttttgtttaggattgtcttggtaatgcaggctcttttttggttccatatgaactttaaagtagattttccaattctgtgaagaaagtcattggtagctggatggggatggcattgaatctataaattaccttgggcagtatggccattttcatgatattgattcttcctatccatgagcatggaatgttcttccatttgtttgtgtcctctttgattttgttgagcagtggtttgtagttctccttgaagacatccttcacatcccttgtaagttggattcctaggtattttattctctttgtagcaattgtgaatgggcgttcactcatgatttggctctctgtttgtctgtaattggtgtataggaatgcttgtgatttttgcgccttgattttgtatcctgagactttgctgaagttgcttatcatcttaaagagattttgggctgagatgatggggttttctaaatatataatcatgtcatctgtgaacagggacaaactgatttcctcttttcctaattgaataccctttatttctttctcttgcttgattgccctggccagaacttccaacagtatgttgaataggagtggtgagagagggcatccctgtcttgtgccagttttcaaagggaatgcttccagttttttcccattcagtatgatattggctgtgggtttgtcataaatacctcttattattttgagatacgttccatcaatgaaacagactttcaaccaacacagaccaaaagagacaaagaaggccattacataatggtaaagggatcaattcaacaagaagagctaactatcctaaatatatatgcacccaatacaggagcacccagattcataaagcaagtccttagatacctacaaagagacatagactcccacacaataataatgggaaactttaacaccccattgtcaatattagacagatgaacgagacagaagattaataaggatatccaggacttgaactcagcaatgcactaagccgacctaatagacatctacagaactctccaccacaaatcaacagaatatatcttcttctcagcaccacatcacacttattccaaaattgaccacattgttggaagtaaaacactcctcagcaaatgtaaaagaacagaaatcacaacaaactgtctctcagaccacagtgcaatcaaattagaactcaggattaagaaactcactcaaaaccgcacaactacatggaaactgaacaacctgctcctgaatgactcctgggtaaattagaaactgaaggcagaaataaagatgttctttgaaaccaatgagaacaaagacacaacgtaccagaatctctgggacacatttaaagcagtgtatagagggaaatttatagcactaaatgctcacaagagaaagcaggaaagatctaaaattgacaccctaacatcacagttaaaagaactagagaagcaagagcaaacaaattcaaaagctagcataaggcaagaaataactaagattagagcagaactaaaggaaatagagacacacaaaacccttcaaaaaatcagtgagtccaggagctggttttctgaaaagatcaacaaaatagatagactgctagcaagactaataaagaagaaaagagaggagaatcaaatagatgcaataaaaatgataaaggggatatcaccatcgatcccacagaaatacaaactaccttcagagaatactataaacacctctatgtaaataaactagaaaatctagaagaaatggataaattcctggacagatactccctcccaagactaaactaggaagatgttgaatccctgagtataccaataacaggctgtgaaattgaggcaataattaatagcttaccaaccaaaaagagtccaggaccagacggattcacagccggattctaccagaggtacaaggaagagctggtaccattccttctgaaattattccagtcaacagaaaaagagggaatcctccctaactcattttatgaggccagcatcatcctgataccaaagcctggcagagacacaacaacaacaaaaaaagaattttagaccaatatccctgatgaacatcgatgtgaaaatcctcaataaaatactggcaaactgaatccagcagcacatcaaaaagcttatccaccatgatcaagtgggcttcatccctgggatgcaaggctggttcaacatatgcaaatgaataaacgtaatccatcacataaacagaaccaaagacaaaaaccacatgattatctcaatagatgtaggaaaggcctttgacaaaattgaacagcgcttcatgctaaaaactctcaaactcctaacctcaggtgatccacctgcctcggcctcccaaagtgctgggattacaggcgtgagccaccacacctggcccaccaaagcacttttaaaagtctttactggctggctgtttggtcacaataatgtttatagtgaatatgcctttttctttaataaacacatttaacgttttaaagttctttttctgaagagtgatttttggttttgattgttgatagtggccttgattcatgccaaacttataaaaatcctggtcagtttatactgagcttctgcacatagagttttatataaaaccaagactttgtatttgaaggatggaatgttgatttaaacaccttttttgtacataatcattttagaatttgaagaggaaaaattaacaaagcttgtcagattacctttcagatttctttcttttgttccctaatattaccttgtaacaataccatctccatctccgtatgcttctagatcacattaattccacagcaaactttatattatcagacataatttgaaatgtgatacaacttaaattcactgtgccagctcagcattcctaattcatgttatctgcagtgtttgaattatagttcagatttattggaccagagaatgagaaaatccaaattctctagaattgatttcttacatggaaaggctgacacagtgggagatgtgttgctgtttaaaacagaactttgagacctccccacccccgttcagtgataagagaatgaacaatgcattttaatggaaaaattgaagtaaagcaagatagttcaaattaactggagaaccatgattgttggttccagaaaaattcactgttgtattctcagtgtttgaaaatgactgtcacatgataggcactcaattaatttgttgaatacatgactaagtgtattataagccaagagaagttttaatatgcttattacatgtttaatacaagaaaagcattatctcaatttattcaggatatagtaatacatagatgatcatttatactgctctaccttgatgaggcctctagctttccactaaatgtttgtcacttatgatagcaataacagtaatagaagtagcatctagcatttatgtaatactttttatcatttagtaagtactatttatttattaaaatgcacacatatatgttctcacttgtcttcagaacaaatttgagtgctcggtggaacaggttctaaacaaatgtgagatccctcttctcccactcctggatgttggccttgtatggtaggaagggcaggtatagttctttgattggtgaggaaactaaaaatagaaagaatagtttatgggccaaaagccacactttaattttgtaataaacataaacctaaattacagataatctgacatcttttccactttaaatttattatagatttaactgactttacatttcattcaataatttctttgcaatgtcactgaaatgcagtgacagatgtatatttaaaattactataaagcccatcttgaataaaataaagaagtgtaatatatagtagataagaaaatactatttttcagagctaagcatgatctgatttttatcagtattttgaaagtatttattcatttccctggataaaagactgtacgtgatttggaatataaggaaaggaataggtgaagatgtcccttctgaactgttttttttaaacttggtttttgaaggacccgtttgtttttcgttttcttgccctttcaaataaccagcagcataattagtatgctatggtgttatgggaacaaattatgaataaacaaggattaaaagattgtatgaatatatctttcatacttacttggaggatttaatttcacaatataagatattttaaaaataaatacttggattttatcctggaaattttcatattaatgaaagaaagaaaaacctatttaatgagagctttaagattgtatcttatgggaaagtctaactttaggtataaaaggatcagttttattttgagatttttggctaagactttacttaaagattgctttgtcagaactggagattttaggagtgcctatgacttgacagaaacaactgggatagactattctgatgttctttaatgtttaattggtaattctaagggaagaagaaatactttggtaagttagatgcatggtccagctagcttaattatctgtcttgcgtgctggggactatatggagagtgattcctgtccatcatagtattggtctcaaaaggtcaatttctagttcagacagcttcaggtctcctttggtctccaggatttgcatatttatctgttttatctttagttttgatggaaaaataatgcgtataagtgaacatctattaagataatagctttttgttttcgaaatttctcctaaattataaggcctgatacgtctagagctagtatttgaacattcggcacaaacgttaaatttcatatgtttagaataattagttcttaaattcaaaagatatttgactagccaaaacgtgatgtctgactttataggagatgatgagcatttaggtgatgatgtataagtgaaatatgtcctgaaaggcccctcatagaattggttttactgagtaatactttggtactaagtccttggctcaaatcaagaaaggacagaaagggaaggcacacagttgtatttataaggatgtcgttgaagacattggttatatatcacacaatttcccttttatgaaaacccttcagtgtatcttttttcttttatcttttccttttttggggccagtctgacacgtgaaatgatgtcttgttatttaaatgtacatttcttttgattgctagtacatgttttatgtattgtttttattttatttttttaacaaattgccctgctaattttcttgctatttttccaattgggatgttcatttttttcttatggactttcaatggtacttgtgtattgcaaggagattaatcttttaccatacatattctaaacatttttctgctttctctaattttttatgtgttttttttatttaaataaaagtttgggtttgtttttctaagtgaaaatgaggccagccatcttttgtttgctttcatttcctttaaagattatataagtagttatcaatattttctccaaatacttgtatttttgttttttgtttaaaataaatatcaggttcctatctaaattttacatttaaatgcagaatataagcctcatgaaggcagcaattttgtcgattttattccttatcgttggctgtattcatggcacatcataggcatgtaatatgtatttttcaaatagatagtataagtctttatctaaactttatattgttataaaaatgtgaatagaaatctagctttcttaacctttttagaaagctggacatgtacttttaagtcatatttaagcctgctgtttttcctctgtcccgaaattcttcctcttgctttccacctatttctgtagaaaatccttctgtggtaatacaccgacaaggtcataatttacgtttcaagttttcctaacgtgatctttctttgtagcacttgtcatagctgcagtttcatgattgtttgtggaattatttaaatgttcttctccccgcttccaccctacaagccaacattagtcagggactttacttatttttgttcatcatcatatcccactgcatggcacatattagataattaataagttttttttaaatgagcattttattttttgaatagactaataaactgccacaaaaatcacataccaagtccttgcacatattcggtccccttcaagacttttacattttatattattgatctgtctgttttgttatcagtcccatacaaatttaataactatacttctaaaaacattttagtatttcttaggttatagtggcttcccatatactctttacaacaggtgtgtccaatcttttggcttctctgggccactttggaagaagaatttgtattgggccacacataaaatacactaacaataacgatagctgatgagctttaaaaaaatcacacacaaaaaatctcaatctcataatgtttcaagaaagtttacggatttgtgttgggccacatgtggcctgcagaccatgggctggacaagcttgctctacactaattcacacagtttaaaacattttccaactattctcacatatttatcttctggttgtattttataatcatttgtcaagttaaaaaaatctcattgtatatttataagtgtgcgtgtgagagagagtatgtttgtgtgttggtttgcaaggaaggatttgttttaaatttgtaaatcggagagaggttgtgtatttataataaaatattccattttcttatttaggagcttgctatgcggcttttaatttattgaatgcgttgtcgggcacggtggctcacacctgtaatgccagcactttgggaggctgaggtgggcagatcacctgaggtcaggagtttgagaccagcctggccaatatggtgaaaccccgtctctattaaaaatacaaaaattggccaggcatgctagtgcatgcccatatccagctactcaggaggctgaggcatgagaatcgctcgaacctgggaggcagaggttgcaccactgcactccagcctgggcgacagagcaagactctgtttcaaaaaaaaaagactacttacgaatttattgaatgcatttatttctctcagttaatttaaaactttattttatagaacctaaacttttcatgttaggatttttcttagacattttcatgcagaaactagttaacatagcaagctcgaatttgctatctttagaaggatttgcttacagggttggcttgtccttggctgtcatctgataacttgacttcagaatgttccctgtggtactaagtgataaggttatttggtgtaccaggggtactgaatttcattgtgccaatctgcctagacttaaaaaaaatgtgatttatacttccttctgggattttttaaaaatattgtggctgagtatgtaggcagagagtgtctgtgtgaccagtccctccaaaatctttgcactcggggtctcaagagatttttccagacagagatgctacacatattactgcatttctttgctagagagcattagaaacttacacacagatctcttcaggtgccacttgatgtcttcatctctcattagttttatcacttttaaatatcttctcttagtttttcctgatagtcccaatattgtcatctctaaatgaaaattctgtgtacttttttacaatatttatccttcacattcatttttcttgtcatattacagtgattagatcttccagaacaatattgaaaaatacagttgacttcaaaaacttttattttcaatataattgtgatagtgttttatattagatatgttttctattatctttagtttgatattctttatcatagtaagaaactatcccttaatgtctagtttatttagtttcattagaagcacacaatgcattttaagtcttttttgatacctgttgagacaacccaatttttttgtttctttattaatgtgataaattgtttcacatatttgaaaagccttatttaaaaagagtcatgatatcgctaactatcctggcgataaactatccatattattttaaatgattttaaaaccttgctatggaaaataagattaacttaagtagtaggcttattgtaatttattgccacttaaataatagaggttaatagaaggatgcaagaagagagccaacttgttgtatcatggagaaaaataattgtaagtattaataataataaataaaaataagactgtttagcatatttctaaaggacattctcaaataagtaatctgtatttggtatctgttggccaaaatatatattttctgtattttagcaacacacacaaagctatgtgtgtgaatacatttttataaatcgatgtatttttgatacaaaaaagcctgttgcattcagacaggtgtttttgaagcactgacatttgcttccagctctcctacttttactttcaatgcaatatgatgaaataaaccattttatgtatactacataattgccacaatgtccatactggtaatacttgattgttaatactgatagagcatgagacagcatgatgtcataaattggttctcatcttatttgctctgtaattggtcatgatcattacagatgatttcatcttgctaggatttgcttcctttattctataactatattactaaaatgacatagtgattttaaaatttacagttaaaatagagaaaaatgttcattttaagcatgtatgttttaaaaatcatatgtattattattttacattgtattactaactacactgtcatacttattactgaaatatatgtatgagtacgattatagttttttgtaaaaatattgtattcgtctgttctcacactgctaagaaagacatacctgagactgggtaatttatttaaaaaagagatttaattgactcacagttcagcatggctggggaggcctcaggaaacttatagtcatggtagaaggggagacaaacacgtcctttctcacatggcagcaggaaggagaagaatgagtgcccagtgaagggggcagccccttataaaaccatcagatcccatgagaaataactccgtatcatgagaacaggatgggggaaaccatccccacgattcagttatctccacctggtccctctcacgacacgtggggattattggaactacaagataaaatttgggttggggacacagccaaaccatatcaaagtttaaatattttctcacaataaagagaggatatatgtaagtaaacataaattctgagatttaattgaaatttagtgaatcatgtttttcttcagtgttctttcacataagaggtaattttttttggcttaataaaaatgtctcttatctttcctttacttcttccatctttctatctgataatgtggcaaaaggcagcttttgaaaacaaacaaaatactacagtaaaagcatattttttctgatttctatcagctatgaatatctagcattaattttcctggtagaatgtttgatgactataaagaggagactggtaagaaggagaagatgcaccctccacacaggtcagtggggaggcggacttacaagtacttttagtgctacttttagggcggtacaaagttactgaaagcctaggaggtctacttaactcggcatcagatgttacataaagtgttatggaggctgacgtatctgaatttcagcattgcttccatctcctctggtaactggccccagtaaacctatctaacattattttctagtgtgtctatattaggattctttagagaaacaaaaccaataggatagggtgtgtgggggggtatgtgtgtgtgggtgtgcgggtgtgtatatgtgtttgtatggaacctgagtttttgaggaggtatttttaagcttgaattgaccgaaattggtcatgatttcagggaaggaaaaattgaatcacaggaagggttaagagaaaatgtacatgtagagggtgtgagggagagggaaaaattcattgtgattttgaagttcccagtttggaagatggagtaaatgaatcagatatgtcaggaaacacatggaagttgagttttgtatatgctgcatttgagatgcctgaggagcagttaggaatgcatatctggagaacaaagaggtccaggctagggggaaagtgaggtcttcaacttaaggcctgtgatggagccaggtgagaagagaacatctaaggacagcatgtaaagctatatgaagccctaagagtgtcaacattccttgccctataaatgtttgattgcctgattagttatattcataatgagttctatgtgaagcaaaagaaatgggaacatttgattaatctgcaagattccattgacattctcaaaagtaaattgtcatatgttaaggcagattactaaaatggaattctttatgtgtatcagcatgactgagcgagttaactaatctgtttgacactcagcactcatctatagacaacccaaccccatgattggtcctactatatccacgcttgtcttactataaaggaaatctctatgtagtagcagcagaacttttttttttcttcctcaactaaatgtgatgtcaatcctgtataaaatctcacttctttccttggtccctgccaacctatctcatgtctttgctcatttgactccagctgaaggaggcttctttctgttcctgcccaagggcttgtgcatatggtagttactcaataaatacttatgaaatggatgaatgactctgccttgtagatttgttctgagaagtaaatgtgaaaaagtatatgaagagcctagtgatgtatctggtacattagagatgtgaaataaatgcctcttttgaccattttaattttttgtttctccaaatctgtaatcctgacatttctgtcgtcttctgctgcaatctactttcccaacccttctcatccagccagcttactgtctttggtttcggcacccccacaggccacggaccatgtatgatctcctcagtttgtacttcagtgtgaactgaagagatcacagtttcatacacaaggtttttcatacatgtaatctcttgagttaccctcttacacttcaataattacatatggattcctagtcccaaggacactgagcatataagtcgttgtgctggagattctcagaagaatgggtgtcctctggggacttggtcacagacctaaaaagggactctttaccagtcacaaagcactatcatgatcacacccttattatatggatttggaatcagcacttcataaattgtagccaacattgattgaacaccaaatatgggtcaggcagtgttctaagcacgttacatatatcacttgatgagtttggttttattggtattcctgttttatactcactaacttgcctaagatcacgctgctactgatttgcaagttaggatgtaagcccaggtggtctagtttcagattcctgtccttacctatgctttttattcaatactgcctcagcagcagtttcagggtcatagagttaacatctgttctttagtgtttgattctagattttaaaaataatttaccattttagttttcaaataattctaatagtttctttctactcttttacctaccactttaagtctttattcccatagggcagctactgttaacaatattttcagaacctttttcatcataatttttttgtaaaacatcttagtggctttgtgattccccctttcagttgtttattttctgaaagttcagcttattcttagttcatgaaagttttaaataccagtggtccaaacacaactccggtatgttcatgtgtgtgcctgtggatgttccacctgtgtccgaggcagatttttgaaattaattaacttcttacctgtttggaacttatttacatgagtttctgcctgaaggagatgtacttctgtttgaaaactccaggttgatgaatttttcgggttgccaggactcaaacttatttgacaaatcatctatgaccctatcaccttgatgctcagaaacaaatgaaccaacagcccttcctgactaaggaaacaggttttgatggagttttcaatgcatggctttatggactcaagaatcaaatgttttctgaacaatgtgaagaaagttttgtttctagatccttatatgttcctgtgtctccttttctgtagaaaagctctgcaatttttaatcagtaacacaaaaatgcctccatggaaatgtccataattctcagcgtgcagtggaacattttccgaaaaagtgaggtcaccagaagcacagagcagagaaatcccagatggcactaatatttgatttcatttttagcacgctcatattcagcagatggattggaaggctgacctctctgacacttctgcatcactgcctgctactccaattgcctttgcgaatgttttttcataaggcatctcctggtacctcagagattgatgcctggtcgcctgcctgtgttatgcttcatttcgccaggattctgtgtggttgagagttgctgtattctataaaaggggaaatcctggctcatcagtatctcaagcttttcctacagtctctcaaattgcgtgtaacgtctcggagcatatcattttagctttctaggtgtacccctgatttgtatccatctttaacttatcctagtctaattttctgccctcttttgccatcaaaaataatagcaaaaacctcaattacttttgcagcaacctaaatagctaagccaagaataatgtaaaaaaaaagttaaatgttttcaaaatacctactaagtacaaaaatttgattattttaatatgaacattgctgaatctcctccttgagctatagtttcagtggccaaaagcaaagacctgagttagagttcccaatcatgctgttttctttaagggtaagctctactttagagtaagtgtcagttttcttatttgtaaactagtgatattattcgtgccaggcagttaggattgatgtgaagattaaatgaagaaatgaatgtcatatggttgtcacagtctgtggcacagagtaaatatacaaagaatattagtttgtggtgtgcaaaataacttttgtatgtataatataaataaaatataaaataaatggtaaaattattttgtttcattattacttagattgtgagtaaagtgaaatgttaagaattttttaatgttcacactaatgctttattttaaaactttctataaaattactgtattccttgttatggaccattatgttgtccacacatctatttagagatgaccctcttctccctcctaccctcacctgctagtttatatttcagtggcgtggctacagacaaggaactatcagataagatgagtatccagtgggtttttttttttttttttccaggcaggttgacctatgtggccatttgttaaagttctctgagaatgctcaattctgaggaggattaggttgctatgtccttccaggttgcttgttcccacacagccagattctggtacatatttgaatgcatagcatacttttggcttagaaaacattgcacatttagtagtcattttgcttgaatcagatctctacctgatgtcattttgatgaatttagggtttagatgactaaattgcagctttgttgtgaaactttctatagaaagttatttttttcctttttttaggtctaacataagaccagactatgcagactccaatttccacgacttcaagatgcataccttcactcgagtcacatcctgcaaagtctgccagatgctcctgaggtaagcctgctcagtcctggttttcagtttaaaggaactgatataattgctaagtgtttcagacttttctaaccttctagccaataggttctaaagtggggaatttgccttagcagtctggatcccacaaacctttgccaggctttctgcctggacagtcctttcagaagctctggcaagctcgtctccctctaccaagggggtaccttgaagagcactgttgatactttttttcttcttcttgcagtaatttcatatgggcagaattttgcaccgtttaatataccactttcttatttcacctttcaggggaacattttatcaaggctatttatgttttaagtgtggagcgagagcacacaaagaatgtttgggaagagtagacaattgtggcagagttaattctggtggtaagtcatgtttattgttgcaattctgtttttaatgaggacataaaatttgctaaacataattaaggcctaatttactctgaatatgtgtttattgtaacatatctgcttttgaaactattatttataagcacaattagaaaaatgcttaaaatttacgtgagttttctgcataactttgttttaaattatttaaaatttgtgtgacttttatacatatcttggagacagaggtcttcaagagggagttggatggtttcatgtcactcatttctttaaaagccctaaataaatgactaaaaccatacaaacatagccgaaaaaatagagtaacaaaaacaacagaaagaatatattcttctatctttagttcttaaatttcctttttattcttttaaatatttagctcaggaatgctaatggctccagaagtaaacatcacacagactaattcatgaattaatgaattgaatacattgtcattttgcagcacttaaaaaagagcatatatcttttgggttttatgtaaatattttccccttggtttttaaaaataatgctgcatgattgttacatgagctagtttctaagatggctggcagttatgcattcagtagcctattgcctctttctgctcctcttgggctctcttccttgtctttattttctggcttctttattcttccctttcttcttttttctctttgtccttttcccccgagtttctctgtgtttttatcaataagacctttcaaaatcagtaaaacttttgaacacaagaaaggatctttaacagcttgagttcaaaaggtagccatgtcaacctttgattttcccaaaggaaaaggtggacattgaattattttggataatgtgaaaaagagtgaaacagagaatagctcatttcggagctgagttcagaaaataggcaattgtagaaaaggtgaatcctattagacgactgagatcatagcacattcctctcagacattttaaaaggaccctctgtgccattctctgtgctaggcatgagcagctataaagtgacagatcttggcatgagttgagcacctacactgtgcctgtcctgcctgggtgctctactgggcatcttcttgcatgagctcattccgtcttcagaatggccctgcacatttactgatgggggtcggattgcttatgcagtttactcaagggctgttaaataaacttacctcttacttctgtcggaaagtcagaaacagtttacagagttgtaaaatataatagaaataaaaattattgttgttattctttaattgccaccccaatagaatttatcacttgaatttttgttgttccatctttatatgccccattctttaatctctttggagacagttaacattttatttgctcatagtaggctaatgtttatataaattccaaggccctgtcttgatgagatgatatctgtgaagaatgtaaaatgatcccatagttggcatggttctaaaggaaatagtgtaggagaatagtttagagtcaagcagagatggttgaaatgctagctttgcgccatttgttagctatgtgagcttggggaatttacttaaatattctgagcttttgtttattcattttgtaaattagacgattattatgaggatacagtgagataatgttgattcttaccacagtacctgagcaaagtgagaacttactattttaatctaaggtgatatagtgaaaaatcaggttttttttttttttttgaaagacgtgggcttatttagtatttttattgttttcatgatctggagtacacgtggatgggaacgttaaggagcaccaaactttaaaataatacgcaagtatggcattaaaaggacataaaattttttaacttttacgttataaaagtcaataggaaatcattgaaaattcctagtctagtcaaatagaagagtcatatattctcagtgtctgttcctaggtaattatttcaatgtactctgtccttacataagtcattttgtctatggcagtaaaatctacaagctctggagtcttggtctgtttgaatcctagcttcacaatttactccttgggtgattttgaactccatttacttaccctttgtaagtattggtttcttcccttatgctatggtttggccctgtgtgcccacccaaatctcatcctgaattgtaatccccacgtgtcaagggaggggccaggcaggaggggattggatcatgggatttcctccacgctgttctcatgatagtgagtgagttctcatgagaactgatggtttcataaggcagtatttcttgctcttgctctctgtctcacttgtcaccatgtaagatgtacctgcttcaccttctgccatgattgtaagtttcctgaggcctccccagccatgtggaactgtgagcaaattaaacctcttttctgtataaattccccagtctcaggtattacattatagcagtgggaggacggactaatacagtaaattggtacccagagtggggggcactgctataaagatacttgaaaatgtggaagcgactttggaactgggtaatggatagaggttggaacagtttggagggctcagaagaagacaggaagatgtgggaaagtttggaacttcctagagacttgttgaatggttttgaccaaagtgctgataatggtgtggacaatgaagttcgggctgaggtggtcccaaatggagatgaggaacttgttgggaattggagtaaaggtcactcttgctgtgttttagtaaagagactggtggcattgtgccccaccctagagatctgtggaactttgaacttgagagagatgatttgaaattggaacttatgtttaaaagagaagtggagcataaaaggttggagaatttgcagcctgatgatgcgatagaaaagaaaaacccattttctggggagaatttcaagcttgctgcagaagtttgcataagtaatgaggagctaaatgttaattgccaagacaatggggaaaatgtctccagggcatgtcagaggtcttcatggcagccccttccatcatggtcctagagtcctaggagagaaatggttttgtggactggatcaagggccccactgctgtgtgcagcttaaggatttggtgccctgtgttcccagctgctccagccatggcgaaaaggggccaacgtacagctcaggctgttgcttcagagggtgcaagccccaggcctttgcttcagagggtgcaagccccaggcctttgcagcttccatgtggtgttggacctgtggatgcacaaaagtcaagagttgaagtttaggtatccgtctaacaaagatctaataaccagagtctacaaggcacttaaacaaatttacaagaaagaaacaaacaaccccattaaaaagcaggcaaaggacatgaacagacacttctcaaaagaagacatttatgcagctaacacatatatgaaaaaaaaagctcaacatgactgatcattagagaaatgcaaatcaaaaccacaataagataccatctcacgctattcagaatggcaattattaaaaagtcaagaaacaatagatgctgctgaggcagtggagaaataggaatgcttttatactgttggtgggaatgtaaattagttcatccattgtggaagacagtgtggcaatccctcaaagacctagaaccagaaataccaactgactcagcaatcccattactaggcatatacccagaggaatagaaatcattctactataaagatacatgcatgcgtatgttcactgcagcactattcacaatggcaaaagcacggaatcagcccaaatgcccatcagtgatagactggataaagaaaatgtggtacatatatcatagaataccatgccgacataaagaggaatgagatcatgtcctttacagggacatggacggagctggaagccattatcctcagcaaactaatgcaggaacagaaaaccaaacaccacatgttctcactcataagtgggagctgaacaatgagaacacatggacacagggaggggaacaacacacactggggtctgtaagcagggtgggggaaaggagagcatcaggaaaaatagctaatgcatgctgcacttaattcttaggtgatgcgttgataggtgcagcaaaccaccatggcacgcgtttacctatgtaacaaacctgcacatcctgcacatgtaccctggaacttaaaataaaatgaaataaataaaataaaactttaaaaaatgcttattgctcatggccacttgtcttcaggccataaggaagttgaaagttgactgcatagaccatgaaacaatgttcaatcactttggcttttgtaagcttacctttttaagaatacttactgacaaaatttgatttaaaaataaggattcttatctctagagtcttcctagctgtttaactcagctttggcatgctgccttgccaacaactcacttgcacttataatttaattgtagtgacatagacagcagattttcaaagaactgaaggtggattttcaaattcctcagcctcataacctttggtgtgtgatcatcctggcccaccttcaccaagaatcctatcaagtcagtttagccggaatcgcccttatatgtgatgtttcctctcactaattttccatccattgacctcaccctcctccttggctataaatctccacttgtccatgctgtatttgaaattgaacctggatttctttctcctttgcaattgttcctgaataaaatctgttatcacaacttaaaaaaaaaaagagagagaaagaatcgagctttgggaagctctgcttagatttcagaggatatatggaaatgtctggatgcccaggcagcggtctgctgcagggtcagggccctcatggagaacctctgctagggcagtacagaagggaaatgtggggttggagctcccacacagagtccccactgccactgcctagtggagctgtgagaagagggccacggtcctccagattccacaatggtaggtccacccacagtttgcactgtgcctggaaaacccgcagacactcattgccagcctgtgagagcagccaggaggggggctgtaccctgcaacgccataggggcagagctgcccaagaccctgggtgcctacctcttgcatcggtgtgacctggatatgagacatggagtcagaagtaactgccctgctggatttcagacttgcatggggcctgtaggccctttgttttgatcaatttctcccatttggaacaggtgtatttacacaatgcctgtacccctattgtatcttgggaggaactaacttattttttattttactggctcatagttggaagggacttgccttgtctcagatgaaactttgaactgtggacttttgagttaatgctgaaattagttaagactttgggggactgttgggtaggcatgattgtgttttgaatatgaggatgtgagttttgggaggggccaggagcagaatgatatggtttggctctgtgtccgcacccaaatctcatctcgaattgtaatccccataatccccacatatcaagggagggaggtgattggatcatgggggcattttccccatgctgttctcatgatagtgaataagttctcaggagatctgatggttttataaggcagttttccctgctctggcttgctctcttgcctgcctccatgtaagaattgcctcttttgccttctgccatgattgtaagtttcctgaggcctccccatccatgttaaactgggagtcaattaaacctcttttctttatgaataacccagtctcaggtatttcttcctggcagtgtgagaatggactaacaccttgtaaaacagggccaataataacacttagattttaaaatctttttaagcaaatacccctatttagtgccaggtactgttctcagtacagctgctcctccattaatgatggggttatgtcctcattaagccattgtaagtggaaactatcgtaagtcaaaactgcattcaatgcacctaacctattgtacattatagctttgcttatcatactttaaacatgctcacagtacttgaaatacagttgggcaaaaatcatctggcaacacagtacactgtattgtttgcttccccttgtgatttcgtggctgactggtagctgtggctagctgctgctgcccagcatcatgagtgagtctcattgggcatgttgctcgcccgggaaaatatcaaaattcaaatattaaagtctagtttctacggaatgcatgtgactttcataccgttgtaaagtggaaaaatcataaatgaaccatccaaaattggggaccatttgtactttaccattgttaactcatttactcctatataaattctgtgaagttggtattattgacatcttacagatgagaaaccaaggcacagagaaatatgcaatctgtctaagtttcttgttcaatacaaccaagattcaaatccaggcaggccagcccctaagtttgttcttaccactgggctctgctaccagttacatgaatgatctgtgatgatgatatgtcagatgtgtcaaaagcccagtactgaatcctagtaagtaatcatgtgcttgcctttctcagtgaaagggagtgattttctaatggttttttaggcagaacactttaattaaattagtaactacccagtgtttttaggtttgaatgttctgtagtgctgcgagaagacatgcatccctggggaccatacctaccttcttcccatggaaactctcaagaccggatggacttaagacacattcagttctagggcctcttattttaagatgaagaaacaaggtcataaatatatgaaaataagataactaagaataatactgttagtgccctgcagattgtagataatgcttactaagatatcctcaattaaaaagtagcatcattctctaaactttggtatgtaattcattacaaagcaggaaaatgtttttttaaaacctctggctaaatttgctttttggagtttgtaacatactctcttgctcttttgattcttttccctgttttgcatatttccattgacctccattccccttctgttttatacgttggtgccctttctctccctctctccttcttttaagttctttcctgctcaagattttgagagaccggtaacaccgaatgctcatagttcattagcggtatgaaatggtaaggacctgcctaggaggcttcctttttttactctcagatcggggtttgctgggtagcccttataaggggcaatgtctttagggggaagaagaatctctgtatcattccatcagtagcctgtaccttctgaaagctggaagccatggcatcttctcctcaccctcattccttctcaccctggtataggtggtaactgtgggtagagtgtgagtttgagcttggtaggtctgatgtgagtgtggtaaagtaggtactattttgaagtcttgggcaagctagactttatgagctgcttctcagcttctcaagctcaacattgacttaagtcttgtgtgatcctttgggcatccaggaataattgcttgctgcagttcagtaatatagtttttcatgactggcctaggatttggaggaaatgctggtgtaggggagggcaggaaaagggataagatatatccaggggatggagacttagtttacttgaatagggcttttgcatggagaagagtgtgatatgatttcagcagaacttgactttgagggaaatcatttcaacagccaaattgaaagcaagggagtactactgacttaagacaaactcaaatgtttacatagatcagacccccccttaatattaaatcataggtggtttgaaattcacccatactttacagagctttatagcaataatgtttaacatagtctaactatactctcaagcaacaaaaagagatcctgattggatcagtgtggatcaggagtccacttgtgatccagaaagctatgactagtaggagttgttataaacattgcatagttggcgtgaaaggcaattccaaaaaggggagtaggcagaggttggttaatggatacagaagtacacccagatgggaagaataaattataatgtcctatagcactataggctgactataattaacaataatttattgtatattttcaaatagctggaagagcagattttgaatattcccaacacaaagaaatgataaatgtttgaggtgatagatatgctaattatcttgatttggttgtaacactttgtatacatatattgaaatatcacactgtaccccataaatatgtgtaatactgttggttccctgcagattgtagataatgcttgcttatacagatatcattgattaaaaagtagcatcattctctaaactttgttgtgtacttgattacaaagcaggacaaaacattttaaaacctctggctttgaatgtgtcaattaaagataataaaataaaaaatttaagagggggagcatgctatctttattcaacatcagacttgtttatagaaagggatagtcaaatggagaagaggtactagttgtacaaaatgacagggtaacccaggggctcaatgagaggtagataatcttttactctaccttttaatggacagatccatggcacatcacatttaggccttaccttacttgacctttctctttcatttaacactgctaatcatcctccttgatgctatccttcacaacccatcatgcgcccatgccatcttctggaaatctgattgactttcctggtttagctacaacccacaccccaggtagataaaggtccatctgtgcatgaaacttctctcctgaagtatgaattttaaattaccatcttctccttacatatcccctcccatgcgtcttgcattgacctcaaatgtctcatgactaaaatcaacctcattagtcattaccgcaaacttccctctcctatgctttgtcttagttaaaggcccaccatccaaacactcacatagacctgggtgtcaacgtcttccacatcttgattcactttcctgttcttcttagctctcctcctaagtctctctaggatgcattgataatggtgttgatatacacagaaaatctcattgtctcttgcttgaacaactcaaaagtttcctaattccctgctcttaatcttattcttacataatttataaaattatcttccgtctgatggtttcattctttcacatactgtactttacatttcttacagaataatgtccaaactttccaatatggcctacaaagctctaagtaatttgtacagctcattttttaccacttcctcctatcccccaacctataacacgactctctttaactactcacagttctccaaccagtttttttatgtctgtgtatctacatgtattttgtttttctattttactgtctttccttcccttttctgtttagtaaacttaatgttcattttcaaaaagtcaatgcagatgttgcccccactttgaaaaccttttctgacactcctaatgcctgggctttattagtctgtcagtcctctgtgctcccctgacatcatatgtttacttttatcacatttattataattgactctatgttcatctcctcaattagactgcagccctctcaatgataggaaccatacctaattggtgttttgacctcaaggaagtagtgaggaatggagtgagtgaatggatcaacaaatggacagacaaatgagtaccactgtagtgtagcagggcttctgggccctgaagatcactataatcttagaatcagaaacaggagagtgcaggggattgtacagttttggttccaccttcgtagagactagagcttgactagattgtggaaaagtggaataaaaaccttacctgagtccctggctggtactttatgaatgaaaggtagaaaattaggtagaccttttagattcctttctagtatttttgcaaggaaaggctcatggcctaagcatcgattgttaggcctttgagaggagacacctgggttagattaataagtagcaagaaaatgaagcaattcacagaatgcttgatgacaaaaatgcctccctttctgaaaaaatctactgcctgatccagtcgatccaattgttagagttctcacttggctcttactatttcctctgcctgaaacatgctcccttttctccgaacagttccaaggaccaccctttcattgctttctgtccaaactctttgccaatcattaaccgtaccttgaccatccaatggtagcctgaattaaattgttctctaattatttctatgtaggctttatgcatttgccaaggttaggctgttctgtggtaactaacaaacccccaggtcccattggctttaagatataaaagtttatttctcacacatgcactgtttactgtgagttcagtggcccttcagagtagctcccttctaatcagggaacccagatcagtttgatcttgtgactttgccagcttgacacatgggttctagggttgctgacttacagacccatagcctggaagtaagcagtgccatttttcatcaagtccattggctgaaactagtcacatggcttcaacctaactgcaagggaagctgggcaatgtaatgaaacacatggactatttggtgtctgtctctacccctgttagattatatgctcctttgctgttcggaatatgtttctcatcttttgtgtccaccccttagtaccaagttcagaggagtggcacttaatatcatgttgttgttgctttttcccataataggactatttcaaccagaatataatttttaatgatgttataggatgtggctaaatattattaagcatttgaagtatctcttaacacttctttttgttcaagttagccctttttggatgttgtcttccttgggttggaaaaccttctatatttcatgctctatatcccttatattaatctagtcttcattcaccctggaaatgataattacttgacaaaaatgcagtgcatttctgaatgaagcacctcatttgtattaatatgtgattatgacagattattaactcaagtgcatttgaagtatgaaaaaaagatgtgttaagtttattttgttaataagacaaactatgcaacttggaaacaaatttgaatgttggatgattagtttatgtcttaacatttgaggatgtgcatggatataaagggcaggcagttccactctccttttccctgaacttgagttgacttcttcacattcactatggcaacctcaatgatcaacacatacaggagctctgaagtgcatgccaaaactttccaacgttaataatgaataggtatgaactccactatgcaagcttctctgaacgagtcactgcaaagctaatgtaattttagggtgtcgtttccttctcacagtacaccaccgcgaaggtctaatcccagacagcaatctttatggacatttgcttttccccccactacactacatgactaagcccctttggtctccacttcttactctgacattgaccagtatagcttgctttgcatcctctcagtttaaacaaagtaacattggaagggaaatactgttggagcaaacgactttggtataatgcatcttttcctttagtgagaatgcaagcctcagctgccctaatatttaactgaagcagatccccatttgcttatctgtttaattgcacttttatctaggccagctgctgctcctgctgctgctatagccactcctaattggaaggacgttgctgtggtatcctagtggtttaaaactgagagactgctacctagaacctgcacccacattggtatctgaaccgggctcctttataaatcatattttacattttaacataaaagataagctttcaggatacaattttatttcagccttctactgctaggcattttatcacagtacttttacgtgagctgaagattgaccattgatttcataaccaaaaatgactttagttctgcataatattacttaaaactcataaagacaattttatacttgagtagttattattccttccatctatttgggtcagtttaatggtacattaataattattaatgtgaattggaatctattatatggttgtattcctattagagcccctgaaaagacttgaaatcaaagcctctttctaagtattatttatagtttatggtttgctttattttctttttaaaacattgctgtatatctgagtagtgaacatagcatttgtgaaagtgaactttctccaaaatttgatcagtccaagcattttttagttgtaatgtctcacagaaatagcactttagtcacgatgatagggtaccttcaaaaactgtactggtaattacttttctgtggcccctgttgagataggcagtcttactggacattgatgtgtttagtctgaatagaacttcagataagagacaaagcaaattgtgcaataatgtatgaattgagagccacttgtattgaaaaacaaaataggacagaattttatatttaaacaagtaaaaattatttaaattttcacttgaaatttaaagcttccatgaaaattgtttctcttgcaccaataatgcacattgaactctgtgctggcattaaagatggagttctgcaaaggctccaagcacctcagcaacaccacttctcagaattatattaagccagttgggacatgatgaaagaatgcaaggtataaaccccttgagggcccatgagtcaccatctagaaaggttcttgaaaggggaagaatgttttatagtttgatcaataggaatctgagaagtaggctgcagggtaaatataagttgaggattaaaaacttttggaaacttgaagaattgaattacaatcctaagaaagttcccaggagaaaaagagagatacagaaagagagactttttcatcccatctcaaccagcagccaacctttcttctaggtcagagtacagccaaaatagatttgatgataatcagccctaattatctcagctctattgcagaactaaggcatgaacagagttttctagagatccaagtgcccaccatagtagtttcaggtggataccaaaaggaagtaaaaatggggttgcaggcttcaaaacttagagcaacttttccatagaatactccatacaaaaaggtttcttattccattttttcagccagaatgaaactttactttgaaaaatatatgtattttcagtgttgcagttgggttttcctttctctccttaccattattttagtgtcagtgaacaggctattgcattagtgtgggtatgacagtttagattgtgtttataaaggaggcagtctgtttaatggtatagtcactgtcacaagcacaaaagcataaatacaggagcctggctaagaatttctgaactcagcagattctaagagttactgatactcctttgggttttgccttattcttagaaaatttacagaatcctaccatgaaacatgattaaataaaaacagacttctaggagctgctatttatgtggcacactcagcatgatcagatcagagtgcaaacagctctatgccgtatccatgaatgcagcaggcctctccttggcagagggtgaatgtggtggccatgaggacaggaagggatagcaaggagaaaggcaaaggggaagccctactaaaggactcatgcccttggagttgcatccagcacaaagccccttttcaatttttcctatctgggttacacagagaaggctttgtgtagagcatttcttaaagcacccaatcagaaatgtgaggaaagttgcttctcttgatgagacaccagaggaaggaagcaggagacaatgacaagggaggaaataaaggagggatagctaagtaaggtagacagctaagtctagtttgttcccagtgttgtaccagtctcatcagtgccgtgtctgggtctcacagcctctggtgttctatgatggatcctctcttctgccaagagctggccacctggcagccaaaccctgcacaagatatgaagagcctgtaaatgcaggacttctgttcctggatctgctcctctgatgaagaggtgcaagtgtctccgtagctacttgaccaccgtaaataccattgtttcctcttcctgggggtcacccagagaaccctcatggaacatggtgtgacaactactgacacatggggttatcataggttttatgccatgaataatacatttaaagtatgttgtaaaagacttactttgcaaggacctaaaaacacttctatgggaagaatcagaaaaaaataattatttttgaattgaaattcaggtgcacactcatttatgaacactgaacccaaaagagctgaggtttccccaattttggagctcgtgtagaaagctttcctcaatctccttggatggaaaacttaaactgctcccactgtttagcacttcctgcagtttatgactctcagttcaggctctaactcaccagtaggggaatagggatattctggtgtatatgggtctttctgggcaaaccagtgaagcaagtctcacagctgttctgtcaagaacccaaattcccctaacctgggttctaagactgggccagccaaatggcacttttatagaacctcttcccaaaccagcgctcttgggcgatctttcttctgaaacgttatgtgtttccaatagggaggaaaagaagaaatgaagtaactttttgtccaggaatactcctttgtaaaggttgatttcagggctagcaaagatgccttcatagaaggcagttatttgtgaaagccaaggtgatggggtttgaaattgacaaagggatgaggacttagcttttcttctgaaggtgactttctgcccatggatcttccatttccattaatcagaagtattcgttaaaaaaagaaaaaaaagaaaaaaaaaagctagagagaaaagaaaaaacaaaccaacctcctgttccatgccccaggcaatcttcttgtgtaaagcaatctgtggcagctagtcaggtggcctggcaggagttttccccttcaactctggctgggagcttcttagaatctcttaaagaaacatcctgcagagctcccacttaggcctgctctttctgtcctgatgtctctctgtggcatcttttcagatgcttctttagaggatcattttggatggggaaggtataggcctgggcttatgatgatgagggatttcctgtctgtctggagaagttagaacatgtataagtgctcctgggtatggggaaaggaggcaaagatgctgcccaccagttttccaagtgccgtgtgcgcccttatccccagaacgatcctttgctcttctactatagtacgcatttgaagatctcagggcccttataaccattaggcatttgcagggcctgaaatgtaatgaaggaattgttcttcctatttctggaggtaaactaaatatgaaaagaaaattagcattaaaatcaatcctgactcagtttttttttaagttccatctttaactcaaactgtatttctgccaaaattaaaaataaaagttatagccacttaacaaaaaacaattcacacgaaatgttgtactatgtataatttgctattgttacaaatcgtcaatgcagtacctttgttagcttagtgtttttagattcttaaaacgaggcatgttgaaagaaaggttgcatttagctttctcttatgcctataaatttagtgtaagcccctgttttaaggagctttatgtggtaggactgacattgcttaataaacaatggaaaaagttaagcataacctagaagtcatttaaaactgtgagtcactttcctgacaagccaatagggtaagagaaccaaggttgcaaaataattactagcccagcctgagggaccgtggaaatatattacaggtatcagttaagaaaacaaagcagtggtgttttaccactctgcagagaaagctaaggttgctaaccaaacaaaataactttacactgacaatgccaatttttacatttctttcagaacaagggacactcaaactaccagaggtaagattaacattttaaatattttttataacctttgcatttcaagttgtttgctaacttaaccaggcttgggcttttacactgttaaatgtgccttttaaaataaatagaaataaacagaaacagagggaacaaccaagtgattgtgaacaaaatgcaaaagttaaatccaaggaatgttcactgtcactgtccgaaggtcttaggtagagaaaaaatgtgaatatttaatcaaagactgtgtatgaaatgggactgtaagtacagagggaagggtggcccttatcgccagaagttggtagatgcgtccccgtcatgaaatgttgtgtcactgcccgacatttgccgaattactgaaattccgtagaattagtgcaaattctaacgttgttcatctaagattatggttccatgtttctagtacttttccattagagcagaaagatgatgattatcacatcctattgatcaaatgaagatctagtaacatttccttttggtttaacatagagtctcctaatggcttagaagtatgtaatccatgttacctctcagaataaagttactttaaaaatccaaaaaaaagttatttaaaaaaatacagaagatgatgggatatgtaggaagtaaacagcaagttgcccatcattaaatactttcctgttgaaaatactgtcaatggtgttgtttgatgttgtttatatagagttccccaaaattataaaatttcagacagaaaagattttaatggttcccagacaatcattgccttgaccttcaaccaaaaataacagatttcttacctgactgcccctccccacaaatggccatagcaaaacatttttagaaatcatagaaaaataaaatacaaactatgtgtgattagttatatgaaccaaaagtacagtaatctgaaaatttcaaagtaacgatgaaaattatgatttgtaaattaatatctaacaattaaaacctctctttaaaagtgatattagtatgtttttaatccaacatctagtaaaaataagaaaaagtacagcaaaatataagaggtgcttgtctctactttttgcataagtacataatttgaacatataggatatcaagagtgtgatataaagaggctcatatgcacctaatcagtgcatctgttgattatattttaaaacctaaagtctagaccaaagaatgcataacaaggtgatttttttaataggccatatgagtttctttagagctaaaataaattaaccaaagagttcctttagtgtttcattgacaggtaagatttttcactagggctatcaggattcttccagcagtgccaaggatcttgcaaagcagccttctttcactttctcattgctattattatattattgagaaagaaaccttgtagagttctgaactttacctcagtgttacttaacacttatccttttagatatatatattattttttccaaggaagatggtttcattttaattaagtaatgtgaagtgggtgtgcttacagaaagaaaatatgccaataagaagtgggtaataattttcatgtgatactaaataattctcacaggcacttttatactttttaaattacatgtaagcctatgatacaaggaattaattttcacattgatttttaaaaatatataacatcagttttttagtgacttgtttcactcttcaatataagtataatttttatttactgtgtgactgtactaaaaatctctgttttgtgtggatggaggattatagtaagctctgaggctagtcaatccatttggaaacttgagtttgttttaagggagaaatacagcaaactaatattaagaagcagctctcaccctataccaggtgtgttcactctccaaggcagatgattgtatgctgctcaggaatcttctcataagtaaatagtgaaacacttttgtaatttgtaagctctgtgatttttattttttctcctctcttgaagaccttctttctctccatgtaccagtttataggcctcctctgcttccctttcaatagttatgattgtgaattttttttaaattttgcactttatttgcgaggtaggtcagttttcactagccacagaatccgtggggcgtccataaccatacctgggctgtacatctcacatcccattctggagtggaccttcggaaagttcctctggctccaagaagcaagtttatcattgcatacatatttagctactttaaatccctttttttttagagggaaagaaagataaggcaatggtaatgaggcaagaaataactgccaagtgcttatagaattgagtttggttcctgccccccctccccccccacccccccaaccagcccaccattgttaggtagatcaaaggagactgagaaggtcctggagactgattctcatggtggtgtgaagctgtaactgagagctccaggggtggctactagatgtgtcctctcctcctttccgttctcttcctgctggggacaagggcctgtccagctccgtcctagacttttgagaatatagattggggaggggagtatacgcatagagatgacagaatgacaaatgaaatttgcactttaaaattgttcaaaatatgatctgctgaacatctccaggtttttcaatataaaatactttttaggttcttttaaagtataaaaaaatcttagcctctccaaatgcagttggtttaggggcgtgaaaattcctccgatgttattttttaaatacaccagttcatagtttattccactgcacacccttcctgtagaaaggtttctgttttcagagtgactgactttcagtggattttcaggaggaagaacctaaagtataagtagtaaggcaccaaaagagtagaagaattactttgtgtgaatttaaacatttaaaataacaaaaagctaataatctatcacttaataatccttaccatgtggctgtaactgttccaagcatttaaggtaaattaactcatttaattctcactgcaaaacctatgaagtcagtgctagtattatctccattttatagaggaacaaacaggcacagagatataaatttaactgtttgtgttcaaactgaatttgaacttagggagtattattctagaatccattctcttaatacttgcaatgtgtagcctattttaattctaaattcaaggtgtaagaacacagagttgctcttgaagtcagggtccccttttcacattttaagtttatagttcctacatgggactaatttaggcattctaggaatcaaaccaaagagttaaattcatttttttttgccttcctagtactttgatagtagcaggtataaaatcagtagaaagacagcttctattgtgcattaagaagatgatgggatatgtagcaagtaaatagcaagttgcccatcattaaataatttcctgttgaaaatactgtcaattgtgttgttcgatgttgtttatatagagttcctctaaattataaaatttcagacagaaaagattttttctttaaattagtgttctttcatattatcagacatgagtctgtaactcattatgcttccaatttttgtgccttggctaccaacaaatctagagcaaaattttcctttcattcacaatgactcttgttacagcttttctagtgcagctatccatcttgctcaacatagcttcaatgctgattttaatgatcctagcagtcttttacaaatccatgttgaaagtagttggagtaaaaaccaaaattacattttaaaaatttctccaatttgctttcacctgagaaccctgcaagtctgctggatatgactttgaggcccttaggaaggctggaaaaaaacctcatttcatccatttaacttgtgaatgaaaacaacagaaagaaccctgagagaaatccatggctaatgtgtgcttagcacagccaagtgtgctctgaatgaaaccaagtcttcacacacagatacaaaccccaacacataaaaagaaaattgcttttgtgaaaatctagattgtatgatagtcatagactcagcatttcatccagttgcataataaagaagtgaaatcaagcccttcttaattagtgagattactgtagttaggtgggaatgagtttaatgctttagaaataaaatatgtagccatgcattttcatagatttaaaatctcttgttttgtgtttcatctgtaatttttgtaatgcaaagttgttttcttacagattcattttctataataagaattcatttttatgattcacaagctgcatgtctgttttgttttttaaagtgttcagatacaactggtctataattaaaacactattctcatttaagtgttggctaaaatcagagcttcagatctttgttttgaggttgtataccttcttcagtctggtctgtgaggtcccataaatagctgagttagagttttatgagatcagtttaaggctgttgttgctcatatgtcttggctgggaacatattctaaccaagatggctgctgggctttgttctctccatcgtcactatgacttaacaaattgagtcccaatatttggagttggcaaccaaaaagattttttttcttactgttataaggtaccaacaacttatcaagtgtaatgatatacacgtggaagacttactagaaaaacaaataaaacaaactttaaaaccatattctgatcaaatttagtcatactttgacttggaaaatgtgcaacattcatttgctttccaaagtgccagtagtaatacaatttaatagtgcaaaattaccaacacatatttgttttgctttgttttactttactgcacagaaacggaccaatggactgcgaagaactcctaaacaggtggatccaggtgtgtttctgattaaaccttccataattatggcttcagctaagtgcttatgaaaggatatgggaattgctgtggaaagtgaggcatattgttggcctttgttcctcataatttggtgtataatgtgtgaccaggaggtcatggtctaacgtgtaaatcattcacatgagtaactaccagcaactaccagcattgcactctttccacagtcagcagttgagctggttatttgcttactgaacagcctcagggtgcctggttaatgctcacatatccagcaccctccctgtgttcctttgtaaatctagtaagaaaaccagccagctagctgccacttaaaaatcactgttttctaagtaagtaggggagagcataaaccagacaactggtacccaccctccatcagagaaaatttcttaattctatatccatgctattttataatagcagcatgttttttggggactttgtgacaagtttcctctccggagaccaattatttgtctgcagaaaacgttcagttgttttctatttagcattgtgagatttgccctgtcattatgttagtataattatttttcatccattatgcaatgccttctttccacagtttaattaccaaagattttttatgtatgtgatccttttgttgtgagtaaaaggtattcacagttaaaggattccaaatacacgaacttgatgataaaccaaggggaacatgagaaatagagtagctttgctggaaaataatctggactatgtgtttcattttgttttcctatcataagtggtattcacctagttgtaaagtttagttttcaaagcattatagtttataactgaaaccacacccatggtagcattgccagtttatgagctgtttaagatttataggagctttgttgcctctggctagaaattgcctcacttgtgtcctgagactagtttaaatcttttaactacagaacaaatttgaagccattaaaaaaacaggggttctggtttactttttaatagttctgactttcccaagacaatatcctttgcagaggactccctgcaataatatttagaagtgactttctctattattttcagtaggggtatatgactgtgaacataatatttttgtcttattttgtgtgagttatagtattgctgtttcagaaaaattacttaacctttataagtgttatttttttaatgtattttttctttcttctcccctcagggaaatgcatttttgtatttgtagtatgtcaataggaacatatttgactcaaccatttatagccaaaattttctagaatcccttacattatttagattagtaaattcccagattagaaatatggcaaagtagaacaacaataaaacagatttatactcctttatcctaaaggtgatggctttgtataggtacagtttttttgttttgtttttctatttgtccaaagactttagaacttcatgaagaataaacttacaagagaagtgctgttgtatttatgtttgtaagaacatacgtggctgggtgcagtggctcacgcctgtaatcccagcactttgggaggtcaaggccggcggatcacgaggtcaggagatggagaccatcctggctaacacggtgaaaccccatctctactaaaaatacaagcaaaaaaaaaatagctgggggtggtggcgggtgcctgtagtcccagctacttgggaggctgaggcaggagaatggcgtgagcccgggaggcagaacttgcagtgagccgagatcgcgccactgcactccagcctggtgacaaagcgagactctgtctcaaaaaaaaaaaaaaaaaagttttccattacgtataataaatgtatatgagtgtatttttcctttttccatatttttggaaataaaaaacccaaacacttgatgatcttgcctgttgaagctgctgatatagtaagcctatttcttcccacagctgtcttttgatttaggcttgacttatgtatttaaagttgcttgacttttggatttctgcctctttctgctggttagttgcaaagcttctttgttcaaagttaacccttgcttgatgaccagcgtgccttgatcctcatgtggctattgtttagagattttcagacaaaatgtttaaacaagggatcagtaaagttgagtctgcgtagacaaactgcttccacaatgcattatttgctgttagtatttctaccatggaagttcctttgatttttttttatcctacagttaatttacttaacatctccaagtgtcaacacatgactttgcagggcctcacttaaagtggcttataaaagcaactgattaaagagtttaggaggccgggtgtaactacttcaccaggtccaaatttcagagccatgttcaaaggtatattatatatattctctatagcccttttgcactggaaaggaacttaatgcatagtccagtgggtagtaggtgcttaataaatgctacatgaattaataagtgatgatacagtttttatgtatgcattgacattctttctttttaaattcctcctgctgatatgctaatgaaacacagcatagtctagtggtgggaagcatggctctgagccatgttgcctgggcttgggactggccttagctgtttacttgctgtttgaacttcggcagtttgcctcctctctctgtgccatagtttcctcatttgtaaaaggaaatgaataagaggacctaccttacgttgttgttgtgagcattacgtgagctaatatatgtaggccaggcgcgttggctcattcctgtaatcctagaactttgggaggccaagtgggaggatcacttgaagccaggagcttgggactgtggtgagctgtgatggcaccactacattccagcctgggtgacagagcaagaccttatctcaagaaacaaaagagcaagtaaagtactctcaaaggtgcccaagtaaagtactctcaaaggtgcccagtatatagtaaatgctaagtatagcaattactatatcaactaatttatattagagcatgttctttaatattggactttttgtcatgtgaaggagaataatattaaatagaccctgaattttatgttgaatttctgttgaaataagaagctacataatcacagtcattttcagatttgttgttattcccccttaatctaatggctttcatgatcttttgcttatctttaccaataaacatagtcaactgtgatagttgagaggttttttttttggtgaaattattagtgtttgttattgcaataaagaagcaaagaaaaactcccaatattgaaaacatatattgtggggtttattcaaatccaagaaagagtgaactgtaggtttgtgttgtagcttgttagcacatttaaatcattcactccctattaataattgtgattaatctttatagacaatatttgcaaatggctttgctctttattttttcttgtcttctattgtgtgctaataaaagtatcaacttataatcttggctgcttttataaatatagtaatgtattagatgcaaattctggtagctcttttgaatttcttaaatatagcagggaattttcatcagtttgtacttttcttcctaagacagatgttggtatcaggaaaataacacttgtaacagacatatcaattatttcaggaacacggaggtgctaggcctttttcaagaacatgagatcataaatctcaagaaaatctgagcactgatgtaatatttttcacctaaagtggcactcaaggtcaaagttaccaattaaattttaatactgagctttaaaaatttccttctgtctcagtgtaggagatacaagatttatttcagtttgcatgtggcaaatctgtataccagggcatgtattcttttcactgggtccatgtttttagattattgcaaaattgtcttatatttgtggaactcatagcatcctgcatttaagcctacagtcactagcttttaaacacttcaggcgaccattctgtgttgtgctgcctaaagattatgtggagtagatgggaaatgtttaaatagcttacactctttctgatcttaagttattcttgtgctttgtgataaccttgaataataaatgaataggtaatgattaaattgataagagtcctttctgacaactcttgtttctcagatgctcattgttagactcttgattacaaagagttgcatgtggcttagaaaaactgtcttttcttattcaccaaggagatgtcttactgttttgtagcagagacatcttcaaagatggtcacttcctctttcaggtggataggattgacatataacgccattctcatttgttattgtatgaagaaaggaatctaagaaatctttctttcattaccaatttcatttcttatctgacattaagcacaggattgtcattaattataaaacatggcccctttccgcaaagaatttatattcttcctaggaaaggaatagatatagacacaaagttctgattgcataaatgcatgtatataaatgtacatataaaatttttaaatattatatactatttttgtgcagatttattacgtatagcagtgtcttaaaaacaattagtgaattgtttaataaacatataaaaagatctaggattacacaatacatacaagaaagcaaaacaaattgggaaacacaaatgtctcaaattgcttttaagctgggttacatataaatgttttcatttatataaataaaaatttttatactggtttattgtattgaattacaatttaatactattgttcttagtgttttaatttcaaaggattgtgaaatttattccaagtctaaacagaattgttgatttcttttagatttgcttttaaatgtaatgtcaatatgttcaatagagaaattttatatttttgtttccaaatagaaaacattgagaaaaataacaacagagtgttttcaaatgcacttatctaaaaatacattttatctcttttcttttttatgagggagacaaatgcatattcctgaaggttttagtaaatgagcttttgtctataataaatagtaaagtttctatagattagaatatttccatattaatcagtcaaacctgcttctgtcttttctatcacctctaaagctaatttctcatcaaatataaatcttaatctaaatattgggagcataattgtaaatgtgtaaaaatatatttcacattgaaagaaatgaacttgaaaaaactgggacagtaaacccagtgattaagattcattgcagagaaatgagaaatccaagctgtgaacaaatgctgaggagcatgctctggtttttaaaatagccgactttttttcaagcttctatgaaaccatggacaataagactagttttgcactaggacagttgatcttcttgtagtcattttcaggactacctttctgattcccttttccgtgataacagatttctgaaatgagcaccacagcctcttgctcgcatctttcttggttggaggaggatttatttctccccttcaaggctcattccgagttcacaaaggatcactacttctgttgtctggcaggtctgtgcatgccttgccaagcctgtcttttatactggtcaggcaccttcagaatcagaacaaaggtgaggtgaatatctggagatgtgcatgggggtgcttttagatggaaaatatacatcagtaatatgactactgaaataacagaatgtttgaattatatttagaacctactctgggccatttatgcacttctaacaatttctattattgtagtagttatgttttagaagataaagtatatatctattaaatatttagaagaaaatcctgaaaaagaagtaatgaacctagtgagctacttcgaacatttatcatcaataaactgttccttacttagaacgtcagatatggagtggacttcctttgccatatctatggttatgctggttgaataccattccatttcagaaaaagaaggatatgccattgtaatgctaagtagataaagaaaagtcagtaatttcttatgggccagcaacctctgagaggcagatgattttctttcagcacttaggtctgaagtaacttaaatgaaaggaactaactgggtcaaaacatattgactttgtataacaatatttgatgcaaatgatatccaattgatttcaggagaggacattgataaagtaattcttaatataatttatgatcttatttatactacagttctatgtagaaatagcaagattattatcaaattaattagaaccctggagtgctatttgtggaatttctgtcaaaatgactcatattggcaattagttatctttcagcatattcaaatcaagttgacttctaaatttttaatttgaatgaaaataaaagcttatgtttggttcttataattgtttttatggatcgtttttcctttgaggctcattcattttcttctatataggtattagaaacgtggaagttcctctgcctttgaggaacttggaattttgctggagagttaagacatacaaacataacttgtcaaagtaatattgtagagtacatgatgaactaccaaagtgtgtcgtataggttatgaatgatctggttgactgtgaaggcagatgagggagaattttttgcaaactgaaggacacaggacaaggaaacaaaatatctaaaacagacatcagtaaaggtaaatttactagaactacatatgtttaaatgaagttatcagtctgttcctaggtttgggtcagttcaattatataccaaccaatatgcttttgattaccaagtgacaaaaatccatttcaaactagcttaggaaaaaaaaaagttttctgacttaggtaactggaattccaaagcattttggcttcaggcagagatggatccagggactccaactgatatcattagggttcagtttctctttgtgtcttagttctcctttctcctctattggcttcttgtcaacatgcacctcacagaggtttttctcatgtggaggcaaagttgtctgttagcagctcttcatgtacattgtccccacagctggttaattcagagaaaatagaacatctttctctcagtaaatccagcagaatcccaaggagagctttaattggcctagcctagaccatgtgctcttctctgaagcaatcactgcagccagagtgctctgttgattggccagcctggcttctgtgctcacttctcaggtgggaagtgggattgaactagcttgtccacatggaattttttttctataattctgtttacaaatgaataagagagaggaaagagaggcttggttttagcagattaaaatgtacatctattattgtgtgcaacaagtttcagacagttttcatccttgggcatactgtgcctaggttttccacctctcctaccttgtcctttttccatttgtaggatcctctgtttgatagttctctggtatccaaaatggttgatgtggagaagtgaacctaaaataggaactggagattcccaacaaaggtttattccaactggaagctttttgtttgcagtggtaaaagaaaacactaattttcttgccacatatttgatcttcttgtagccctgtcatggtacctcactgtttttagacagtgatcatccttttttctactgttatctactgacatgttagcatagattggtttatcggattagagaactgaggaaacagaacctaacacagcatgttttgtggggacagaattgaagaaaggtgccatccttaaaggaaaggtcagggtaagaatgtgggagagccagatgatacagctcttaaggcattaaatttaagccactacctgcttcacggcaataaaggagtaatgaggaaagaaagagaaggagagatctttttaaattttatctgtattaaacatattcatgcataatagcacttttaatctccaacggtagccctgtgtggtggtatagactgagggttctacagtggcacagatctggatttgtgtcctgcctctctactaactagctatatagtcttaggcaaataaacctgcttatcatctctaaaatggaagtaatagtagcagccatctcctagtattattatgaagattaaatgagataatgaagtatcaaccaagtttagcacatactaagtgctctgaagattatgatgatagtggtggttattgatacatatagatacctgtattttctattgctatgtaacaatttaccatgaatttagcagcttaaaacgacacacatgtgttatctcagtttctgtgaatcagaaatctaggcatggcttagttgggttctgtgcttcagggtttcttacaatacttcacttaagatatcggccagggctggatctcatccgaaggctcaactggtgatgggttcactttcaaactcacttacactgcttttcgcgggattccattccttttggactgtgaactgagggccttatgacctggaacacttggccagaagctgtcttcagttctttactacatggacctactcaccatggatgcttgcttcatcagaatatgcaaaccaagaaggtgatagggtttccttgcaaggtggacattaaaatgtataatataatcacagaagtgacatcccatcacctttgccatattcttttggctacccacattcagggaaggggattaagtatgtcagtaccaggaggcaaggatcattggggtttttcagcagagggaaccaaagttctgagaggttaagtacttcaaccaaggtcacacagcacttggtgggtgccaaacttaattgcagcatatttggctttagagaccttatccttcgacatcttctgtatattttacttatgtcaagctttggacagagaaaagcttatttcctgtggtctagctgtatagttctgtgcaaattagcagtgggatctggtctgattttcagagttcattagtggctgctgttaccaagcagatttatgggtgattttattttatgcattgttaattttgaaaatgttaatctgaaattgctacagtatttcaattaatttgggtgattaaaacttagcaccagaagaatccctaccagaagataaggcagctaattagaggttctgaaacaaacaactgtagacactggcactgaaacacgccatgtgtatgacacccagcagaactcactctgcttaacagtttggaaatggaaagaataatttctgccagtctaaatattaaacttgaatgcagttgaattttttaaaagctattttaaggagttaactatttgaatcaatatatagtttttaaatatcatgcagttctgaaaaactaccttcagattattttgcagtgttggcttttggataactgcagtagtgacagaaatacaatagatatttgttgtccaagtattatttaaaaatgaggcagcatacactttttaaaaaatgacacttgagcttcttttgctagagttttgcattttgtaaagtttatcttaaaatattcggaaaatataaggaagtgtagaaaaagttctctggacaaattacctataatcctctcactcagctaatcaccctgtatacttttgttacacacttttttcctcatatgtttattttttatgtgcagccacatgtttattaaatgcctatgtttccagtttggtattctccttttatcacttaattttgtttcattgagcgaatttgttgattcatttgttctttcaactctttgacaagtatactgacttggtgttaagtgtacaagaatgaacaagatgtgttttccctcacacaactccctatgtcctggagcaaaggtaatggtgaagatttgagatcagggagatacagagggtatacttaaaagaggcatagactttagatatgtgagcatcaggaaatgatgtctaacctggaatccaggatatgagcagggatcaacagcatctaaatggagagaagagggttgcaggcagagggaacagctccaagaaaggccctgagttggagaaggcacaggatggttagggttggagcaggagagccattcacaaagagaatggaaggaaaaccaaggcaggatcttggttgatgcacatcaaggaattggactttattctgatgaacagattgagcctttggaaaggttttatccagaggagtgacatgggcagctaggactggttgaaaagatcaccctagccgcacttgaatcttgagtcattaaatactcttcagaaaaaaggaagtgggttttagtataatttattgttgaacattagtctttctaatttttatttttataaatgctttgaggaacatctgtgcatgaacatacttttccatatggctgattattatttaacaatggcgtcatagaggtacaatatctgggtcaaagcatatgaactcctagattttggatgtagatgttgccaaatttaccttttagaaatgttacattgaattatgtccccacatattattggggtatgagaatatgtcttattttatgcccaccaaccttgtattgttcttttcactataagtcattagataggaaaataatagtatcttactatcatatcatagtagttgataccataatatgaacttccttgatttttagtgagatagattattttaatgtttttggctatgtgtatttttttctgagaattatctattatgcttactccctctttctattcaagatttggtgcttttctaaattacttgtaagaatatatgtgtgtgtgtgagagagatcaatcttacatttatcgaaaatatttttatattttttttctggtgtatttgtttctatataaagttttaaatttaccaggagtcaaagttacagacattttatttatgatctgttttactgcttttatgcttagaaaattttccctcctctgacttattaaacacctacttataattttattgtttaatttttgtagcatttggccatttaacttatttttaagtaataacttatttaacttatttttatttaaggaatagattttaattctgtgactaattccaaatgtacattaaaatgtttttcaggatttacattacaagattttacagaatttaaatttatctttttttttttttttttttttttgagacagagtcttgctctgttgcccaggctggagtgcagtggcaagatcttggctccctgcaacctctgcctcccaggttcaaccgattcttgtacctcagccacccaagtagctgagattgcaggtgtgtgccaccatgcctagctaagtttttgtatttttagtagaggcagtgtttcaccatgttgaccaggctggtctcaaactcttggcctcatgtaatcctcccgccttggccttgcggcgtgctgggattacaggtgtgagccactgcacccagtctaaatttatcttttttgttattgcataacaaccacaattatattgtgtactttttgttttgtgctttattatacacatagcttgctaaaattgtaagttatcttgtgcaaagcatgtcacaatacatgttctgtatatataggaaattacgttttaaacaaatataaatacttaatattgaaatagtcagttttgttttgttttttttggtaaaatatgacaaactaagcctaacttccccaaggattttcagaagtaggaagaaaaatattctatggctctgccttttgagttcagagtagctcctcccgttgttcttatttccttttgtacatatgtgtctccctttattttacaaatcctcctcatcttaatttactctgctgctcctgggagtgagactagacctattattttaaaagagctttagttttagtaattcttcatctaagtatgaaaatttcaacttctactttatttgaagtatgcagtagatatgttctcatttcaaaaacagtgtggagattctacactttcaagttctaatttggcaagtcttatatgtcatcatgaaaatattaggtgtttaataaatagactttcttggagaagtcggttgtaagcaggtagaataatgactttggattcctgcctggcatgttgccccttatgatctgttcacagaacgtgcttctggatgtccagatattaaccgttgtgatcatagctacctcttatatcaaatgccccaacaaaatcgtgtgatgtcttcagttcaggacagagctttccttcttgggagtaagaattactctttcagtttgtctagaggacgtgaacatgattagataaacaaaacatgaaagtgtacatatatttctctacctccacctaccattataggcctaacattatagcttttcactcccagaggaagaaactttgccatttcaaaaaactgtaatgccatgctttggggatcccagatttaaatattttatgcatcttccatttaaattcaagcagtatccaagaacagaatctggccaatgattttgagaaaacgaaatggcaacaccttcttggaacctcaaactgttcaaggatttttttttctagcaaaacaggaagaaattgggggaaaagcatatggactcaggttgagcatatgatgtattttcaactcgagtcggcactttactcatatttgtagtgtgacttaaaattaatttgggtgaagcactcagatttgagggaggaaaaaaaatccctatttgggactaagtcaacatttgtggcatctcattaatcgctgccttatgtaactgctttccccacctaaagagaagctactgggatgagaaaagtttataatattaatgccaagtacagatcttgcctctcccaaaaggagttcattaatcaccatcgaagcacaagaacaaacatacttcatgtctcttgccagtttttttcaataacatttctgaaaggcaaaaaaaaaaatatgtttaatcttcatttgcaaaggttttaatttggctgttatttaatttgtgataatgttatgtaaatttaacatgctctgagaatgcccaggcatagggtatagaagtagagtgtgttggttaagagtttgggcccatggatcagagagatctggatccagattcttggctttgttacctcctctctgtgtggtcataacacaggcaaagcacttcaagctcagtgcttgcttggcacgaaatagctggcaaagagccagcagtgatggaaattcttactcttactggtaggaagcagtatgggcatcaagtttgaaaacatgactttcagtccaagctgctgtgcaaatctttggacaatttaataagcctcagttttctaatctgtaaaatggagatgaaaatactcaccctacccacatacactggcacaaatgatataatgtattaatcaagatagaaaactgaacctagccatggcatacaaaatcatgtcatataattttgaaaagtgcaaagttgtgaaatcatctttattttgccatgtatctcagattctcaactgtaacattatttgggtgatcagtgtgtagtattgattatattttagtgtcagccatgtagttactctctcctctaaggagttttttattaccattcactggaaaatacacagctttttctttgcaattatttctttacctcttttcttctgccttccaatttaaaattcatgagtaatacagcacctcacgaatagatgaaagggatgacaatctaaaaaaaaagaaaaaactaatgtaaacctcatgctggaaaacagaaacaccaatttaaacaatcataaataggaaaaacaaaaaaacctgttgtgcaagaaaaggaggctctagtctacctttatttacaaccatcagctaccgagtatcaaagataggaatggatccatggtgaaattttcaggcattcttgaaaatgtgtttatttctttcttgtctttattagatgtgccctgtctccttcatttctttatttccatggcccctgctactagaagcattgtaaaaagccaaaagaagaacaagaaattctgaggacatgggtgaaaatgcagccttgaggtttctgaaaataacaggagacagacaaggctggtgtccagcaacaatactgggtagctctttttgtccccacttacacagcgaaggataaagaagagatcctatggacacttagtaaggattacttcatgttttaattcaaagtactttggaaagaagactttgagcagagtggaatagcaggaggtttttgtaaggtgaaatagaatgaaagtgcagccaagaatttttctgtcttcaattttaaagaacaccggcataactcatttttctttttttcccctgtgttctttttgaccttcttagcagctcctgactttctcccttggggatttttctctgtatagtcagcgctgactcccttagaaatcctgaaccccacacccgtatcgcgaaagagttgaagagaattcaaataaacacgttgagataagtagcttgtgaactaactgttacagcatgcctctgtaataagatactgccagctagaagctaaaataaagtgaaattccatttaacatgtgacaatcaaaactgtatgtttctcctaaaaatataagctaaagttaatgttagacattagaaattcatactgaaacacctacattcatttaatggtaaatttctttagaattgttagtttcctcctctctagactgtccaaacatagttcctgggaccacgcctgtagtttctttctctcactacaatgaggaaaaagttgatggtttgctaatctcttattctacacatttcattgtactccatgactgcaaattcatctttgtatgatttatatgtcaatcagcatgttggtgaagtagccatggaatgaatgttagagtgatatttgttgatgtactagaggttttacatgctttatttttaatttcacaacaaagctgtgagaggtattatgcccattttacagatgaggaagctacactgagagttgtgacaggtgtccaaattcatgtaagtaataaacgctgaaactgagctttaaaccaaatccttataaaacttccatatatgtgtttccataactagaagaagcattgtatgtttttaactaatttagcagtcttgtaggaatgcattcattaaatcagtgcactttatcagaagatttattttttagccaggctggctacaattatggatcatgccagatgctcaatggagggaggaagtgagatgaagtaggctaaagagaaataatcttggtcagattgaagaaggataagcactcttaattgtcaatatcaaatgaaaggagaaatatgaccttgatgtgaaggcttaaggcagggttgctatcatatgactgtctgggtcctggatgagagaggaccagctgaggtgattggagagcctgggaaagagcttctcggaagggcccagttgggcaaagggcaagcagacactgcagatggcccctcaagtctctgccaaccttgggatgctacgattccaagcaaggaaggaagctcattccacatagagttttagatctttcattagtgtgcctttgattttaacgtgattagaaaataaaatcatagcaaaatatcaggaaatgaccccaaactaatgtaataaatgctgcttctgtttgttttttatactgtcttttcccttaatgtcttcattaagatttgtgtagaaaacagggttttaagcaggatgttgctattttaaataatttatagaggatgattgtttttctgtgttgtgatttgtttgtgtgtgtgtgtgtataataatcctaacataaaccatcatcagcgaaaccatcactaatgatagcaataaaccttatcataaattcatttacattattttgtgtaaaaattgcatctcatttcctaggcacatatggagacattgttggattatatttcctgcattgctaccccattacaggcatgctcttacatgcatgtgtgggtggccagacaatataagtggttaaaaaattagttttgtagttagcattgcacagctcagtgctttttctcactacttagcagtgtaccctagtccatcctttgttactgggggtgttattagcatccaccttccagaatttctgtgtattgattaactgagagactatattgtggaacattagcacagtgtctggctctttgtccatactaataaatggtagatattagcatcacctgatttttgccaccatctatacattcctggagcagaggtatagaaggtgagctaaaacctatagaggcagcttctggataccagactctcgaggccatagccatgctgttgtcttgttttgattttaagtgtccagatccattagagcagaggcagcagtacaagctgctggctcttacatgtttggcttatgatgcctttttgaaaatcaatgatacagaaactccagagctaggctgcctaggtttgaatgcagtcttcactatttaccagctctgtgaccttgctcaagtcacttaaaccctctgtaccttaacttctttaaaatggaaataataagacccacttcatagggttgtcatgaggcttaaacgagttaatatatactaaggtcatagaacagggactggcacataatttatatatatacaaattagctgggtgtggtggtgtgcacctgtagtcccagccactcaggacgctgaggcaggtgaattgcttgaacccaggaggcagaggttgcagtgagctgagatcgtgccactgcattccagcctggtggcagagtgagactccgtctcaaaaaaaaaaaaaaaagtctcaaatgatcttgccatagaagtatgaaagggagtgagggatcagaagccacggtgatcttctgtgctgcttctggaaatagtggctcctggtccagacatcacagatttcacctacctgccatagttaatggccatcacagtcctgaaagcccacacaccaatttccaaattgcagatatcaccttgcttcaggtcactctggcattctccaagaactatatttttgagaaataagacattaactcttatatttttttcccttaagagtaagaacattgttcgttattcatgagtgccagtagccagttctgtgactttggtagctcatttaacttttctggacattattttactcttgacaattggtgggttggatttcatgatttcaaatacctgttcacatcttagtatcctaatattctttctacagtgaagaggaagggtaaggtgaagggctaaaggaagataatgtgtgtggtgaaaatactggcataaaaacctctattcttcaggccacgtggtgttacttatgaacatagtgaccttgggagcattttctgaaaatactcttccccctccctgttttgattctggaatagtttcctttttcctcacaattctaccttccttcaacagttgcatttacagataatatccttcaccgtttgtttctttatgcatcactagtgtgtgtataaagcagagatggcaagagctgccatgcattttggctgtgtgattttgcaaccaggagacgacctagtaggtatgcagcaatactgacatggagagatccctcctccctctggatcaggctgggacagagtgtttctagtattggcctgcaagacactggctctgccctcagcagggatggctgtgtgcagtcaggtatgtaaaactagttagctcccacccttgaccttgtcatatgaccgatcatatgaaagtgtatttgtgagctataattattgaggtatctgccttatctcccttgctagactgatagctcctttgaggacaaacacctggtctttatctttacatttcctagggagatttagtgcagaacccttcacacaaaagtgtttagcagtgctgtaccaaggagggtggatacaatgggagtagtctacctactagtggggaaggatattttatcactgacattgctgagaattgctggcccatgtgataagaaaaaccaaaccagctttgattaaaagacagttttattattgtttttaaattatccccagacaatgcaccccttgttgtccagcctgacatgaaccactctcaacccccatattttcccacaatctaacccttcttctacaccactggtatttagtaaattattattcaatttgtcagctgttgtaatagtctcccaattgttcgtcttgcctccaatcctgacttcttttattgactcctccagactatcagaagaatgatttacctaaaggagagacagcatggcctctcctacttaaactcttcagcgcatactcagaaccagtctacagtatattaactataaaaggcccccaggagctgattcatacctaacttatttctactactcctgcaatagcagagatctggtaattttccacatgtactgaattctttcttgccactataccttgggtcatgctcttgtttctgaacaaaatgacttgacttctctatttactctacttctatatctggttaattcctatttatctatcattcatccatctaaacttaattccagtattccctcttccaagaatcctactttataatactccatatctggtgtgcattgtgggtccctctcccatgacaacattgctatagtattttttttaatggtctgggtgcacatctactttctgcaatctttcataagctccttaataactggagcttcatcttttcatatttatacccatggtatctggaacatagcaggtgatcaggaaatatatattgaactgaattggaagcgcaactttataaaagggaacactggtttgtggtgtgaaaattctttaacctttttgaaaagccgacctatgctgctgcttcttatactttgaaaattaagaaaatggtttgttcaagcactgtagttctcacttataagtaggaactgaacgatgagaacatgtggacacatggcagtggcgaggaacaacacacactggggccttttgtggggggttggggagggagagcatcaggaataataggtaatggaagctgagcttaatacccaggtgatggtttgatctgtgcagcaaaccaccatggcagatgtttacttatgtaacaaacctgcacatcttgcacgtttactctggaacttaaaagttgaagaaaaataaaataggaggggagggcaaagagtgattgtacaaaacaaggtgaaaaatttagaaaacattatgtaatagctaatgtatgcttattaaaccattaagaaagagaagaaaaaaagaaaatggtttgttaatgagccagcagtcctattttactaattgcttatttttgagactaatgtacaaaaataatgaaaagcattacatttgagtattggtgagcccatactatctttgttaatttttttcatatcataagaacaattaataaaagatttcaaacccacagcatcatagaacacagacatgtcttataaagtgatattttgataaattttgcaagaatcttcaagtgaaaatcatttgtctctaatatcaaccacttagagccaaattagaacaataggagtttcatttaagatccataagtagctgcagtagagtattactatgacactatttgctgaaattataaaggggaatttgctggtaccgaaagtcaaggcaatcagatttttcagcggaggtaaaatactaccaaatgcttcattttgcaaattggcatttttttctttgaagctctgaccactttataggcaattatcttgaatcatgtggcatgtaagtctgcttattacattcttctagctataatatgtttggtgaaagagcttatcaaaccatttttttttcattatattcattttcgatccaaagttaccaaggattcaaaaatctagagaaagtttatgggggttacagaagacccagagatattttcaaagcctttccaatagaatactatgcatatttatttttttaagagtaatatttggaccagaaatacttggtttaggacagacatttctcatctttctttcattataaagttattttaatgacccagatttacacaagcctgtaaaacagtgtagaagtctgtatcttagaattccatttgaatatctgcaaagggaaagtatatttttaagttactgaatacactttgcattaggtaattatcaccctcagatgtttccaattaatcctgactaaccagatgaactagagtaacacaatattccagtcttaaatacgttttttggtttatacaagaatgtggatttaccgcatatattcttaaaacataaattcttcaacatatttaaaatatgcttagacttgtaaagaactgtaattgaaaacccagggaagcttcaggaggacaagaccagcctggagcagcccgagaagtcgatgtgcaggtcattgctgtggatagtgagggtttcagtgttggggaatttctgctttctgattgacacctgccccattgtgaaagtgctttcaactgctggagttggataaggttaccaacttttagcttcattgctttgccccttattcatatgactaatatgtctttttctacccattaggcccacagaaagtgtgctttcgttagcgtttttctgggaagtatggtacctcgcagagctttcatttggttagtaaatgttcttgctaaaacgtcagcacataacctgtcaatctggttgcatttgggctataagaagctttaagaccagtggccttgaataaaatccattcaactcttagtgcttttaatgaaatagaaaagataactattgggcctctaaaaacattgatcattgaaaaacagcagcatttgtgctctggaaatgcactgtgtgtgtgtgtgagagagataacttatatccctgtgacattattgtctccacttgaggcagatatttttttttcccttatagaaatcctttcaggaaaaaatccaaactgagcagagtaaaaattgagacagtattcttttgtgcatgttttttgagcttccctaatgttttaactttatagtttttttataaaaacaatttgtcatattttaaaatgcaattttaatcactcggaggaaggggactaggtacatttgtattcatgtcgtgtggggatataagtttgttgacagtctcattttgcaaaatggatttaatgctgaaaaaatcatagcaattcattttttaaaaataacacagcctctttaaatacagtgctctagttttcaaattttaggtctatgccatgtaaacaattattcacattatgaattaaaattctgtttgcttacagagcagcttaattcttttgcttataggcacatagtgacttgaaaatctaagtaataattgttcatttaggagaggaaaataccttcctcaactaatctgtaataccaacttaattttccgtggtaggtagggaaattcggtatcaccaagtcctgtaacatgttagatatacaacagaaccacagttgtaatgatgttgttctaaggacttacagtctaaagccattccttatttgaaatagagaatttgacaacacatatacacgcagaatggccccatattgtcatatttgtacaagcaaaattagtcaagaaatgcagaaaaattttgttaaaattattttaaaatatattctttaatgataaacatgcacatatgctttcatttatttaacaaacttttattgagagattattggacaccaaacactatactttggataaacaattgaacaatttcatggtccctggccttgtaaagcttatattcaagtggggagaaagcaaaacaaaattaatatacaagttatgttaaataactataataaaaattcagaaacacagttgaacaaaggaatgttcagtgtatctgcctgggagggttgcgaagacattgcagaggcggtgcccttgagggattagaatgatccgaaagcatagccttgcactgtggaagtgagtggtttacttcgcggaggatggtagcaagcactttgggtgcataatgggtcgtgcaagagtggcacctcttgtgtgtacatgtcacagagctgccccgtgaaggaggctggtggggactgagctccagctagcagatcctggcatgggaaagtgtctaccctggggcagaaacttttgttaaataatattataaagttaactacataaagtttagaaaatccatataaggaaaaaagttctcataattttacacatcagatgaaacattgttaatattgtggcctatgtctttatggattttttttctgtacttctttatgtgtgtgtgtatatagatatatttaaaaacaaaaatgaggtcatcttgtatacactgctgcttgtaacttgattttttccctcaaccatatgtttgaacattgtgccttccctgaacacttgatgagattatgtccttttggtttgtgcttccgtagcgtttgcaatttttctaatgtaaaacacataatgctttgtaatatttgcctgtataattttccttttccctgttagactctaagtttttgaggataagggaaaaactgccttgtttattatgttgttcacattccaagcagaaaataagcattgggtgtgtttttaaaaaaattaatatgcatagtgatgaatgaatgccttaggaaaagatgaacaaacagaagctgaaagctgaaataccaacaaattatctcctaggatctccttcactttgcagccacagtgaatgatgtgttccataaaagggaaaatgggtgtaaagtgaaagcttcagtctgtcagacagggaggctataaggccagtggtctgccttggcctggtgcgtatttccgtctttctttctgtgaagaaatagatggatgtctataggagctgccacatgagttagtttcttttctagttaccttgtttcaaagccaagggagccaaatctcaaaatgccttcccactcacttggataattaagatgaaaataacaattatataactgtgtagcagaaaagaagtctttaagtttggcaccttgaaagcagtgctcactgttgccactggtactcgaaaagtaatgactctgtgggaaaggtctgcaaagaaaggaatctccctttctgagcattgcagggttcaacatgctatgacctgaaactggaacaagtgagaataaactgggaaagaaaaaaacatggagtggggaaagaagtgagtaaattgaaggtgaattagatgatccgtgggaatactttttagatgccaaggaattttcatttcagttgtaggagagatttccctgatacatcatggcatttctgaagctttcctgtgtcttgaggtgggggaaagggaagtataaatgtttgccattaagaatttggtagtattctggtgatttattcattaacattgtgcggatgagggatggaaaaggtctagtttagccctcaccactctcccttttgtttctcattggagattttattacccaatcaatagattttacagaacactatttgcaggttttaactcatgtataaaaagaagccttcaacaaaaaccaagtgcgggtaacagcatatccttaataccagcatatccttaatactatacataatagctgatgtatagtagaagctcagtaggcatttcctaaaaaatatgactaaatcgggatacatttctgtagattccaagaaggttatgtaaaaatacaaaatatttttatgtttatctacatatatagttaaataaaaataaaagcacttcctcataaaaagaacaatcactttgtcagtgcttctgcatactttaaagaagaaactttggaatcccaggtggttctttttttggacattgtgaagagctgaagtctataggattcgtagaaatgtaagtagttatttttaacaggaccatctgtggccattaatatatttagtaaggtgaatttctttgatgaatttatctaatctccattcgcatttcctatgtatagttttgaagtaacaagtcaggccttttatacttttttttttctgaaagatggtattttcaaaaatatcttaacataaaaatgcttagcctccaggtcttaaaaatataaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcgttaccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacagacaacctacagaatgggagaaaatttttgcaacctactcatctgacaaaggtgtgatatccagaatctacaatgaactcaaacaaatttacaagataaaaacaaacaaccccatcaaaaagtgggtgaaggatatcaacagacacttctcaaaagaagacatttatgcagccaaaaaacacatgaaaaaatgctcatcatcactggccatcagagaaatacaaatcaaaaccacaataagataccatctcacaccagttagaatggcagtcattaaaaagtcaggaaacaacaggtgctggagaggatgtggagaaataggaagacttttacactgttggtgggactgttaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttgaaacccacccaaatgtccaacaatgatagactggatcaagaaaatgtggcacatatacaccgtggaatactatgcagccataaggaatgatgagttcatgtcctttgtagggacatggatgaagctggagaccatcattctcagcaaattatcgcaagaacaaaaaaccaaacaccgcatgttctcactcataggcctgttattctttagctatatattgtattattgtgtgtttcacgttgaacgtactttattgaggccattaatttgaaaggaagtacggttttctttcattagaaagagatattgaagtattgtgcccagtaggtaaattgaggcaaaatggcatttattgaaatgtttacatcctcatataaattctatgccaaaataaaaactaaaacctacattgcagattttctagtcgtatttcctctcgtatggctgtactaatagcaattagttagcaatttctcttccatgactgtactaatgattaagttgttgaacataacatttttaacaacaccagtgaagcacctgaaaatgcaactgaataacaagtatgaaaatgctgttttaatatccagttctgttttatgtttataattaatagaactttaatcataatatgtgttctgtgaatcccagagaatattttgctacaatctttgcatggaatcctgtgttttgctctccctatggtagctgtgtggaacttcagttgacctctgtggtagtgtcatgctagatcagaagtaatacgtccaaagtgatatgaaccactgtggtgtctaagacaatatatacccagaggcaactctcgggacaaaacgtcaaaaaggattaagttcctgtgtataacaattctttcttagccgtccttttctatagtgctcattatttcctgagatagccagaaagggaaaattaagagaacataggccataacatttgaaattcttaaaaaataaaaactgattcttatttgtaggccatgatttaatacatgtggaattttcttataaagtcccctttatactacattgacctaactgctgttaaattgttttgtttcataagctgaagtcttactttaattattcaagatacagaggccgggcgtggtggctcatgcctgtaatgccagcactttgggaggccgagacgggcggatcacttgaggtcaggagtttgatatcaacctggcgaacatggtgaaactccatctctgctaaaaacacaaaaatcagccaggtgtagtggtgcatgcccgtaatcccagctacttcggaggctgagacaggacaattgctttgaacccgggagacagaggctgcagtgagctgagattgtgccactgcactccagcctgtgtgacagagcgagacatcgtctcggaaaaaaaaaaaaaaaaaaaaaaaaaaggattgtcttgactgaaaatgggaaatgtgtaaatgtgttgtgtgttgttgtatatgctgaggtcagaagttaggcttatatgcaggagtaatgtttactctttttctactcttgggaaagactgtcataggtggtcagagaggaaaggacattgcaggcagcacagagagctaggataatttccttttttatatttttatttttattgatatataatagatgtgcatacttttggagtacctgcaataatttgatacactgatatagtcacatcagggttcattgggatatctaccaccttatgtatttatcttttctttatgcttggaacatttgaattgtgctttcctggctattttgaaatatgcaatggattaatgttaactgtagtcaccctactgatctattgaacatcagatcttctttctgctaagtatatatttgtacccattaatctcttcatctgctacctactaccccacttcccagcctctggtaaccatgaatatactctatcttcatgaattccacattcttagctctcacataggagggagaacatgcaatatttgtctttctatgcttggcttattttacttaacataataacctccagttccactcatattgctgcaaatgacaggatttcattcctttttatggctgcatgtatggctgaatgatgtttcattgtgtatatatgccacattttcttatccacccatccattgatggacacttaggttgatttccatatttcggttattatgaatagtgttacaataagcaagggagtgcaggtatcaattgaatatattgatttcctttcttttggctatatacccagtagtggaattggtggatcattctgtagttgtattttttagttttttgatgaggctctatactattttccataggggctgtactaattagcattaccaccaatagtatatgagggttcccctttctccacaccctcactggtgtttgttatcctctgtctttttgataaaagccattctaaatggggtaagatgatatctcactgtggttttgattttcatttccctgatggttattgatattgagaatttttcatatacctgttgacgactaatatgtcttttttgagaaatgtctactcagatctttagctcatttttaaattagattatttgtttcttcttagttgtttgagcaccttctgtattctagttattaattccctgtcagatgaatgttcacaaatattttctcccattctctacattgttgattgtttcctttgctcttcagaagctttttagtttaatgtaatcgtgttctatttttgcttttgttgcctttgcttttgaggtcttacacaaaaaaccttttcccaaaccagtgtcctggagcatttctgtgaggttttcttctagtagtttcatagtttgaggccttagatttaagtctttaatatagtttgctttgatttttgtatgtgctgagatataggggtctagatttttagttctgcatatgggtatccagttttcccagcaccatttactgaagagattgccctttcctcattgtatgttcttggcgcctttatcaaaaatgacttggctgtaaatgcatggatttatatctgagtttctatctgttccattggtctatgtgtctgtttttatgccagtgccatgctgatttggctactatagatttgtattatattttgaagtcaggtagtgtgatatctccagctttattccatttgtccaggattgctttggctttgtgttatgttcaggtgcttttataaactgtgattgaacagttgtgcatgtgaactttgtgctaagtgtcactggtgttttagttgagaaatgaggcagaaataaaagttttatttcagtgtgtcatttctatgtataactcttaattttaccagtggactgcctaccagatgatttataacttcttggcacaatttgttattattttaacattcttatttttctttatagcctacagtttacatttttattgttgtatatttttattatacttttagaatgtaggtactatttcattattattttcatatgattagaagccagtgtatatctaacattttccttttccctgttagactctaagctttgtggggataagggaaaggctgacttgtttgagtagcttgttatgctacatttgaataagtgaaaaccataatataattttggtatttaaagttgattaaagaaactctttatgtagaaaaaagatgggaaactaaaaatttggggagataattagactaaggataaagtgagggaaaaaggaaggaaggtcagggagagagttagtagttttcagattgatggttgggggaaaaatattgaagtatcaaaggacaaagcaataccagtactattcctaaagttaatattcacctacatttcaaatattttacattgaaaaattgtagatgacaaaagcttataggataatgccttaaatttttagtattcccaattaatttataggaaggagacaatatatatttccaatattataatcccagggttgtagagattttgagactaaatctctgaaattcctacaataatctaaaggatttactgttgtctataaaagctatcattctcactagaaaattttgagtctgatttcttttccagctttcttggaaaagagtagtgatgcattcattaagtattgaaatctgaaataagtacttgtgacctttctgtaatctaatctaaacttatttttcttggtcaatcaaagattccaccgttagtgggtaacaaagtgctttttggaaagaacaccacttttgcttttagctagaatatgcaactggacttaagttgcttcatatgtaaatgaaaatatttggctaaataagaaccttctttgacacaggcactgtgctagcatgtagtgttttcgtggtcagaacagtactacttcaaaagaatacacaactcagcatggtttcagatgttttcccctctctttattatagacactgttaagaaggaatgttcctgggaagggagcaattttttcagttaatgtatattcataggtaaatatgttggtggttgacacttggccccagggaaagggaatttaaaggaaaaattttatctattttcaaaaaatgaagacacatagttagcctcctcctatgaaacattggtggctttgaataatagttatacatttgcttgattttaaactgataaatgtatatattcactctgctcatgtctgaatccataggattgtaactaaatggttctatctgacttgaattccttttttcacttcagaaaaaggttaaggaggaaaacttcaaataaaaataagggagggactaaaccttagagttacctgttagatattgtggtgattgcggatcctcagagtttgaaagtggactcatagaagtttacaatgactgagcaggttagaaattcttccaagtaagtattttaattgtagcaccattttataaataaaagactactcttctgcatttcccttgttctatttcagaagtttgttatggaagaatgtttgtaagaagggtagagagattgttcaatttatgtgcatttttctgtagatatgttgatagttgttctctgagctaagggctccatagcctctttaaaaaaaaaaatcagcacatcgaaatgatggtgcagagtcatttgcattctctgaaactttgccagtcagaaataccaattgcacatgctcttcattttagcttataaatcaataaaccctgtctgcatgaatctgaatcttttgggaatgcatctgaatatgctctctactactcaagcagaagatcacaggaaggagggaggtcaagagaacagagaaaaataaagaaaagcaagcaaataattgagtgtataggaaataaaaaagttgggtgtttttctttaacataaatgatgcaagtcatctcatttaaagtgtattcaggatgagtataaattattaagagggccttagtaagaacctttaaggaatatattagcagttttacatgtcaaaaacaattttatttttttggaaaatgtcagttacacttagcatattgatagttgggtagaagcacaaataaataaaagtagtttaaaagcaagtaaaaactaatgatcaagtggcagtttgtttctataataccaataataactgaatatttgtatcattaaaagctaaatttggctatgaaaataaatgtttatcatacaaatttaggcaatataaatatatatatgaaaacaagaggagatagatactaacaagtaaacagataactatgtgaattgcaagttcataatgtagactgccttggctggacctgttacaggaaaggggtcccaatccagaccccaagagagagttcttggatcttgcacaagaactaattcaggtgagttcatagagtaaagtgaaagcaactttattaagaaagtaaaggaataaaataatggctactccatagacagcgcagccccagggactgttgattggccatttttgtggttatttcttgatgatttgctaaacaaggggtggattattcatgcctcccctttttaaaccatgtagggtatcttcctgacattgccatggcatttgtaaactgtcatggcactggtgggagtgtagcagtgaggactaggagaggtcactcccgtggccatcttggttttggtgagatttagccggcttctttactgcaatctgttttatcagcaaggtctttatgacctgtatcttgtgctgacctcctagcgtatcctgtgacttagaatgccttaaccgtctgggagtgcagcccactaggtgtcagccttattttacccagctcctattcaagatggcgttgctctggttcactcgtctgtgacagacctacttgctccaggtatttaaggaaccctaagaaagcatgactaaaaagagtgagcaagtgtgaggctggaacaagatgaaactggagagttatcaggtgccagaaaatatatagggtcttgtatgcagtgaccaggagttcaaatttaattttaagtgcagtgagcaagtttttaataggaaacttattatataatttattatttttttaatcaggctgctgtgtgtaggatggtcaaacattataagattgaatgaggaaaagccaattagaaagacagtgcttgaactgggaggtagaaatgaaggtggcaagaaatggtttgattagagagaaattttagagatataatcaagtatatgtgcatgtgtgtgcacatgcatatttggaagggtggcctttgggagagaaagggtccctccctccctccctccctcccttccttactttgtttcttccttcctttttgaaaaaaaataaataaataattgagataaagagcacaacctatggcaccatggtgtttggtcacagtctagtagatataaactctgtacgaagacacaaaaaaaaggtgctatagtctggtacctacactttatactaaataaatactgttggtgtattgagtggtactgaagcaagaagattgagtatctaaaggagtgtatgtttaaggcacttaaaatgcacttaagggaatgttggtaggtgttttagtctgtttaggctgctccaacaaaataccatagactctgtggtttataaatgacagctgacagttctggagtctaagaaatctacaatcaaggtgccagtagattcagtgtctggcaagggccattacagatggctgtcttctcagtgttctcacgtggtagatggggtgagggagctctctagggcctcttttacaagggcaggaattctgcacatggggctccacccttgtggcctaattgcctctcaaaggctccacctctttcattcatgtccctacaaaggacatgaactcatcatttttatggctgcatagtattccatggtgtatatgtgccacattttcttaatccagtctatcattgttggacatttgggttggttccaagtctttgctattgtgattggaaatcatcattctcagtaaactatcgccaggacaaaaaaccaaacaccgcatgttctcactcatagatgggaattgaacaatgagaacacatggacacaggaaggggaacatcacactctgggactgttgtggggtggggggaggggggggagggatagcattagaagatatacctaatgctaaatgatgagttaatgggtgcagcacaccagcatggcacatgtatacatatgtaactaacctgcacattgtgcacatgtgccctaaaacttaaagtataataataataataaataaataaataaataataaaataaaaatttaaaaaaaaaggctccacctcctaataccatcatgttgggaattacgtgtcaacatatgtatttgggggtacataaacatttagtctatagcaatgggtttattagtagaaattatatatgagttttaaggagtgagaatagtagttcagattattttttcccttgggttggtggatgagctgaatattcagacatcagtaagtatatgccaggaagaaggtaaagtatgttaatgagaacttgacctgttcaataaatttcaagtaattcacagaatgagtgtaggaaaggagtaataaaatgggccagaccctcaagactgcctattatcaagtttaaattttatccattgctttcatgcagtgtcactgaccttttttctgtccctcaagtactttcaagttctttccagtttcagagcattcacgcatatggctcagtttgcctgttacatttttcctcccaaatgcctactgtcttctcctcaggtcttaaccctgacctgatggcctacccttaaataaagcatcccccactccacacacacccctgtcactctctaatccagaatctctttctaagtggttctttatgatacttttatctggtattattacattgattcacttgcttttgtgtttgtctcctccactaaaatatgagctttatgagggagggatgtagtcagtcttatttatggtagcattcacagtgcaaagccaatatcaatgcatgaatgatctgtaaatatttgctgaataagtgaatgaacccatagaacaaagaaggaaaattaggttcttgcaaagtgcccttaatcatttttacttttacgctgttatcttctcctttagatatcctttatgagtggactgataatggttcattttggttgcgagaaagaaaacatgctcagttgctctgggagctgggtgtttatggtaggaggttaacaacaacaaaaaaaaagccaaggggatcatctcaataatcactctggacctcagtgccttagaagaagggaagagtacaggaggctttaagggaatctttctggaccaaccattttataaactagtgatctcagtcatcttttgtttacagaagtcagaaattgttctttgctgacttagatatctgcctcctgcttccatgttctgtaagagcaaatattcttcaatgagtgctgctcctttagactgtctctcttggcctcctcttcagccgctggtgtctcacatgttaagcctatttattgcagtctttgagttaagttaatcaccagccctgaattacttgggtgtagtcagatgagcagaataatgtggtttaggtgataataaccttatgtagaaagaactccctgtggctgctaactcacacgtccacagagctgcatacagacgtgtcaggctctaagagttctacagattgtccaatacagtgcttgctttttttttgtttgtttgttttttgagggcttttgaggctgtttttagaatatattactgggagttattaccttcctcctggaatttgcctagtattggtgagctctcagttgttcaccacttgaagaaaagttctacctcctcctttcctgcttcccaagataacaccagacatgtggcgggtactcagatcatcctgaaacatacatcagccatgtcaagtggcctcttttctaccagtctcattccctgtaggttgcatagaatgaccaacctgaagtagggaagcctgaactaagagtctataaattggatttttgttccatttttgcttctgattagctgttgactttagacaatttattttagtatttagttttataatgtgacaaataaggtggttagactaggtgacaatactctgtaaaattgtgtaattgtgttctttttctatctttaaagaagatgataagatagctcagggctatgcttctgaaactggattccttacatccctgggaatagctgtttgccaggggtctgccaagtacatggcattttctcctgaagctttgaccttaaatattttagggaaacattttttccaataaaatgtacatgtataacagaacagaatgttaaatttgcatggattttcaagtaacacatgaaattttatagttattttatatttggtagcctataaacacctttttaataaaggtgaaaaaaacttccaaagacattatcatatctttcatccttgattcatgattcactaatactccagtagacagtgccaaagagtgactagtcagtggttatgaagttgaaggaaggcatctctgcctcatccttgtttttatatgagctgtgacagtgctatttccattatttgagtcatcattgtttataaaaataatgtaggcttctctggtgaaaattttaaaaattattgatggggagtgttccctttgtgaacagtcagttctttagaccagtttgttttccaccaaattgcctgcttctgttgtagcatggaatttttccaccaaaattctatgccgtggttccttttactcctctctgaagaccagcagatcaatgaaaaagtcatgctttcttagaaagagccctataagctgtgatgtcaggggaatcccagcacctagcatcccaggctcaacctgattcttaggacctgattcttagattgtgaacttgtatcaggaaaggtccagatgttaatttataaagggttttttagttgggaggatgacaggcagcacttatttcactgtaattttctcaaaagcaaatttggcagtggtaggtgttggtcatggtgttttgcacatgtacccacaagaatgtgattcccaaacttggctagagtttggatgtcacacctaggaaatttatagaaaaaataatgtacatgttttagggtcctacccaagaattatgaaaggaaaatttctgaaaatttttatagatatgaacatttatttgttttaaagttccctctggatggaggtccatgcccagttgtattgttatctcagagttcacctgtctgtctattccatggactgactataggctgtttgaaggcaggatactttcccttgctttcttctgaaactgccatgcccagcacttatggaatgctgaagtcacatttgatgaatgaattaatatgttatgcttgtgatcagtttcccaggataaaacatctacatgttctgatatcttgtaaaactaattattttttaatgtggctgtgtttagattttaaattgggcctcagaggtgaaaggctagcatattacctacagcccatttatctagtaggcagtactctcctctaagttattgcctcggggaagcccattgcattagggcagtgataacagcatcatgaatagatactaatctatgttgtagcaatcgctcttcttgccctgcttggaagacacagtggttgatgctcctataattagctgttcagttcattgaagtttgaaagtttatgtgaaaattatcagtgaaacaatttatatctagaaaattttctaatagggttctacttagaattaacttttaaaaaaagcacatgtgtcatttggagtgtgtcactcttagcggtactaaattcagatttgaaaggaaattttgtttcaggtcccccttttaaaaacacttctgtattgttttgggaaactccagcattctgcatacctacatgtagctttagttttatttaaccagaaacacacgactattagtagagtgtaactatccttttaatattgctaatttgtttgttaattcctcctgcataagtttgacttgggcattttgtctgatgtaagaccaagcacaattactaatgtgagcaaaagttaatgagcaaaattgtcaagttatatattaagggcatagttagctgtacaacaaagcttttgttgtaggggataaaacaaggtaaaataattaaacatctggcaggagatctaattttggcttagtattttaatcatattctcttggataattataattgattatataaaagttttaggaacttctaagattgcccaaatacatatggtgaaagtacatgtgattattttgcatttaatgtctgaaggtagttgcaatataaatattcatatttgggtgagcaacactgtaactcagctaacacatctgttgtaaataaattctggagtggagagaaactaaacaattgttgggtctgtattttcccaagaagagagaagcaactttctgagattagttgtgagtttataatataatgaaatgtgtatttcttgtcattttttaaggaatatgactgtctgtttccaattaatcactgccagtgaggaaacttagagttcaagttttgtagtttacgctactttgcacctcagcatcctttgaagtatggtagccaagggaaaatatggagttttttaaggaactggtgattttaagcctgaacaaattttgaaagactaatctatgaaaaggagatttgccatcttcagcataattccagatggaaggcagtaggtcaatggagagaagttacgtagagatttttaagtaagtttcaagaagaccttattaataaactctgcaacaatgactgagttgtcatggggatgtgtggtgaatgttctgccctggacatttttaaacagaggttaaaaacctatcagaggcatattttctaaggggagaagaaaacctatattaaattaatactaaatgactgttcgaaatatgaacatctgtaaatctaatttattctccgttcttgatctcatttgtgaagtgtgatgccttctgtggcagtagattgtgttaagaattttattgatgattgaatgctgacgtcaggtttaacccatttcctcttaatcgcaattttttgtcttccagttaatgtgagtgtgttcacattcttagcaatgtaatggtgcctttttcataagtggaaagatattaaagggcattttggatagcaaccatttatcccacctgtattgtagaacacctactatatgctaaaatcagaagcaaagagcaagttgtcagaattcattatatcgctgtgcccttgtttcattccttttatcctttgatctctgtacccctgacaacagatcatgctgaaattggaagtgctgacagtaagaaataaattgccaaagataaccctaacaaatgaccaaaaaaaaaaaaaatacattccattatatcataaactcacaacccattccacaaaaaaccatatgagttgaagaaacactatactttgtaagttgattatggctgaatagaggttaatgacaatgtcctagtggctatttcctgggcttaagcataattcttggcaagggttacacatttttgctttggggaagaggtcagcaacatacctatagtagtgtgctactaggtgaacttcttaaatgaagctcataaccaagaagaaagcaataccagaaaagatagagtaaataaaaaacttaggaataagtgggactagaaaagctagaatagctaagtcctattacttgaccagagtatactagtgtatactctgtatactcgagtatacagagtatactagtgtatacatactagtgtatacactagtatgtaccctttgtaatgttaaatataattttacatgttatgggcatgtggtgggcattccagtccatctacagaaagacatatgaggcagcattgctccatccctaacaccttacagcctcttatggagcctgggcatttctgtattttaatccctaatatatatttgggtggtgaaatgtcatcaaagttaattttttcctaaacactctgtgaattttcagttgtttcttcttaagaatgattgacttgggcatgttggcaataaagaaacagctctttccatcatttgtcacatgacgctgctccctttttatccctgtggctcttggcaacagaaaactgcagtgaagtccacggctcagaactggccccagtatttgagaccacatcagctctttgaggtttaaaagatcttctttcttgacttccgcctatatttaaaactgtcagaaaaacaaaattacccagggagtctaccaaacaagatgctttccttgccctaggtatgctcaataaaaaggaggtgaactgcaattctctcccttaaacacggagttaactatcatgcaaaccagactccatttaaaaaattattccactttatattacatcctcttccacctgttggagttcttaatcacttgtgtatgggatatttaggtttcattttaaattagcagtagcaacttaatagaatatgtaaaataaactctctatactaaaggcatttgcagtgtattgagagcaagtctgttaaacatttaactgagaggagttctcttatagagtgttgtttaggggaaagtcaatgaaatctgctgttggtgttagggtgagaccttataacatctggtagggaaatgctccatgaatgtgagattaaaatcatccctctgggggttctgcggcacaagaacagaagcaaaggaggatgtagcaactcctgacaagcctcagcagtcccagcagctaaactggggtgaagggcacagtgtttttcaacctctgcctcctgattggattgataaacaagtgttgactaaaacttttctagtctgttcagtttatagccacacttgtttttctccctctggcatgttgttcaaaagaattttgaggactttaataaactgtttgctgaagcatttcatgtagcttttgagagttttctaggtaacttggacatctagaactgaatgacagtcattcatccttctttacatgtttagtgcagcattttcagccagttacagcttcaccatggttaatcattagaataaaaagtcctgaagcttaataaaggcttcagtccttaaatgtgcaaaaaatatcatgtttatgagtggacctctcttagttgggagcagtttcacctgtaaatgaataagtgactgtgaggttgtccattgtgaccagtattgctgcacctagacccatgttcaattgaagctgctgttctctcaaaaatgaaatcgtgaactgaggccttcattgcacattcaaagaaatacaaagagaaggaatggatctgtatttcaaatatcattggtgctattggcttagacatattccctttattgggtctgttttgcaagcctaaatttgagcctgaagagtttctccatatgaatgtcttaagtattgcagtggcacatccatcacctttttgcttttgaattacaaagataaccttaagatatgatccatatactgggcaatgtgatacatacacagaaaggatgagcctcctcagtgatgaaatcagccagtgcccaagaggaaagtaataggcagaaaggatagagttgatgaaaaaattgattcttttccattaaactgtacgtgatgtgttttttatgaagcaggcatcagctgaaggagaaatattttttcaactaaaaaagagattgatggtaagggagaggaaaactatgtcagggatcatgggataaatatgtgtcttattctattaccatctcatataatgagaaagttgaaaatcattctattatagttacttaaaatgtttacttggacttggtggtattaacactttttaatgttaataatgacattttttgtaaagttcatgtagacttcatgcatcattgttttctcaattctaaaacttgtttggcttattttcaggtttaccaaagatgcaggtcattaggaactattctggaacaccacccccagctctgcatgaaggaccccctttacagctccaggccggggataccgttgaacttctgaaaggagatgcacacagtctgttttggcaggtactgttgttgcaggaaaggggtcctgatgcagaccccaagagagggttcttaaatcttgcccaagaaggaattcagggcgagtccacagtgcaaagcaaaagcaagttgattaagaaagtaaaggaataaaagaatggctactccatagacagagcagccccgagggttgctggttgcccatttttatggttatttcttgatgaaatattaaacaaggggtggattattcatgtctcccctttttagatcatattgggtaacttcctgacgttgccatggcatttgtaaactgtcatggtgctgatgggaatgtagtagtgaggacgaccagaggtcacttggttttggtaggatttagccggcttctttactgcaacctgttttatcagcaaggtctttatgacctgtatcttgtgccaacctcctatctcatactgtgacttagaatgccttaattgtcagggaatgcagtcgagtaggtttcagcctcattttgcccagctcccatttaagatggagttgctctggttcacacgcctctgacactatccgaattacagtttgttagatttaatgcatgatttattactgcttaaagaaaaatgactcttgtctttagaaactgcatgctttcagcttcagaaactttacatgatatgcggaaaatattttttattaaccttttttatatttactaatgccaaagttgcaacaaaaattggaacactagagaaaaatactatcagtgctgtggggtcataattatcatttttattaaaaattcctactttaccagagcattttttccaaaccgaggacctctgggtatgatctaatttgcatggctttaatatattaacagttcacttcaggggaactacctaattagcttgcctgtggccatttctgaccatatttgctttttacctacccacagtaatacctggagttctcagaggtgctctgggcattattcataaaatctatgaaatgtgaaaagtaagtgagcatgttgatgtttgcccatgatgaaatctctcttggccggtggacctttttatttggttgaaactttttttgaacttaggtaaatatggtattatgttaagattgagtaaagctgttcattaaattctcgaatttcatgtgtatgttagaaatatttcccaatgatgttgaggaaagaattcgttaaaaaatctattgtgcattgagggaaaaataagtgaggaccaacagaaaggttatcacgagtgaaatgtggttagaggtaaaaagagagaaatcagagaaaagactgttggataataatcaattgtgcacatgcagaagggacagctattttatttgcttacatctattttattgtctgtcatcttgttatataagaatgcccaaagattgaacgtttgtctctaaccaccatttcaattgtggtagccagtgatttttccaaagctccaccattcttcttaagtatcccactccttccaaacttcatccttcccagaaaaagaaaagagagaacaacagacttgaattctaccacctcttcagaccacttctgtgtctgtcagcttaaccagaaaacatacttgcatttgtagccataaggttcctcacattcaagacttatctttcttcttggactttttatcccgtattccatcagctggcttttgactcctaaattttcaacttcattctctccactggctcattttctatagtatataaatatgctcagtctcctcccatattaaacacataactcagccttttgtctggtcatgccagacactctttcaccctcttcctctccacaaccaaagctaagcttgttggggaagtagtctatgctcactttctaccactccatgtcctattcataagccagcctcttgcagaaactactccttcttggatcattagtgcaactttatataaaaacagctttgagatggatggtaaactgtgcatagtttaagtgtacaatttgataagtttgaacacacacatacgtacatacatatatataagtgaaactatcactataatcaggataataaacatatccaatatcatccctaaaagtttttgtgccccttggtaatccctccatcatgctccttcctgttgctttgttccgccttgcgcaacaaccctcagcaaccactgttctgctttcagactggagatgagtttgtatttttttagaatttgatgtgcatcacatagcatatattgttttttgtatggcttatttcacacaacatgattatcttgagattccatcacgttgttatgtgtaatgatagttctttctttttatcgctgattatcgttccatgtgtggagatagcacaatttgtttacccgttaacctgttgatggactttcaggttgccactagtttttggctattgcaaataaagcttctatgaacattcaaatataattctttgtatggacataatgcttttatttttcttagatactaatgccaagaggggaatatatagatcatatgtagatatacatttaagtttttgagaaattattaaattgttactcaaagtgcctataccatgttacatttctcccaactgtatttgtgagttttaggtgcctcttatccttgccaacatttggtgtggtcattcttttttttttttttttaaatacagggtcttcctctgttgcccaggctggagtgtgtggtactacaatcgtagctcactgtagcctcaaactcctgggctcaagccatcttcccatctcagcctcctgagtagttggaacaacaggcatgtatcaccatgcctggctaattttttagagatagtgtctagctaagttgcccaggctattctcaaactcctggcctcaagcatccctcccacttcagcctgccaagtagctaggattacaagcatgagccagtcttttaaattttatttattctagcaggtatatagtggtgtctcattgcagttttgatttgcatttctttaatcattaattcattaataatgttgaacatctttttgtgtgcttgtttaccatctatataactttgctggtgaagtgcttgttcaaatattttgtcagctttttaatgagccatgcatttttttattatttggctttgagagctccctagatattttgggtaaaagtccttcataaaatattttatttccatatgcttctcctaatctgtggctttttttttattctcttgataatgttatacatagaacagaagtttttacctttgatgtagtccagtttgttaatttgttctttatatggatcatgctaaaggtattacatctaacaaatctttgcctaccccaaagttacaaagacattctcctttgttatcttctagaaggcttatagttttaggttttacatttagatttatgattcattttgaggtttttttttgtatatggtactaaggtttttttacatgtggatatctaggtgctccagcagcatttgttgaaaacgcaattatttctccactggattgcctttgtaagtttgtagataatgtgttgtccatacatatgtgtgtatatatatctttatgtgtatgtgcacatatatttatatgtactatatatgtgtgtgtatatatatatctttatgtgtatatatgccgtgtgtgtgtatctttatatgtgtgtgtatctatatgtgtgtgtatatatatcttcatatatatgtatatgtaggtctgtttctggactgttattttgttacattgatttctttgtccatctttgtaccaatgtgatgctgtcttgattactgtagctaataagacgtcctgaagtcagacaatgttagtccaaatttgttcttttccttttttcataggtgttttgggtttccttggtcctttgcatgtcaaatgaattttgcgatcaccttgtcaacttcaccaataaaaaagcttgttgagattttgattggaatctcattgaattgtagatcaatataggaaaattgacatcctaacaagactgagtcttctaatcactgaacatactatactcctcatttatttaggtctttaattctcagaagtgttttgcagttttcagagttaaggtcatatacatcttttgtcatatttatctgtaattatttcatatttcattttgatgctattataaatgagttttaatattttaatttatgttgttcattgtgagatatagaaatacaattgatttttgtatgttgatctcttattctttaactcttattaaattcagttgttcttgtagctttccttttgtagagtccagcagattttgtaatatagacaccatgttttattcttcctttgcaatctgattgccttttatttctttttcttgacttgtagcaatggctagaatgtccagtaaaatgtcaaatagaagtcatgagagagtatatccttgccttattccagatcttagaggaaaaacattaagtctcttaccattaagtatgacattatctgtagtttctcataaatgcccttcattaagttgaggacattgccttctattcctagtttgctgcaagttttcatcagtaatagatgtcagatttttctcaaatgctcttctgcatccattgaaatgatgatataatttttgtttttattaatgcggcaaatttgactttcatatgttaaatcaatatttattttctatgattaaatcccaagtggcaattatatattatcttttttatatattgtttcattttcatgtaatacctttgtctggtttggataataatgtaatgttcaaggaatgaattgggatctagtcccttctcttcaactttctaaaagagatttatagaattagcattatttcttcctgaagtgtgtcgtagaatttactagggaagctatctaggcctagagtttccttagtggaaggttttgttttgttgtttgtttgtttattttgagacggagtctcgctctgttgcccaggctggagaggctggagtgcagcggcgggatcacggctcattgcagcctctgcctcctaggttcaagcaattaccgtgcctcagccacatgagtagctgggattacaggtgaacgtcaccatgcccggctaatttttgtacttttagtagaaatgaagtttcaccatgttgcccaggctggtctcaaactcctgacctcaagtgatctgccctcctcagcctcccaaagtgctaggattacaggcgtgagtcagcacgcctggcctagaagtttaaaaaaaaaaaattataaaacaaacatatggctattcaggttacttgcttcttctcctcgagtgagtttggtagattgtggttttcaaggaatttgtccattttgtctaagttgtcaaatttaatggcatgaatttttattcataatatttcttcattatccttttaatgtctatagaatctgtggttgtattatccatctcattcccgatatcagtaatgtatctctttttgcctggtcagcccgactagataggtatgcattttattgatcttctaatagaaccagattttggctttattggttctattgtttttttcccctatcatcgatttctgctctgatttttattactttctttctattcttttgggcttaatttgctcttcttttgctagttcgttaaggtagggtgtttgctcactgatttgtgtactttcctttcttttgctagtatagttagttagtactgcaaatttctttctaagtgctactttgctgccttcccaaaattttgcaaagctgtttattttcattttcagtcagttcaaaatacagatggtccttgccttatgatggtttgatttaatgatttttcaattttatgatggtgtaaaaatgatacacatgcagtagaaactatacttggagggcccatgcaaccattctgtttttcactttcagtacagtattcaataaattatatcagttttcaatattttattataaaataaactttgtgttgtattattttgcccaactgtgggctaatataattattttgagcatgtttaaggtaggctaggctaagctatgatgttcagtacagtaggtgtattaaatgcatttttgacttatgatattttcaatattcagtgggtttatcagggcataaccccattataagtcaaggagcatctgtactttctaattgctctttcagtttcttcttatagattgcttaggaatacattaattagctttgaaatatttagggattgcccagacatatttagaattattttatggcccatctccactgtggagtttctattctaatctgctgttgcatgatatctgagattaccttctaactgatctcacctccagaatcttatggtttattgtggccataatccacatcactgcaaaattcaaatgcaattccataatttcttgttaaagtctttcagtgtcttccttctaaccaggcagaattgcctcttatttattctttccttatagtaatgatgacaacaatagcaccaacaactaatgttcactatgcatttttatgtacaaggtagagttttaagaatatctttgttaatacccatgatactaatgaaaattctataaaatgaattactattattatcctcaatttatagatgagtgaactgaggcactgtgaggttgaatagtctgcccaaagacacacagctagtaacttagcagagctgttattcggacataggaattccggccaagagtccaatctctttactattacgctctagcacttcttttacaatcatgttatttatgatgaagctcatgctgccttcctaaacttcatgcaccttagggatattgggatggtggctgtctttatgctaattaaagaaactagttttgtgagtttctttcactgtcaccatcaaatttgtggcagtgtttcagttttgtgattttttaaaaaatttattttattatactttaagttttagggtacgtgtgcacaacgtgcaggtttgttacatatgtatacatgtgccatgtttgtgtgctgcacccattaacttctcatttaacattaggtgtatttcctaatgctatccctcccccctccccccaccccacaacaggccccagtgtgtgatgttccccttcctgtgtccatgtgttctcattgttcaattcccacctatgagtgagaacatgcggtgtttggttttttgtccttgcgataatttgctgagaatgattgtttccagcttcatccttgtccctacaaaggacatgaactcatcattttttatggctgcatagtattccttggtgtatatctgctacattttcttaatccagtctatcattgttggacatttgggttggttccaagtctttgctattgtgaatagtgatgcaataaacatacatgtgcatgtgtctttatagcagcatgatttataattctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggcaagtgatgatgagcattttttcatgtgtctttcagctgcataaatgtcttttgagaagtgtctgttcatatcctttgcccactttttcatggggttgtttgtttttttcttgtaaatttgtttgagttcattgtagattctggatattagccctttgtcagatgagtagattgcaaaaattttctcccatgttgtaggttgcctgttcactctgatggtagtttcttttgctgtgcagaagctctttagtttaattagatcccatttgtcaattttggctttcattgccattgcttttggtgttttagacatgaagtccttgcccatacctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcatttccctatttcttctttttgtcaggtttgtcaaagatcagatggttgtagatatgtggcattatttttgagggctctgttctgttccattggtctatctcactgttttggtaccagtaccatgctgttttggttactgtagccttgtagtatagtttgaagtcaggtagcatgatgcctccagctttgttcttttggcttaggattgacttggcaatgcaggctcttttttggttccatatgagctttaaagtagttttttccaattctgtgaagaaagtcattggtagcttgatggggatggcattgaatctataaattaccatgggcagtatggccattttcacaatattgattcttcctacccagttttgtgattattatataacagtttattatttctcataatgctatgggtgataaggtggttcttctgcttcagttgatggttggggtggtgggagcagctgtaaggtctcgaatgcccgtgtccacaggattggcagttagtgttagcctctgtctaggaactcagcagaggctttctgcacgttgacctcttcagtggttccttatcttcctcacagcatggtgatcgcagggtacttagacttcctatatggtagctggctcccaagagtgtaaaagtggaaactgctggaccttcttaagcctaaacaccagagctggtgcagaattacttttgccgcttttttttggttaaagcaagacatggccagcccagatacaagaggaaggggaccataccaatcaaataccaggaggtgtggttcaccaggataccaaaataacagtgtgccacagacagaaaacattttgaagccgcatgagcagccctaagaataaaatggttttgtgagctgttccaagggcactgaaagccaatcagtttttcacaacaaagaaagagacaggaagtagtcaagccaaacacaaaatgttgaagatcttggtgcgtataagtggcttgcaaagtgtggtgtttgagatcactctgaaggtcatgcaggagtcctagaaccatgcctaatgtatgcttagaggcatttagctttagaaagataattttggaattcatatttttctaaccaagctctgtttcttttcatcttttttttcttaaaccttagatttgtaaaacttaattatgtatagtatcttttttcatttattcactaatttttcctatcacaggtttagatggtgctttcaattattttcatgttttgagattcattatttccttcattcctcacagccacataatgttaaaagtagaactataattgagattctgtgacaactagcccagtgccattttttactaaatactactgcctcctattctttctagacaaaaagacattattagttgtcatttcctttcagcagcctataaacttgaagattttctggtatagtattagaatggttttggagacacttaggagaatcataggagaaatgagaacccatggatgacaatatatatgggtatgtctggggtatatgtaatgattagaaacaagtaaggctaatgtttagaacagagaaaaacaacacatttatttcagatagcaagtatgcattgagtgccaactctgttcactactcagacactgctaacacttcaattatcagttcctatcattggtttgacattaggtctcctgtctttagaagaatcattttgcttgccagcagccagtaatatgtttgagtttttgcacacatatttaaagttcatctagtgtttcccatacagatgtaacttgggtcagaattgcgttatggatacttctaagccaatcaaagaatttttagccagcaaatgctagttttattgaaatgaaccactggcagtatgagaaaaactaaattcaagtcatgtatctgtagccaaatagctatatggctttggtcaagtcatttaatcattatgtagcttagtttcttcatgtattacctgagtggggctataccagagcagtgcttaccaccctgactgaatcacctggggagctttgcaataatgtcaacacacagcctcacttccagagattaagacacagatggccttggttgagcccaggcataagtagattttataaaaccccagatgaatctaatgtgagccattgatttgattatctaattggtaagagaccatggtaattttgacactatccccagctcaccagttggtaattggtattattaaacgtagctacaaaataaggtgttacacttttacactgttggtgggactgtaaactagttcaaccattgtggaagtcagtgtggtgattcctcagggatctagaactagaaataccatttgacccagcaatcccattactgggtatatacccaaaagattataaatcatgctgctataaaggtacatgcacacgtatgtttattgcggcattattcacaatagcaaagacttggaaccaacccaaatgtccaacaatgatagactggattaagaaaatgtggcagatatacaccatgaaatactatgcagccataaaaaatgatgagttcatgtcctttgtagggacaaggatgaagctggaaacaatcattctcagcaaattatcgcaaggacaaaaaaccaaacaccgcatgttctcactcataggtgggaattgaacaatgagaacacatggacacaggaaggggaacatcacactctggggcctgttgtggggtggggggaggggggagggatagcattaggagatatacctaatgctaaatgacgagttaatgggtgcagcacaccaacatggcacatgtatacatatgtaactaacctgtacattgtgcacatgtaccctaaaacttaaaagtataataataataaaataaaattaaaaaagagaaagtatactagagtggaagaagaaaataagagaaaatttagatgtctccaaatttcttattcttttaccagttttaatgttatataatcttacaaatgtactgtgtagggaccatggaacagttagctgactctgctaaacatgtattatgcctgcattttagtaagtttacaattttagttataaaggtttagtgataaaattgtaatactcatatttaaatgtattatgataacaatgcatttagtataaatataaattttatatatctgtaaataaaacagtatattttatgtctcaaaaaaaaataggtgttacaatactttggctttgatagttaccaaataaggggtacctttttgacaaattagtgtatgatttaaaaaatcacttgctaaacagtctttgtaccgaacttgatatagtcttctctaattgaaaaaagcacttaagatcttacaatgtttcaaggctgtcatgattaaattagcttttgtttcatagactggacatatggaaggtacatgtaggaaactgggttgaatctgtacttactcaatggcgtaatctggaatgccatgtttttaaaaaaattctgaacaaagacctttcctccttattgggtctaaatgtggaatcatgtactggttgatcctttgaagccatgtgtttttttaggcatgtttacagtggccccttttatgttaatttgctgattttcatactcaaagaagacatgtactttatggcttgaatcctaaaatatgtgactcccccactgggaatgtgttttaattgtttttgagaacatagtttttaagcacctctttttggttccttcctaatcttcagagtctacacacttagctctggagaagcaagttatgtgtttaggaaataatagcttattttgctgagtgttactgactctgccatctataccagtgtgactttaaatagattacttactctgaagtgggcctcagttttatctgtcaagtggaagtaacaatcactgcatacaaaataaagcaaatacacaaaggagttctagcacagtgcccattaaatagtggctcctatccatccatccatccatccatccatccatcctcccatccattcttccatctttttatcctaccattcatccattcatatacttataaagtgcctactatgtaactgactgtgtttcatgttgggagaaccagaaactagagaacccgtttctaacctggaggcctccatgatgtaaggaatgatcagaactcaggataggtaatgcacctggttttcattttgagttttgtaattaaggtttttgtaaatcatattgttgcaaatatatctagcgttaaacctatagataaaaatctagaaaacttatcgagatgttacaatggctttgtatttgatttcaaaaatgtcttttgtactagttaggtgctttggcttatttggaaatttttgagaagttatgctttctgacctgttttctctgtttttgcaagttgatgacttcactcattagtgtgggaagtcagattttgtagtagactgtcatgttttccacatactctatgtcaggagaatacaaattatcctctactatatatcaggaactttctttctttgaatagctattaatttagtctgtattattattataacaacagtaatttctgatgctattgaatgaatgggctatctgcattttcattattacttctttcaaacaatgaattatcaattgagctgtaaaaatgtactctgttcagtctttgcatttcaggattccttttggcagcattttcttttcttctttgtcttcttctttttttcttcctcttcccttgaaagctctataaaattgccttcaagtgaaatgaatataaaataggaaattggccatttggggcacgttttctagtgcaggtgtaaggcatagtttttactaagcctaacaacatgcaggacaattctgatcgtgtcatccaattgatgatgataaacatgttgcttttaagtctttgttgcaatatgtgataaaaaagtcttagtaactcctgagaatatccttcatgctggaagaaattgttcatattacaaactttattttcccagaaaagataactatacttatcacaaaggaagagagggcaagacagagaaacaggcaaatgtaaaattaagccatgtcatctatggtttctattacaatagaatgcatagaaaacatagaaatatgtgttttcttcttagaataaagactgtgaaacagtgaggattctgtgtcttatatcatggggttttatttgctccattgtcatttacgaatatccaaatgttccacagggagagttttgtaagctaattggaaccaaaaggcaattataagcagtagaactgtaatcagtgccaaaaataatatatatttttatccacaatgcaagttaaataacttagaaaatagttgtgatacttcatgcttactaatcatacatctacacgatctttattctaagaagtgaaaatgtttttacacacattccgattaattcacaaggtcttcataaagagggtaaatggaaaatcatgttaccttcatttagaactgtgtctttaaagggccaaatttatgacctgtttataaaattgcagttgtagagttaaaactagagtccttttcagacttgtggtcccctactttagttctatatattagaccattgtactttgttttaggagagtcatttaattttctaacacctctaagaaaaacacacttttaaaggcagttttgttattttttggtagaaaaaatagtaaacaaaacatcactttatgtataactttttgtgtaacaggaagagtcacacagaaaataaaaagtcagaaagtaagttgagcttagagagaacttggaggttctcaggaggaaggaagcatttctagtcatgctgatttcagaggcaacgaacctgggggctggtgggctcttgacttggccaggggcaaccaggtgctggattccctgctaccatcctctcagccatccagacacaatggtgatgaatgttctgtaagctggcctttgtcttagtttaccttgtcaataatttttacttcccacaggactgctgtatttggtcttcaaacagtccaggtgacttgcttttttttacagatactttttcttcattttaagctgaatagaaaaatgaagggctgattagggggatctttttcacaggagacctgttttctcaaacctccaaccattgatgtatatgttaccctcttcctggttttccctttcacccccgttctgtcagctaaatccttccttatcatcaaggcacaatactgggttgccttttctgacgtcttctcagaaccaaaaaggcttctatcataacacccatcatactgtgtcctaagggtctttttatccttcttcctgcctggttagagcactccagaaatataaaagctatgggtttcattactttatctcagttcctagaataaaataggcattcagtccataggtctggaatgaataagcctatttagagttgtgatctccataaggtgttatttacaagttttaaaaggaattgtttattaaattatactttatgatgtcatttgaaagaccattaaagtattttttcatctgtcagatttaaatgtgccttttttctctcagaataattttaaaactacttaacattgtttcctcaaatttctcctctataaaatgagattttaattcttaaatgactcatggagtgttgtgagtctcataggaagtaaacttgaaaagagattgaaaaggagaaaaaagtgtatttgggtataatgattaatgattttgaaagacatgctttattttccagaaatggaaaaatgataatcaggtattttttgtttctggttttgtttttaggtttcctcttcccaatatttaatgtgaagagtcccactggcacatatggtctcatagaagactattctgccttcccaattctcatacccagtttttgaaatttctttaatcagagattaaacttttacttcataattagacataaaaatgcaaatgatcaattctgaagagattggttgatttaaataatcatcagggtaaaaatcatgagcccttttctcagagcaggtttgattgaggaagacccaggatacctcacagagagtgatggagatggggaaggaaaaagagagataggggtttacagaaaacaaacgctgcctagggaatgtgactgagaacataagtgatctgtgcaataacgcacaacccagaaaccctctgagcctggagaagggaggtgcagctgagtggagttagtagatctttccctccagcacctctccctgaaacttcagaaatcagtcacttcaaaggattcttttcctttgccctagattaaaaggagacttctaatcctttctagaccacacaacaatattagctccagtagaattttctaaagctgtgtatttttcttcctgatctaaaattcaagtgttagtctgcatcatcatcagagtcaaagaagaacattacagaaatgtaagaaagaatcagatctcctttgttaagaaaactgattccggacaccaaaagactcattgctttgggttataaaccagagagtaaacatttcttggaactggtaagtgtttttccccttcagattcctatccaagggcatttcttcatgatgtctcaaactcagattttatcatggcaatgatccttttaaggcagtgttggagcttgttttcccagtgtcccgctgttcatcttggcttttcttctaaactgcctcttaccactgatttattaaccccatcccttgagtaaaatcagtagaagccaaggcagaattgaaactgtggccatggggataaaaagctatgtgaaagtgtagaggctcagtcggcattagtatgtcctgtaatcatgagaccttgattttgacaggtatttgcctgtaaatactgagttaaatcagagtccctaattacaggaaaggagaaaaaggcagtatgtgactgcactagaacaagggaggccttgggagagatgattatagaagataataggcattagtaaaggcctgtaagaaacattttccctgggtgattgtcaactggctttgattaaatagatcataaactgaatttgcaggaatgtttccaagtgtacagactgtagtatgggaattggcaggcctcctgacaaagtgggtgaggtcctaattgttaattctcaaaatgggcatttttggttaacaattcttgtatttttccaatacttggtacagtgcaatgtaggttataatatacttagatgaggacagtgccatctaagtagaagttcagacaatgaagtattatctctttttttttcctgcagggtaagggagtaacattatgggagaaagttctgagaaattctgttgtggtcctttttcttccattattttattactatgtaagctacattctgccataatgactaaaagtttgtgtcaatcacagaatactttcagtgggccatgaatttggaattccatctgacgtgattattgatttgatggtgcaagtggtttcagtaaagtatgcatgtgcacatgcccttaagagttgtggccaaataatttatcaaattatagcatatattgaattttaattattcatgataatttgaattcctgaagaatgaatcaatgaatgcaatttctaacaaatcaacctttatgtgcttcggaaaatagaccgcttcacactgagttaaaaacgtcactaagaagctgaaatgtccttgtcttctgtaaataaatgctatcagattaaattactggcctggcacagtggctcatgcctgtaatcccaacactttgggaggctggggcaagtggatgatttgaggtcaggagtttgaaaccagcctggccaacatggtgaaaccccatctctactaaaaatacaaagattagccaggcatggtggtatgtgcctgtaatcccagctactcgggagactgaggcagaagaattacttgagcccgggaggcggaggttgcagtgagcagagatccagagatcgcgccattgcactccagcctgggcagcagagtgagatgccgtcccaaaaagaaaaaaaaaaaaaaaagattaaattactgacacacatcatccctaattaagaatttgtggatcaaatgttttttggccaaccatgactgagtggagtactgtgggggcattgcaaaagtgcttatataatataagcaaagaacattggtggtagccgagacattggaaatccttaggtcgtgctctgtgtttcacaggtgaggataatgaagccaagaagggttgaatgacctattcaagatcagaaggccaaaaataaaacccaggctcccaactccctaatcctatcaaattatcacctcacaggttttttcctgatcaaaaatatcacaaaaatctatgaaaataaccaaagcaaaagtgaattaaggaaatggcattgtctgaatgagatccttgaagattgtgtccacgtctattcatttttaattccttagtatgtaacacagtgccttgtgcatattaggaagtcaataaacttttctttaaagcactacttttgcttttagtagaaaagtaacattctttaaaaatatctcatgctgccatgagcatttagtgtttatggtgctatgactcagaatattttctttgtaattagttatgattaaaattgccaaggatagaaaaacattcatttgttgtctgccagtattagaaaagcaaatttctttggacctttgttaagcctggattggttttgggttatatggcttctcaccaagatatggtagaacctgattctttccagattttgtattgagtaacaacgtgggttttggcttacctacatgtagactggtttttgttgccaaattttttttttctatcattaaaggtattctcttgtttctttcacacacacacacacacacacacacacacacacacacacagtcataagactataatttaggattgtatcatgtacatcccacccagtgagactttggagaaaaaacattaagacacccatgatcagaggattccctttcttgctgcagaaacacagggacctcaccaaatacatttttgagtaacaggagaaagactcggtgaagtctcattccagtgttgtattcatctcaaatctacagcttatggcttttagtgggttttttttctcagtatacatttcacaacttttaatttttaagggtttttgacacttccatctgccaaaatttcagagatgtaataaacacaattttgtgtgaattggaaaaaccatcaactataattgaagcctttgtcatgtattttgatgactcgatgcaattataaacccatacaaattgaaggtaaatttaatttcagagatcctagaccaaggtatgagtttcttagacttattcagaattctaagccaatgacagccactttacaagagaactatgccagagatagggacattttgtactgtcttttgaacaacctcatgaactttcactgtttatacattggacaaaagttaaggatcatatccccttttgactaagaaataacaaaaatgcatagcttatggttttgttcttttgtatgtgtgcatgagtattttggaattaatggtagtggccatcatataaccatatgcaggtaggcttggcaagttttcaaagtgttcactgatagaaaatgcatatcttactcatcatataggaagcaattaacaatgaaagaatatgtgtactgccaagaaagcatttgagtaaaggaatggactgtcaggaatataatagttcccgttcaggtgaaagtgatatgagagtctatgttccttgcggcttagcaagtttactgaaatataaagagtggtaggattgtacataggattagacatttctattttaataacacatgaatgggccaaataaaaaaggaaaacttagaaatgaagtaagtgattgacaataatcaagaaacaatattatagataaaataaaacaagtatttagcatttgcaaagtactttcatgcatattaattctttgatccttgtaacaacctagtgagggatgtgtggcagatcttgtcatcatccctgttttaccactgaaacttgcaaaaggttgcacatctttttatagcagagctagaaatagaacaagctcttctgatgacacatcctatgatactgcctttgtgtgttttccaagaactatcccttatgtatatgtaactgatgatggttacaatatggctgcagctgtgattaaaaatctctccttaccaaaggctagtttctgactcggtcttttcctgatcacttcctctttgctggtttttttcttttattgcatgtcctcacaaacttcatcagaataatgccaaaaacagtgtgttcatctttccatccatccttccttccttccatctgcccatccaatcaataaactaatttgtgtatacagtgtattcacctatattcccattattcatggccatgctgtacatcttctttccccaaacactcaacctgtgtatttctgacagcgggaagtgactgggcagggtgacagtcgctctgaccattacccatgtgtgataaattgcttagtaatctccacagcaccatcgtgcatacattgagagtgtttagggcattgtaacttgggagaatttccaatcgttcataaataaccattaatctgtcccttttacattcagctttccacatctgtttcaaattgttcagtgctattccaggagtgcattaaggctccaatccaggtagtattaaggggataaatgagccacagggaagagacactgtatttttctcaaagcagttctttctcctttttacagagttaggagccaagcaatttatgattaagattttcagaagatatgttttgtcattttaagccatccttgtctgtgggtttaaaaatgaggttttagctctagcatcctggcataccttaatgtatttctctgtacaggtagattgtgaatatcatttctaccagcaaacctgaagtagttttaattcattatgattcagtgtggattcttattgaagaaaaatgaagaatagttaaaacctaaggtcagttagaaataaataagtgccagagtatgcatttatgtttgtgatgttcgggaatgtcagaagaagttgtcaataattttagtttgatacattttctacaggaaaaaaattgcttttcaggaaaaaggcattgttattttatgaattataatttaatattatgttgctttatgtctgctccagataattgaatgaaaattatacaggtgcatttttttcttaccatatagtacccataagatattttctcatgtgctttccaaagaatgtattttcataagaatgacccaacctgtactgttagatttacaaaagtctcatcacatagtacagagatgccctgcagaataaatgcatataaagatagcaccgtatggtatatcagatgacacctaagtatgagagaggaatgttttcaagttgaccttgaagatgttcagggacttacagaacaaatacgaggcaggaggataactaaaagatgattccctatctttggcatttgtaatactcataaaagggatgacaagctgattatctgacccagaataaaatgcccacagagtaatgtaaagaagaaggaaattcagttgcatgtctctcaccaaggttagtaaaaacctcatatcatcacataaagtgcactaaatcattggatttgaggttggtctatgtcatagttacagtctgcaatttcatccatgcataggggattgacagctgctccacccattagtattaatgaattaccaacgtacatcccacacacatccaccaagaaaccaaagaaagccctcctacacactactttgttttgaattctccaaatgttgtaggatagctatctttttaataagtagaagttattatatagctaaagctgataagactaggaattagtaagtaattgtaactttattcatacgttaaaataggttaaattatctctcacctctctgtcatctacagaatgcctatgaccatttaagaaatgggacctgaactgctagggcattttattaaggaaaaaacaattcagaatgacattggcagcctgtttagtgaaattttttccctcctgaaggacctccaagagtgtcctttaaaagaggtaaaaaaaaaaaaatgagttttgatatgatgaccatgtgtacttgtttacccagaacagttcagtttataccatttgttctggcatagttattagtcactacccatttactctcaaaaggtcctgatttgaatggaaaattatatgttcatctagttttagagcatttcttatacaaccacggtctcttcctctacccctctagtatgatttcagttcccatttatgtcttttgtgtggaacacctgtttctacaaaggaagaaagaaacaactatgccagtccatacactttcatcagctaaaaaattcatctctttttcctactcttttattctttgggttctcatcctcttttctctgctttgtgacattgcactccccaacgctgtccttatagaatatgtcagggacaggtcaaagaatgtcactatatgaatattttcctatagaaacagtcagcttaatccttgtcagtgcttgtctgtgtgaacaaaaaaaaagtgacatatagtcatgagttacttaatgacagtgatacatactaataaatgcatcattgtgtaaatgttatggagtgtagttatacaaacctagatagtgtagcctactacacacctaggctacgtgtatagcctcttgctgccaggctacaaacctgtatcgcatgttactgcactgaatattgtaggtagttataacatttgtgtatctaaacatagaaaaagtacagtaaaagtatggtattataatcttatgggagcaccatcattataaagttagtcattgactgacatgtcatcatgtggcacatagctttattttattctttttaatgaagaggaatttagggccatgctcctcattgacagggaactatcagattgagttatatctccccttagaaacatttattaagggcccactctgtgtctgacatcttgttatacaaaaatgactgagagattatcccttatgccaaggaactcacagtctattaatagagaagaccatgttgaacaataattacatatactactaggagtgaatactactaaagcactactacttcatgtatcaccaagggtatggaaaggtgtgcatgggattcaatctgggatctgctccttggggaagagatgacagagtaggtaatgtgtgaactgagttttggaggaggaacagaatgaaggtatcaatttacatgaggggctctgcatcaggtttgctctgagaaagtagatagcattacattggccaacatacactgtcacaaaatgtcacttattctcctgtacactgcattctatagattaaagccttttgttgttgttctgaagaagagtggaagttgacagtttactatttataatagccataattttccaatttgttgatacaccttcaaatacactttggaaagaccattacagagctctctctttggcctttcctcgcaaaatagacttatttcctttatgtactctcaaaggtcttgtttgttttttaaagcattcttattcttttctcttctgagcttaatcagtgtatggttcctaccacactcctttatattttgcactcaggtagcattgtagtgtgtttatatataaaggtctggctagtggtatagtcccaaataccatacttatttacttgtatctcactgcctgctgaaaacaaaccattatagagcacttgataaacacagctgaatgaaacaaacagttcacccaaccttgtagttactgctaccatccctcccaggtctctgattcctctctctcctgatcgtttctttctgccttgttgtttcactagtttctgtaaattctgtcttctatcttctctctacattttttccaagtgatgcagccttgctccaattttcagattcctctctaagtcatctaagtctgtgttgtatggatggattctctagtcacctcctacctccattcttcatacttttcccagtctttaactcagaaacagatcatcttctcttcccatatctaatccactggccagttcagcagacttagttaaatagtgtcttcagcatgtgtttctctccctccaattcctttccttaccatgggatcagtttccttgtgatattctcaactccgaaagtgagacccatctaggagccatattccacattggtgcaagtttaagtcttctaaaacatacaacacctttaaagaaatgccatcaccaatgacagaattcagctatcactgtcaaattgtttcctaactactttttatatttaagtcccactgtctttcttcatgagtctctattatgcttgtacagagaggcagtgcagagccctgaagttagaacatctgagtttgatttatggctctgtacttgttagctctgtgaccatgggcagattatttactttctctgtgtctcattttcctcatctgtaatgtggggatagtaattggacctaccataaaggatcatagcaaggattaaataaaacactcagagcagtgtctagcacatattaaggattcaataagtattagtatttttgcagtttaatgataaaaaccacaattacttttgcaccaacctaatagagtcctattctccaaaatcttacggtcttcttctgttaataagtatcctatttctttttcttaaatctgaaaatcatccaaaacttacatttcactgttttctattttcacatcttgaaatctcatcttgctagaaagacattctcatgtcttctcttagaccggtagtatccatttatatggaattcataattatatgccttcacaaaattcatatgatctgcttatgccaatgaatataaaggtgaaagatagaaactgctgttatctctctatcgtaggtgtccccaacccccagactgtggcctgttaggaactgggccacacagcaggaggtgagctgccaatgagcaagcgttactacctgagttccccctcctgtcaaatcagtggcggcattagattctcataggagcgcagacttgactgtgaactgcgcatgtgagggatctaggttgcacttcctttatgagagtctaatgcctgaggtggaacagtttcctcccgaaaccacctgccacgcccccagcacccacctcacctcaccccacatccctggggccaaaaacgttggtgtccactgtgctataggattgagagatataaagctaacaaaattgaagggtagattgaaaaataaacttgaattattttatgatcatgacctgaaaccacatgtaaagttgaacaaccaagaaaactatctctgcttttgcttccttttctgatccacagtaagttaatgctcaggactggatataacacataaggaattctaaggatcctaagtaacagtgctatgtatggggcatcatggggttatcatttgtggtaaatttgttctcaacactggcattttttttttttccttagggcagaaatttagcatctggagaggttggattttttccaagtgatgcagtcaagccttgcccatgtgtaagtattagtatcttaattttctcttgcttcattttgtttttgatcctgtgattaattgtgcaaaaatctacaaaggatactggccaggtcagttattaattttattaatattttctggaagaatcattattttcaacatcattatagttctattgtcagaatatgttttttaatattaagaaaatatatagaagaggcaaattttacttagtagaatttatataactaagtagtctaaaaggttttagaagaaataaaccacagctacaaattagacgcattgtacaggtttcccctttcccactgaactgagaatggtacggtctgcctccagtcacttgggttacagggcgatattacacttcagctgatgtctttgaaagcttgctagaaaatgaaaagtccacaaatttttcaatcaaatgtctaaatatattttctatactttagtgtgacattactttttatataatgtcataatggaattttctgaaaatataaaacacagataaaaggagaataaatgaacatttcctcaattaatattacaggtgaatgtaacctaaaatgtactccctggtgtgttatgatactgataaacttctgtttagggtaacatgattttagtatcataatatggtattatgggtgacgttttccacacaactttttaatttattgactccaaagtaaatgaaatttctttactaatacgatggagatgattgcctgaaggggaaaaactctccttaatctatcgtgcttgctatatttcagtagttactgaatttccaaactggacattctttttactgttagaaacatgagaatctgccatccttggctctagaatgtgccctataggataatttactccactcattcaagcttaattactttcaaaatcaaagagaatagaaaagcgtctgttactctgttggttttgtgatctaatatcacatttgtttaacttttattttaggtttaggggtacatgtgcaggtttattatttgggtaaattgcatgtcatgggggtttggtgtacagattattgtgtcactcagtttctaagcatagtacctgataggtagtgtttagatcctcaccctcctcccaccttccaccctcaaggaggcccctggaatctgttgttcccttctcatgtccatgtatactcaattttaactttcacttataaatgagaacattgttacttgcttttccgttcctgtgttagttcactcatgataatggcctccagctccacccatgctgctgcaaagggcatgatcttgtttctttttatggctgtatagtattccatggtgtatatgtaccatattttctttatcctgaaacatatgggcatttagattgattccatgtttgtgaatattgctgggatgaacataagcatgcatacctttatttgtagaacaatttatatttctttgggtatatacccagtaatgggattgctggctcaaaaggtaattctgctttaagttccttgagaaattgtcacactgctttccacaaaggctgaattactttacattcccaccagcagtgtataagcattcccttttctctgcaaccttgtcagcatctgttatttttttactttttaataaaagccattcttactgatgtgacatggtatctcattgtggtttcaatttgtatttctttaatgattagtaaaattgagcattttttcaaattttttttggccaattatatgtatgtcttctttccaaaagtgtctgttcatgttatttgcccactttttaatggagttgttttttggcttgttaatttatttacattttttatagatgctggatattagacctttgtcagatgcatagtttacaaatattgtctcccattctctatgttgcctgtttactctcttgatagtttcttttgctgtgcagaagccctttagtttaattaggtcccatttgtcaatttttgttttgttgcagttgcttttggcatcttagtcattaaatctttgctgggtcctatgtcaagaatggtatttcctaggttatccttcaggggttttatagctttaggatttacatttgtcttcaatccatctcgagctgatttttgtatatcatataaggaaggggttcaccttcagtcctgcatatggctagccagttatcccagcatcatttatcaaatgtttagctgccacttacaagtgagaacgtgttatttgcttttcctttcctgtgttaattcacgtatgataatggcctgcagctccatccatgttgctgcaaaggacataatcttgtttctcccctttactgaacagggaatcttatccccattgcctgtttttgtcagctttgtcaaagatcagatggttaggtgtgtggcattatttctgggctctttattctgtttcattggtctataatgttacatattttttgtcttatattacattacagtcttgaaagattattgaagtttgataccactcttatttaattagataagctaaaatgattctctatctagtttttggactttgtatgaacaagattcaggcttcctatctgtaaagtagtgatgtatatctgtaggcaggtggcaggatattatacattctaacattaagaagtttgggaacctaaagacatcaaatcaagaatattaagcattgaatgtaccatgtactgttttctgtttacatcctcttgaataaggcataaagatgagcacttgaagttttgttttagggatagtctcgcacaaagtaggcatttaataaattactgttgaatgaatgaacaaaggagtgaaaaagcaaatgcaagtccctagctgtatatagaacattagcaatggtagatactaattaaatcagcctgtagaatcatattgaatgatatttgctgacccaagaagtggctagaaggagaaatatgttcagaaattttaagatgacagagaagtagagtaacttataattgtaagcaagactactaaatatggttgttttatattagtagctactttaaattttactgcttaatgaaattatagattttttttttaattatagggcaagttaagtgaagataaatagaggggaatttgaagaggaggggatagattgagggagtttagaaaatggtattgcttttgattctgggatatattgtttatcggggtccatgagtagtgctgaatgttctattctgggcttaaaatttattttcctgcatttgctacatccatctcctcaaaaattctgatataggcaggtagaaaccaagaactgaggaaaacacaggcggttcataaatgggtcaacttcatttctagcaatatggcaactagagacaaagcctggaactgcagcacaatgcaaacttgggtatatccccgattccaggagctcttggtggatgaactaggagaaaacccatcccactgatgatgatatgcctactttggtattggttcaggattggaaagaaaaaaggaaagcagtatcccctgagaatttctaatcttaaatccaaaaccatccagatgaagggctggaattcataccagctctactacctaaataattctaagctagaagtgtagtttaaaattattccagattattccactgcactccagtctgggtgacagagcgagactccgtctcaaataaaaaataaaaattaaaaaaattattccacattgattattctcccaatgaaaattcaaatgctgtctggattggagcctctttgcacacattcctcaaaggatttttaacataaagtcctaggcaacatacactcacaatttgaaatcattaaatcaatccagaaacaaaccaccttatgccaagatcagcagaaacaataaaatatataattaaatccacaaatatagcagatatttgaattttagatactaaattcaaaattttatacttaacatggtttaagaaattaaagggaacaaaaatctaagaggaaaggaagacactaattgggtatatatgaaaatgattcaggtatagtaattgaaataaaagccttaatggacatattacatggcatatcagacacagttgtgtaggaaattgaggagaaatctgaagaaattgctcaaggagcagttaagagagattaagaagttaaaaataaaacagaaaatggagtgatgagatacaaatacatttaatagaaggagagaatagagataattgtagaaaagcaatattcaaataaacaatgcctgagaactttccagattctataataaaactaatcttcagagtcaagaagcatatattaaaattaatcaacacctggatgcattgtaatgaaaccagaagacattaaagacaaatattaaaactgagagaaaagacagattatctataaaaggttgattattagacccagctaacaacagaaataatagaagcaacaagagtttccacttctggtaactgttgaatagctcctattggaccaatactcccacacataactataacttgtggacaaaatatcaaaacaaaactatctgaaggcactgcccaggagaagattgacacttggaaaaaggaatggcactaggatgagtttctttgttttatggctagctcaaaggcaggcactggattgtaccatgcagggtagctaaaattcagatagaaaccttatggtatttctggcttaaagaaccagattatggagtgagtttaaagcagtctcagcagctggaaaaggaggtaggaagtcttaaaaagagtcagagagaggaaacctcaaattctgtgtataaactttaaggaaagccaggttcttttttggaacataagaaaatacagagcctctacagtttatcattcattcaaattgtccaagatacaatataaaattactcagtatgcaaaggagcaggaaaatgtgaaccatacttaacagaaaagagaatgaagggagatcaaccctgtgatttcctgtttgatgacttaggaaaagattttaaaagcagctgttatcatggtgctcaaggacacaaaggaaaacatgttcataatgaatgaacagaaaacctcaaaagagaaataggaactacaaaagaaccaagtagagattgtacagtgtgaaactacaatgtctgaattaatatctgaaacaataagaatatgttaaaagttgtgagagaaaattactatcctcttagaaatttctcaaaaaaaggatgaaatcgtgatagtttattcaaacaaacacaaacttcacttctaagtgtgccatctagcttcataaggtatacttcaggaagaagcacacataaatagacacatatatatttatttatatatatatatatagaccaatataaatatttctgtatgtatgtgtgtgtgtgtatatatatatatataattttgtacggatactatattctcaataaaatgttttttaaaaactacatgttcatagcagaagttttgcagtgttaatggactatggtgctgggagaaaatggcattagagaaaaatagtaaccatatactcaaagatgaaaaagttcccaaaaggaaattaactgtaatcttaaatatgaagtacttgccagacaaggacccatagtacacagaagaaagtgcagagggcctatgactgatggaaaaggataggaccccacctgagtaatatggatcatggctgggaaggtagtcctggatcttcacatgtcagaatgcacccactgaagagagaaaagctctagtgggacaccagggtggaacagcctcagttacctgttctgttttagaatcttctgtcactgtttccttttttggatctccagcctttttaacagccaaaggagtccacagccagaatattttgaaattctttactctcctccttcctgtctccttttttttgtttgtttgtttgttttttttttttggttctctatggaaagcttggtttaagaataaatatatacattatacttttaaagaacacagggagagggaaagaggaaatatttttcgcatcacatttcagaagccatgtatatcttgtcatcaaagggtgaactattgaagatcagtttatttgtgaaagcaaagttatgtaagaaactatttgaatgattagaatgggtataatttaccttcaacattaattgctgtttattaggattttacaaagttgtgattttaaaaatgtaatccataggataaaaatatttgaatattaataatcaaagaaatgttctgactagaaagatgatttttgatacagtttgagtattcctcatttgaaaatctgacatctgaaatgctctaaagtccaaactttttaagcactgacatgatgctcaaaggaaatgctcattggagcacatacgattttagatttttggattagggatgtggaatgtaattcaaatattctaatttttttaaatccaaaatgtgaaacatctctagtcccaaggattgcagataagggatgctcaacctgtagataactcttaacctggaagggcaaaatagtaacagcacattatgaagaccagcatggctagagacatgttcacattggctagttctctgaaatactatagtttttactgttccaaatgagggaacagtattttcaatcaccaaatataaaaatcccattaatagcatggaatgcatatatcagatatttggacatgagacaaactatctgtactcctattcgtaggaatttttaaagtaaccctctctatagaatgtactttatttcttatttttaacattaatatacctgctttgtctttgttcattttctatttgaccattagcagctacaagttttctttctttgtttgaatagcaaatgcaatatttttccttgtgcgaagctctatgtgaaacaaatggaaaaataagtattttccatgccttttttctgaataaaaggttcttagttggtagatttttaaatcagaatttggaatttattacaaaataagagtctatatccagtgtatattgtttattttgcatgttttcccaatgtcttggaaaagtaaagagctatttggttttcttaataatgttttcactttaattttctttgataagattaaattgccttgataataaataataaaatattaaaaatattaaatacccacatccagtgtatattttttattttgcatgtttttccaaggtcttggaaaagtaaagtgctattcggttttcttaataacgttttcactttagttttctttggtaggattaaattgccttgataataaatattaaaagtttccagttcatattcgcctgctatctctcctcttagagttacagtggcagtaaaatgaatgaaagaatgaattaaagtgaaatgaattattttctacttatctgacagatactatgattcactctgtataaaattaccaatggatagttccaggactgtgccacttagggttttatagagctgagtcagctgaactgaattaatgattgatttctaaaagcttcccttatgtaaacttaatctgtttttgcttttttatatcctaggtgcccaaaccagtagattattcttgccaaccctggtaagtattaaaaatgtttatgtagctaggttgaaataccatacccttagctccaggatgccttaaatgtgggggtagtaaaccatattccatttccatttgtctcggctaaaggtgttttcagatgtaacaaaacaccataatgaattcatgtattgctgacctttccatatctttatctgcgaggggggtgtgtgtgcatgcgagtgcccagtgccctagactgataatttaaagtttataccagccacagaaaggaatggaacatacgcatatgtatcttatattttacagatttaataaagcagagagaaaaatatgctttcattgtctaaaaactaaaaattagctcaaaaaggacagtagtagtttttttttttattttttatagttttagagatggggtcttgctctgtcacccaggatggagtgcagcgatgccatcataacccattgcagccttgaactcctgggctgaagtgatcctccaaagtgctgggattacaggtgtgagccactgcttctggttgacactagtagcttctaaaaataaaatttacaacatatgagagcaacaaaatataaggatggggcacccttaccacttggaggctgaaagtatcattaacaaaacctaggaagtgtaatggatagtaattattattttctagatatctccaactattaaaaaatatatttaggatttagtatagtcatgatgtcataataactaatatatactgagtatttactatatgtgctttgtactgtacatgttttgttttatttcttcaacatttatataagaaaagtggtggtgactgttgttattttttatgggtgaagaaacaaagaaacagagcatgcaactagtgagtggtaaagccagaattccaagttatgccatctgtacattgctatactgcccccaaaatgcagaatgtgaacacattactcatttctatttgttttcctgaattttgtgtttgacttctcttaaaaagactgaatctatttttaatttattggtattaaaatacatgcatagaaatgagatatcagaatacatatataaatataatatcctgggaatatatagtactagttgggtttgcatgttaccatgtgagttatctgatattttttacatgttctgattattttctgttctataacaaaagcatggaaaatgctgagttacttttcaaagtgtaggaatccactgtgcaatgtatgggactctcctcgggccctcctccaccttccctcctctggcagtcactctgccttctgtagttactgtctacccttcctgatatccctccctgggcctcagcactgagcttgctgaagaaattgtggcaggtttgtgatagaactgggaatgtgcttcatttttacctgattgaagacaatttgaagtcattagtgtctgtggaattttaaactatagtcctgaaagaaatttaatttgaggtctagagctgatagcattgataatcaaactgaaaaacatcaggaactgttaaaaatcttgaaagtgtgatgattaggtttcttctcttataccatttttcatgtaactgggcattatagttacaaaggtaatgatttgagagataaaatgctaatacctcaaactgcatggattttatgaaataaacttattaggtacctaagaaccattcagggcacccgaaggtaggttttgtacccttagttttaaaatgcacccttgccaatatgtaaaatcctactgaaaatatgaccagttagaataatattattcttataaaagcaagatgttcaggcaaagggagagccttgaaaataggaagaaataaagatgtagtagaattttaaattacttttctttttttcttgagcaacctggacaatctatttaaactaagcaggcagtttgatgtgaaatgtcttctgctagggaacaaaatgatcaactcccccagaaaatagaaccttcaattttagaaatactaaactatttagagaaaattactttgcttgatggcatggtagttctcaagtcactgagaagttaagtatcaccaactatattatctactcattatttctacatttaaaagtaagttgtttgcacaaggtaaattttgtctcttgcatacagaatgaaataaaatagaaaattaagatgattgtcttcaataatctatgtttcggggtatcaaaagataggaatgagatttgggactgcaaactggggaactatcctaaaatctgtatgcagaacaagagatagatgtcagggtccctgccttttcccatggtagtccggacaaattgccctttcctgcagtggcaggagacactggagttagaaggtatattatgtggaaaaggtgaaccatgtagggcctagatttggaaagatcaagcctagcagagactggggagatgccatagtgaaaacagagggctctgtatactgagtgatgatgctctccagttctcttgtgtagctcagtttcagcactgtgacagctgggtcccatatacacatactaccctgtcttggtattcagacaggaatttggaagatttttggccaaagaaacgaaatagagttaaaaatctaaaatccagacctttgggtgtttcccagctcagtcttcaggttcttgtcaaatgatcagactcagctgggcgtgttgactcgtgcctgtaatccctgcactttgggaggccgaagtgggcggatcatgaggtcaggagttcaagaccagcctggaacatagtgaaaccccatctctactaaaaatacaaaaaattagctgggcgtggttgtgggtgcctgtaatcctagctactcgggaggctgaggcaggagaatcacttgaaccctggaggtggaggttgcaggcagccgagatcacaccactgcacaccagcccgggtgacagtgtgagatttcatcttaaaaaaaaaaaaaagatcagactcctacccagtggacctattttggtgctcacacacacagagtttccagtcaattgtggatgcatccttcttaagtaacaaacaacaaagagtaaccatacatttgaggaaacccttgaactaaaaaaaaaaaaaaaaaaaaaaaaaagaagaaaccattggagtgagcagacaccttaaaaaaacttttatttacatcttcaaaattaagagaaaacttaagttcattggaagtaagctcaatgttttagaaaacagtcaaaataaaaaggagctcttataagttaaatattatagaagacttgggaaataaagtttagcaaatcttccaaaaagtcagagatggataatatgagagaagctatatggaagctagactgttgacccaggggatacagcattcaagtagcaggaattccagaaagagaaaaccaagggcagcaattatcaaagaaatgatacagaaatttctcagaaccgaaggacatgtggctccaaattgaagatacttctgaaaggcaaggacaatataaaaaacacattatcacgaaattttgcagtatatagagaatacagaaagaatttgaaggtttctagggagaaaaaaatcaggcaacatacaaagaattagaaatggtattgaatggaaattagaagacaatgaatcaatgtattaatatttgagaggcaaaataatttctcacctagaattctttacccaataaccaaactatgaatattgcaataatattcatagccaaactatgaattactaggtaaaataaaatattttcatagatgtgggactttagagtgttacatcctgtgtatgtttagaaaaagctgaaggatgagctagtaaatcaaggaagagggagatatagaagccaggaaaggggagcaaagagaagtcccaggactacagtaattcaacaggcttagtagagcaagcagtatcaattagaagagcgtggagggctcagaagaaaaggctccagagaaaattaacaggtagattatgtggttgtcttaattcaattaatgcagctataggttgagtatcccttattcaaaatgcttgggaccggaagtgttttgaatttcagattttttcagattttggaatatttgcataaacatcatgagatatattcaggatggaacccaagtgtaaacacaaaatttatttatgttttatatatatcttatacacaaagcctgaaggtaattttatgtaatattttaaattttgtgcatgaagcaaagtttcgactgcattttgactataatctgcattttagtggaaacatgctgactctcagaaagtttcagattttggaggtttctgaatttcagattttaagattagagatgctcaacgtgtatagtagaataccacagagattggttaacttataaagaagatatatttatttgtctcatggttctaaaagttgggcagtccaaaatcgaggggctgcatctggtgagggccttctcattgcataataacatggcaggagatatcacaaagcgaggaagcagtgggagagacagagagagagtagtggatgaactcattctttttatcaggaacctactccaaagatagctaaccactcctatgataaggtcattaatccactcatgagggcagagcccccgtgacctaatcactttttaaggattctacctttcaatactcttataacaatacttaaatttcaacatgggttttaaggggacattcaaaccatagcaatgttgttgaaaaatgtatttttgggaggtatatttggaaagaatctgtgatagagacagagaacttgaacaaacaaaaacatgagcaattttattttggagggcagatattctttgaatgaacaccctgccaaaactaggccagatgacagcttggctttgtagaggttacagaaagacaagagtgaggaacagcactataaaggagtgagcacaggtggcaggaagaagatggttttccttccttatgtttaaaattgataagaaattgtcatataattgtttagaaatacacaagtagaaataaaaaataggtacagtgtttgaaagggaacttggagtagaatgctggtctgatggaatactgctgctttttcattattataatgtgaatggacttttaaaactatattaatgcatagctttgataaaaatgcatacactcaatactaattgtgataagtgccacaaaaataggaatactgtaatgagaataatggagtaggtagtacaagatgcaggacaacattctttagatggtatggtcagagaagacccctctaaaccttaacaatgagaaggaatattgtgttgatagggtatgagtgtttccagacaagagtgcagtctgtgagaagaccctaagcgcaaaaggagcttgagaaactcctggatctgaaagaaggctggagactagtgatgaaggtagatgtaagagataaggttgaagagaggtaggcatgagtcagattatactaggtcctagtagttcatgagttgttataacttttcttttaacgcaaggtaccatctgcataaaatgcctttagttcctcttttatactagatggaaacctaacatgtcctccatcaacaaacttttgctgaatgcctgtcatgtgcgttttaaatgaatattaagtttgcattacaggtggatgtttatacaaagttacgtgggtctatatgtgaatcagaggattttcggatacattaattattgactagctttgaaagagaaccaatctaaacagaatttttcttttaagttctattgactaaaatctctgatgtaacttgccaggagattttacacctatgtatgatttgaggggtcattaaagattattttaagattgaattttggccttttattattacagttattatggagtttctgtatgtttaaggccagcaaagtctagggagattgaattctggttttgaaaaatatcaaccacaccggtggtatcaactacttgggaggctgaggcacaggcctcccttgaacccaggaggcggaggttgcaggcagctgggatggtgccatgcactccagcctgggcaagagagagaagctctgtctcaaaaaaaaaaaaaaagttactagcatgttaaatagactgcattgctttgggcttgcctgtatttagcaaataaagagaatgagaaatgttctttctatgcaaaaaaaaaaatctaccttttaaaagtaaattttactcattattactaattgcttaagaaaatttatcaaaattgtggacgaatgaattaatctcataacaaaaaactatttaaaataacttattgctagaattttctttaaaaagatacttaaaggagatttcatttcatagtatatatagaaaagctaaaataaatgtgtctgtgtatcttatacagggcagtttctccctacaagtctttttccttcctgtccctaagctccccacaactgtctttttacccaatacccactgactcctctgtgtcccatttatttactaggtgcttagtgggtattaggcattgttcattttgctgttgttagttttgtagagcatttgtgtttggacgtattaaaggacctttttctgatttatttttcttaaacaatgtaattagtatagaattaccaacagctcagatctgccactaaattaaatattgagagatacttacttttagcctctgttctcttccaggtatattatccaaattttctgtgtcattgttttttacaggtatgctggagcaatggaaagattgcaagcagagaccgaacttattaatagggtaaatagtacttaccttgtgaggcacaggaccaaagagtcaggagaatatgcaattagcattaagtaagtaggacaagtacttttacagaaatagatttcctgttttcataattgcatagaccatctgacatgtataacactgaaggtgaaaaccaaagttctaattgaaggagaaataatgcatctatccagacagttcattaatacttgaaaatatatctttgaaaaacagtaaaaagtgttataggttgctaattggcatattagatttctttcataatattgtgttttggtggtttgatgtgtgtatatttctagtaaatactaacagtataaatttctagatttttgtcttatttttctgtattctcaaactgaacttaataaattgtgcataatgaatagtcaaatccaacctcccttctcacttcaaatattggttgtatcctcaaccaatccagtaaatatattttgttaattagctgtcaccagtgtattggcataggtatatatttttgtctgcagaattaattcctaaaatgttattggggcatgccctctggtaattattgatttctactgattaaaaacacatttatattcataagttattcattgcccacaggtacaataatgaagcaaagcacatcaagattttaacaagagatggcttttttcacattgcagaaaatagaaaatttaaaagtttaatggtaagcattgattatttcttttcaatctgggatccttatttttcttttgttagaaaggtcattttaattctatagtttcttggaaattttgctcactgaaaagttatttaaagataatcatattctaattttgcaacaaaatcctgaaaattctaatttataaatctctaagttttatattgctcgaatcgtaatcttcattgtaaattgtttgcaggtttagatagagttttggtttgtgtttaaatgatacagcagattttaaatatacctttctttcctctttttttcttcctttgcctctatgtcctgattcaggcagaggacagtattttaaattataacacaaaaagttgtaattagtaaaatatgtctaacatttaggttcattttttataaaatgcaatataaagtcaaattgaaaagatttttgtattttttgctattttaagtgatctctaccatggttctcattcattaccttagataattatgcattaacaaggtaacatttttgccacttaacagttgatatttcataggaattgtatatttaaatggaaatagtatattgtcaaatcacatcaaatgaataaggattattcccagtttaaaaaaaatagaacttattcatacttttgttagcatataagaatattttgtgtatgtcatttaaacaatgtgtatatatcatcatgtatgcgttgctaacagtaaactctaaattcacatttccttaagtggtctcaagtatgtttctcaagtttggtagtttctgagataatgaagagtttggatataggacataagatgcatttgtactgctaagtaccttgagtaacattgggaaggaccactcattgaatgaaccatcaatcaaatgatacatactgcatccttccagaaaacatctcaaagcactttgcagatgttaacattaaagttaaactgagtgtaagggagccttacaaaataggccagcttgaatgccttatccaaaaatgtagaactgcttcaaggcaggtgtcagtgttttaaagaaattgaagcatcttgagttgaaagaaaaataagaaaatctctatggatgtaaagatcattcccagttcaaaagctaaggatgggcagcaaggtcatgtcctggaaaatgtaaactctgtcaaatttgtaaccaagatccaggcatcctccctgctggaagtaacttacattctgttgaaacaagcaggctgagcacagagagaattggaccagaggaggttcttcataaaatgaaaacttggagggaggtggcaagtggatgcacaaataatgaatgacagacacagctgagacatgataaaagcacgcacaggggctctccacatctctgcaagacgtaccagcttgagctttcacctgcagaacttccttggatggtaatgaggctgctccacagtgttatagttactatgggacttaaaaaactgctgcagagccaaagataactgccagccttgcagactttgaaagtagcaaaagtaactcccatcagaggagacaagcaaagaagatgaaaggaatcgtcactgaaaagggccaatgaatttagctttgtgtcacctgggttcagctcaaggcagttcttcagaagccaaggttagatgtgaaaagccagtaataccacagtgacctggattggtagacatagatacatgagttcctatctgcatgtaaaagctgtgattatagtgaaagcaatagagacccagcattaaaaaaaaattgtgccagagagccttaaaagtttctacaatgatattctctggaaaaataactaaaagtacttgtcacaggactaaagtaagcttttcttatatgttatgtataaaatctcagcaatgccactattagagacacgtgcatatgtgttttcgtctccatatctgggcatcttttgtaaggaagcacgtatcacagcgtgttaaagggaagggactaagaattttagcaaagcaaaatgaaactaacaaacattagcaaaggatgtaattatgaaaagaaaaacaaggagctggaaaaaaaatctcaatatcagaaaagtgcttttatcaagtttagtaaataactataaaaattgctgaagaggcagctgaactaatctgaagctacccctccattttgtttctgttcatttgttgagcaaatttatattgagtccttacaatgtgaaatcactttctggagaactcaaaaggacttaaccattctaaaaagaagcttaagaatcagtaaatacgtctacaccaagaacctcaccatagagcagtccttggaacctaggctgggaaatgccacatggatacttggtcagaaggaatggctcatgttttagcaacctgaacttctggaaggaggtagaagatgattaattggtgtgaaggtttctcaaaatcaagatcatacagacttcatggagttaccttttatcatgttggagtcaaataacacacttgtctattataagtaaggagtgatctgtggatttgagttgtttcttaagaatagttcagtatcctcttgttattggtattagtttactcttctatctgtgaaacacaatagggcctggaattaaatttaaatctggaaagtgtgtaaaacataagcaaactccagagcttcttttaaattaactggtttctcagtgagaagattggccttaggtggttttgacctaacctttttcccttgagtttcaatagcttggttaatcagaatctttgtctttcttagtcattaaattcaaatcctaaatgaatttctgtatccagattacaaggcattaattttgttctaattttcatgtatgcgagacagtccatgtccaaatgctgtttataaaccatctccattgcctgtttccttggtaattggaatgactggctctcactcattatttttgagagacttgaattgttgacactgctgtgtcagtgtgagataaggaaagcttagcgatttcttttgtttagagtcttcttatttacttgttgtacctgaaggtcaatgactgttaaggcaggggtggattagactaaaatacagaaagcataaaggcaaattggaaaagatccatggtgacactatttagttctacccagttagaaacatgtaggaagatttaccctcgtaagactgtaaaaatggaactaaaatatcttccatgcttagtgaagtgataaagagtgttttgcagcttactaagtaagccgcatgaccctaggccttggaaaactcattttttcttccataaaatttgggggtgggcgagtattaaataatcaccaaatcatttttcagtatgataattctatggtttctagccaaattcacataaattgtaattcatagcaaaaatcataaaattcatattacctataacaaaattacgttgaagttcaaagctatggcttataattcctttcaagtttgttttcacatttgctaaagaaaataacacattttactcaatttaagtaataagactaggagaaacttcggtatcgtttgtatcagtgacattatgtatacgtgtgtgtgtgtgtgtgtgtgtattccagagacctcacaaaattttgctttatattttaaaaaaatgaatagcaatattggtcactaagtagaatttaattctataccttgtctgcgcaaaacatgttaaaattcaccaaaatacaaatgcatattctgatcattgaaaccattttggagatacaaacttctacatggtcttttgtttctttttctctttgcttttaaaggtcggtctgattacaaatttcttgcttcaacaaggacccacattatctgggcccaaggaagaaaggaagaaatacatatttttcaagttatagatataatatttggaagaccctaacattttaagtctaagaaaacaaagttcctagtacatcatgaacacatagcaaaaactatttcacttttgcctccctgttttttgtgtgtgtgttttttggtgttttgttttgttttgttttgagacagagtttcgttcttgttgcccaggctggagtacagtggcaaagtctcggctcactgcaacctccacctcccaggttcaagtgattgtcctgcctcagcctcccaagtagctgggatcacaggcacctgccaccacacctggctaacttttttgtatttttggtagagacagggtttcaccatgttggccacgttggtctcaaactcctggcctcaggtgatccgcctgcctcagcctctcaaagtgctgggattacaggcatgaaccaccatgcctggctcttgtttttgtatttacatttgctaggcactatttgctaatagtatgatacagttaagagcacaaactttggataaaggcgctagctatgtgactttgcctaagttcactcacctcactgatatttgagcttcaatgggaataaggcccatttcataatgttcttgagtgaaagttataaggagccatgtaaagggcctggcacatgggataatggggtagctgttacagtttttcacatgtattaggtactttatatattctttgttatcatctgtgaaatggtttattagccccattttataggtgagattgaaaaattgccatttcccttatccaatgctttagccaaactatgctgcttttagcttatgaaaggtggtctttgtttatcacctttatgtctgtttccagcctgcctgctctacctaaaatgatctttccctggttcctggctattgtaattttactagttcttcagtttaagccaagctacttgtattacaaaactttctgtcacccttcccattggatacacaaaacaaagttctctctcctgcctttgaactttcccttccaagatgagaattcctcaatggcaggaggcttatctttataatctctgtgacctctgaagctcctggtacagtgcattccacaacatactcaagttttgtcataaataataaatcattgatgattctctttttcttctttcagctgatttttggactcattgatttgtctggggaactttgaacataaccactgaacagagatattaagttgatggcagtgggatttttagaagaaacaagtggtttttttttctgtttttttttttttattttttatttttaaaaaggcgctccaatagaaacattgaataattaagttaaaagtgatttttcgtttattttcatttcagatatttataagaaattttatatctacaggactcatttgatgataagatacatttttattgtgaattattattcagtttcagtttacagtagagagattcagatttctgcagaatctatgaaaccaacctgcgaaattttctgaaacgatagtctgaaggatggcatgtggttattacattaggtttagatgtatttaagacaaattatttataagagaaaattggaaagaattacattgacctctgtgagtagcagatatgcggagctatgacaggtactatacttcatcagaaactaaaaacagtctcaagtaccatttgtgctttatcaacttttgtttaccacgaaaaagcataagtttgtttttctgccattttgaaagaaaataagtgcaggaaagtagaaattgctgtatattcagcaagcagctgttccttttattttggtttagaaaggcaagtatttcataaataagaacaataattactactctgaaactgaggtttagtattgtttcttttcatttgctacatctgactgaagacaggatgttctccatctgtgaataacaatagggggtaactcatattattaatggcctgagtaacaaggacagctattaggtaggtgtcatgtacatccagacagcagggagagattatcatttgcttaatcttccatatacctatggaaaatttagcattaaattggtcatccttattgtatttatgtgctcaggagttcatgtgtttgagaacaaaagtatccttatcaaaaatatgttggattcttttttccaaaggaacttgtggagtactacaagcatcattctctcaaggaagggttcagaaccttagatacaactctgcagtttccatacaaggagccagaacattcagctggacagaggggtaatagagcaggcaacagctgtaagtattgtaattgagaatacaatttgctgtcacttaaaaattaggggcacaataacattaaacatcttccttccaaattttaaaatataaccaatggatgcgctaatgcatgagcaaggacttcttttctggagttaagcagagtcagatggaccaacaggcttgtgaacatgtctaattatagatctttatggcaaattaaaaattatgtttatgtccaaaaatccagcagaaacgtaaaagatatgctaatatttacatttcatacttttcattgacttttatattaactaaactctttttaacttacatgtaatgtgtgaggtcataattctgtttgagtaatagtatttaagcagggctggtacacagctctccagttagcctagtatctcaaatctgcttatggtctatttcaatgactactttaagaattttgacattactaatgtgtttttttggatgctagtatttctaaaaccatacattggccactttctttcagaatgagctgtgtgctacaactaatcacaaaagattagcatgcaaacaaaagcatgttatggttggactgtgagtctaagtcgaaaaccttttctctcatcgtttaatgttacataatcttcctggagatagagcatgtaacaaaaaaattgaaaaatgtcatcaagaaggtgtgattttattttcttaatctgatatcactttattttttttaaataagtgttttggggaagaagtgaatacaatttcattactcttagaatctttagcctaagcaacactgggatatctagaggtatttgaaaacagaatttgcgtcggtttaatataactttatatttttccttgaaagcagaaactgaaaggggaacaggtaatgctctgggtttcaacaacatcagtgaagttttatacatttcaattcaagtaaacaaacaatctgtcacatcaactgacatattttttatttaagtaacttaatatatgttttcctcacagtgatcaatgatgtatgcctaagctcgtgcaatgaaagtagagcgaactttatgttaaaactttaaacacctattagattttatggtgttattttttagcccaagattacctgattattttagattctcaaataggcataatttttgctcattcaaaaatggaagttttctccaaaaaaacaattttcctaccaatatcttaaaactctgttgaagctatgacatttcccccagcatgaaacatgtaattttcgaagctctgtttctttgccttcccagcagcaagagataataaaagttgccagggaggtcagttagatgaaaaatcctgtttgagttgttcacttagctctagagagcctaggagggagaagtggggcagacagggagaacagatgtcccatattaggtaggaaggtcactaaccctcatatttcactctgtggttcactcccagccaattccttagtgtttagtacatggaggtactcagagaatgtagcccggcaatgaatgaagttgtctaacttaaaattatgtctcatgtttaatgaagtatttaatgctcaacttgtttgacaactaagaagggaattacaggactttttcttaaaaaaaagcatagccagtagaatgtctttgaatatccatgctagccccagataaatttttcagcaaataaactcatgagttcaaacttccctatccagtctttttaagagattctgacaacttgaatcaagccactaaaactttttttttgtaattgtgaagggaaagcaaacaattcattgaaaattttatatttgttatcgtttggttttgttcatcaattattcattcattcgttaaacagatatatattaaacacctaacacatacaaggcactgttctggttctgggatatagcaattaagaagacaaagttcctgcctttatggagtttacatttcaatggggaaactcaggcaagtctggtttggaggagtttcatatttttatatagagtggtcaggtaagatctccctcgtaaagcaactcaaaaggagagaaggggtgtaggttggtaatgattgcacagtggttaacactccaagattagtcattcgttactgcaaagaaggattacaatcttagatcaaatttgtgataccattccagtgttttatttactttatactaactttgtataaagttagaggaagactaagatggttctgaggactaaatgaggtgttctatataaagcacttagcatagtgctcttacatggtaaacagtaaaagttactgctgactctacaacttctacttcctctactactgctgctacttctaactcttattctaacacagtactttcctatatttctaaggcttgaatacatttactaattatgactcatagcaatgtacatctttgcctttatgattttttaaatataacttgcttatttttataccaagtcttgataaaagctcacccttaaagaaagactgcttctatttttatgcattttatacatcccaggaagtggtaaggaggaaatgctgcatgtttgtatagaaagattgtgcaagatgtcttcatattgcttacctttggttcatagctttaggtatgctgctatcatctaaaaataacatttgccaagcattattaccttgggatactgggttggacagaaatggcatctccattacttctaaaagtccttggaggatacagagcaggcaaggtaaagcttggaaccattctgtgttctgagtagaggttgagaatagaacttcaactcctgaaacctgctgtttattattgttattatttttaaataatctagtcaccttggaaaagaaagccccagggcactgtagtggccacttacttttgggctactctaggttagaatgttcgtagaatgtttaccaattattttttcaagtatgtacaatgtgataagattatgacaggactatcttatgcaaattcaaagtaacatctaaaaagatattgattagaattaagcaagtgtccaaagtattgggcaaggagcataacattttaaagttaggggcccattgtaggctgtctctcagcctctctcccagagtgatgggattttatctttgtctttggaatgacttaagagcatttctaagggagaagaaaagagagaaagaaaaagaacaaagagagaactcaggcatagcagggagctcttgggcttcctctagaaacttcagtgactccatgaaagatgttctatggatctttgtaaaaatcccattattttccaaaatggtcatctcaaacctgccttagattgctttaggtttacctgtagggcttgtatatttgaagggcattaaattgacttttgcatttcttgctctacaatgaacacataattattttgaggtctgccagagtagctgtctgaccttaggcgagtcacttagcctgtctggaccttagctttctcatctgatgaatgaggaatgaaattagagattttataatgttcttttaaaaatagcatcttaggttttttcctttgtttgcatgagagaagcaggtaaggtaatgttaacagattggtgcattaggaaaagttgtatgtttagctattttgtgacccataagcagaccttaaatattttgccaagtttttatttgtagagaattagttgggccacagagtagagttgggtaatttttttaaatggctatcactatatttatataatatccaagtatcttctgtaagaacttattaattacaaaagggtaatagtaataaccaagtgattgaagttaacatccctaataatgggacaaataaatatcatgtacctcctaatataatgctccaagcaggacaaaccaacactttggtggtattattgtccccaaaaagcataagtggaatctaatcatgaggaaacatcagacaatcccaaactaaaagacattctgcaaaataattggtctatactctaaaaccttcagtgtcattaaagaaaaagtctgaggaactgtttcagattaaaggagaccaagagatgtgacaactacatataacatgtggtcttggattgaatcctagaacaggggttgggaagatacatacacacacacacacacacacacgtatgtatatatatgtgtgtgtgtatagtaacatattttgtatatgttataaaatatgtgtgtatatatgttgctataaaagatgtgatacaattggcaaattttgaataaattctcttgattaaaaaatagtaccgcatcaatgcaattttctgcttttgataattgtactgtggttatataagagaagagaatacctttgtttttcaggaacgtgtgctgagtatttagcaataaggggcattatgtctgcaatttattctcaagtggctcaggaaaaatacatagattgataaagcaaacatcataaaatgttaacatttggggagtctgaatgaaaaatatgtgggaattccttttgctctccttgctactttaagtctgaaatatttcagaatagaagttttcagttgtggagatgatcccatttgctggctatatctgaagaattgggaggtagtgacagtgtccttcttttgcctgcttcagacatagaagcgtctggtccattgatttcaggacgtgtggaacactagcatgtactgaacagatcatatttgaagccatccgttccttacctgtgacctcattggatttgcttcattcattcattcattcatttattcattcattcattcattcatccctttatcctgaaaatattttcagtacttagtatgtgctaggccttgtgctagatacttgaattataatagtgaataagatacacaatctggtgaacaagaacagacaaaaacaaacaccttcaataatcacaaattttgataatccttatgaagctgaagcataagtgcaaggaaatgggagcagggccatttagccttcagggtcagagaagggctttttgaagaagtgacagtcaggctaaacttaaaggatctacaagagctgacagggtgtggggtggtggccaatagggaacctgcatagcaaagaggtcgtttgtgtgaaggttcataagcattagagaacttcatatttttaaggaactgaaaaaggaccaatgtgttgtgagtatagtaagtggattctgatatttgcactaggaaagtattgaagttttacagacagaaaatggcatgaactaatttacattgtcttaaaagaccactgactgttcctgaggagtggcctagagggaggcatgcacagagggaagatgagttaggaggctattgcagatgtccgtgagagggataagcatgctttgaacatgagttgcatagtgacagcagagaaggatagtggcaggtttgcgtatatcttagaggttgagttgattggataaaggatttgaaatcaaattagtacaagtatggtacataagtatttgctttggacaactggcaagtgataaaaccattaacaatccaggaaacagaagagatagaacagatttaagagaaaagagaatatattcagttttgcacagtgtttaggtacctgcggatattcaatggttcaggatgcagctggcactgaggagagtggtctggattgaaggtagaattttatgaatcattaatactccatttcatagttcacatagaatatagtgatgtgagaattataggcatttgtatataggcttaatttcttctggtgcattgtttgctggagccctagaagccaggaccctttgcttgtcattctcaattgtacttttgcacatgccttgcatgaaatagcctcagaaggggctaaataagagaagtcagagtctaaggttcacaggagacacagcagatattagagtgctaagttgaaactggaaaagcatgggaatatgggtgagtttgaaaacaaagtgtagatcagcatgttcctttcagtgtggtgacaaatagtgtagcaattcttcaaagattgacaaaggctacttttgtcattggagccataagtttgaccttgcaggaagaagtagaagccagaacagagcctaggctgtctctccctgggtgtggtctctttcctgtcacccactgtccccattattctattcaccatccaacaacatgcttatccttcatttttagtcagtattttgggtagaaacagaaacttggataatttgtgtcgtatttatttaactcagtagaacataaagtagcattcttattcctgataattccttaaacatcctaataattccttaactactatttattagttatattacaatagaatagagacaatatttattatctccttcgtacaggttcctaaccatccacttaacttagtttctcccttgcccttttaattcagcattcccatattcacctgcctttattttctgattttattgtatcctcagtttttttgtcatcttttcctcggtcattttgcaattgggtttgatatgatctaattttattctggtaatttaaatatttgttttaatctcattatattggtttcctagtactgctataaaattatcacgaaccaagtggcttaaaacaacagaagtttactctctcacccttctggaggccagaagttgaaaaccaaagtgttagcagggctaattcttcctggaggctctgagggagaatccctcccatgcccctctcccagtttctactggcaatccttggcatggcttggtttatagatgcaccgctccagtctctgctggtcttcacgtcaccttctgtgtgtatcattgtcccttcttttctcttatggacacctgtcattggatttagggcccacccaaatacagcttgatctcattatgagatccttaactgaattacatctgcaaagacccctgtttcaaataaagtcacattcacaggttcacaggtcctgggtgggcatatctttttgaagggccaccattcgacccactgcagttccactgtattaattttaaacttttctctaaaattttccatccttattctaatttttctttttgtcattttgtaacttggagttataagaggactttacattattacagcagtcaggcagtcagtgaatgagatttatacaagaaaaacactactttaatacaaaaaaaaagtgttttcaatgaattgtattgcctttccatggtgaaatgccttatctttctgagagactgcacttctagccaatgcaggctcctaaacaatacttgaatgaccatttgtctgaaacattgtattaaatattttatatggaataagagaacctaagaattctgaaattcaataatttgatgattaacaggacactcttacttttcaaaccccttttacaaatatcagatcaatatctccaatggagtattccaggaatctctagccctgtgagaagtaccatgaaaagatttcttttgtcaaacagatatataagaaatgctgctagtatgatgtattcccttctaggaaagtgacagtttatctagagttttccccagtttatttcatcatgcaacactgtctcatagtgtttaatgctcatgttaggaggcttaaaagagttagtaggtgtgaaatactgagaatagcatctcacatgtgggaagtgctatgtgttttgctcctgctattactactgctgctcctgctaccacttccaatactggtacccagtgtgaagtgttacattagcctcatttgacaattttaagtatatttataaagtccttctccttttccctgatactttggtttcctacttctatttcctggatacacactattccggtatacacactattctatggactaagttagttataacatattgctgacatttttatattcttctctcttcatttatgatgtccacataatttacagttcttgaacaactgatcaactgcaattgcacatcttcattagtaagtgatgctgggcttcccttttttatttagttacttcaggatctttaccagctactctaaagcatttttattctgagcctgatggctttaaaagttagcaaccagtatccaggatcccttcagaatatggcttgcaggtgtaaattctacagattcagataacctcattcagtgctatcttttaaatgtttcaaggctcagagcagtacttatgatcttagaatttctcatcttttatactgttcattaatacttttatagtgtctcatataacctcatgttctaaattgaaaactggtctcggccaggcagagtggctcatgcctgtaatccccagcactttgagaggctgaagcaggtggatcatttgaggttaggagtttgaaacctgcctggccaacgtggtgaaaccccgtctctactaagaatacaaaaaattagcccggtgtggtggcacgcatctgtaatcccagctactcgggaggccgaggcagaagaattgcttgaacccaggaagtggaggttgtagtgagccaagatggtgccactgcactccagcatgggcaacagagggagactcaatataaaaaataactacatacatagatacatgcatacatacatacatacaaacatacatacataactggtctcaatgcagttaatttaccatagtgctttcatataacagccctgatccaagaatttggttttactagtctcttgcttgaaaaacaaacaaattcatctaaatggggagaaattcccagtttttcttcctaaaaatttaaccaggctcctagttatgaggatcaatgctgatatctcttttttcctgatatatgactgatatttgattttccctgctgaatcccaaatctgcataaggtagcaggttttaactctgcagctctcttgctcttaataacattaataagctgactacatattcggctagggtttcctttcattaagttatactttcattcattgcttcgtgcattcaacatttgttgagcctctgcttgcattaaatactatatcatactcacgtctcaagtgttacatacaatacagcttaacatctaaacaataggtaggaatgccagagaaactcttcttgtatctaggcacttcaaacttaccatccccattagccctaatacaagtttttttaaacgttctgtaacactcctgagaagtcatcatcaggctttgcttgaacactcaagggactttatgttcaataccacacaaaacaccctattttctgaacaaattaagtttttttcttttattgatctagaaatttgatgtactatagctatttactgtgattagttcaaaataaatatatattcttcctaccaagataaccccaaatatactataaaaataatgcattgtacattcaaaataaatatactatatactctccctctcatggtaacttttcatctggtatgttctttccccttccccatgcttccttcctacctcttcattccttccttttctttttcaaaataattaatcaattcctcatcatgtaaatggttgtcaatttcccaccatcttcaccaccctctgatagatgcactccaatttgtcagaccgggcacaaaaatttcaatattgcctgactgattggctcagatttttctttattcaaaactcattcttcaacagttaatttccacccttccctttctccttcctcctcaaagggtacagttctacatatttcagtcgaatccaagcacttctttcctcatttactgtttagttgttgcatcttcaccattaacctcctccatagttccccacattcattcattcattattcattaatgcattcattcaacagatcttaattgagagcctacttcagggcaggcactgttaaaatacagcagtgaatagcatggataaaattccctactctaatggagatgccacttgctagtagggaaggtagctaatggatttagaaaaataattaagtgtattatgttagacgttactgagcgctctgggaaaaaaaaaaaaaaaaaactatgccaagggagtggtactcatgagcgctgagggatggcttacaatttttaactgggctggttgggtgatgaaaaacaaaactatagtctcattttccctctttctggtagcgtagcagaaagctggttcatcacttctgagttagttcaatggtagagcaggctgacaccagccactggctctagaagcacttctttctaacaggccacttgtgtgaccagggagcttctgctattataagtttgcataaatatcctgtcaatacatagagcaggatgctgaaactgtaactacagtgtgtgtagagcatttgtgcctcacctcagcagtaggacaatgggagtttgggagattgcatgcacgctacctacttctctgattgtgtgttgttcccacaataagctctgtttctgtcaccatcacatggcactagtggtgtggatccatgacttttataggacatcacagcaggtttcattgtgaaggttgcatttgaatcaagactctcaaggaggtgaaagagagaactgtcagtgctaagggaggggtatgtctgactgggcaatgtggccagagcagaaggaccaagaggaagagtagctggagatgaggttcaaggggtaagtgaggccagatcacttaaggccctaaaggactttagcttttacccttgaagaaacaggaaaccattggagggatgtgggcaaaggagaaacatggtctgtctttaaagttttaataggattattctagtttctgtattataataaaaaaaaccatgaaaatagatgacagagtaggcacaggaagaccagttaggcccatacagcaatcaaggtaagagatgatagtggcctggaacagcacgtagccatataggtgactatatttatattttgagggtgatccaaaaggatattatgacacatcagatgtgatgtataatagtaatagaagacttaagaataattctaaggtttttgctctgagcaactgggagtttggaaggttttgttttgtgttgagggctccaatagagcctaaagtctaatcatagcattctcaatccaaaatcaatcatttccatatctctacataatttctgtctgtgtctatctcttcactaatttctaagctcctgtgatgtcagaggctgtacctattcattatatctcctatgatatcttagcagtctttggcacattagcaatataatacatgtctgccaaatattttttaaatatagatttagaattaacatcttgataagccatatgcatataaataatctgaaatccctaggcagttttccatagcaataagaaagaccttatacttagtttgttttcttgttaatggctttatatgtttatactctgtagcattgaatactaagtagtagtttattttttacaataatcctagacataagttttccttgttacagctttggactttgggttaacagaaatttgtctacttaccagatgtcagcattcaattaaatgaaattaatctaaattattcctagttttttttcagtgacaatatataaaatatacaataagcttttttcttgtaaatttgtttgagttcattgtagattctggatattagccctttgtcagatgagtaggttgtgaaaattttctcccattttgtgggttgcctgttcactctgatggtagtttcttttgccgtgcagaagctctttagtttaattaggtcccatttgtcaattttggcttttgttgccattgctttggtgttttagacatgaagtccttgcccatgcctatgtcctgaatggtaatgcctaggttttcttctagggcttttatggttttaggtctaatgtttaagtctttaatccatcttgaattgattcttgtataaggtgtaaggaagggatccagtttcagctttctacatatggctagccagttttcccagcaccatttattaaatagggaatcctttccccattgcttgttttttgtcaggtttgtcaaagatcagatagttgtagatatgcggtgttatttctgagggctctgttctgttcctttgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcatttgaatctataaattaccttgggcagtatggccattttcgcgatattgattcttcctacccatgaacatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtctgttattggtatataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccttgtcttgtgccagtttgcaaagggaatgcttccagttttttcgcattcagtatgatcttggctgtgggtttgtcacagatagctcttactcaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacagtgagataccatctcacaccagttagaatgggaatcattaaaaagtcaggaaacaccaggtgctggagaggatgtggagaaataggaacacttttacgctgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacacgtatgtttattgcatcactattcacaatagcaaagacttggaaccaacccaaatgtccaacaatgatagactggattaagaaaatgtggcagatattcaccatggaatactatgcagccataaaaaatgatgagttcatgtcctttgtagggacatggatgaaattggaaatcatcattctcagtaaactatcgcgagaacaaaaaaccaaacaccacatattctcactcataggtgggaatcgaacaatgagaacacatggacacaggaaggggaacatcacaccctggggactgttgtggggtggggggaggggggagggatagcattgggagatatacctaatgctagatgacgagttagtgggtgcagcgcaccagcgtggcacatgtatacatatgtaactaacctgcacattgtgcacacgtaccctaaaacttaaagtataataataaaaaatatatatatacaataagcagtaaacaatagggttttaggtcattttgtttgggagagattggggagcagatagttgatactctgtctatgaattttgcagggcatctaaaacgatatgcctgagttctaaaataaaaccagggtaaggatcacaaatttaaattaagcattcattaaattctcagcatgttctctggtgttaggccatctgtagacaatcttggcaaaacgaacctcctagactgctcatcaaagcatcccacttaggagtacagttcttcagcaaaacatctagggccactgctgggcagcaaacgcaagtgatcagtgttgacagtaccattgacccaatcttctcatattcttactaacaactttttgttacctgagtgagaacacatgtgcttgttacaactaaaaactgagtgttaaggaatgtctgtcccagagaatacttagcaagcaacttagggtaatgttctctgatacatgtaaaggataattattagttcaaaaatacttaggatttgataactagtacctgaacgaagagtgtcgattaggttggtttccaatgtgtaaaaatttcaaatattactgaaaactgagtaaattttcatctgctcatgaacattaatagcacgatcaaggcagaacataatactttaaaacaatccttagccttggcaacaaaagtataggcatcaaatatccagtcactagtacttttttatcctaccataaacactgtgttctttttctttttaattggcattcttctgtgttttgtggtgttatcttctcagtcaggtctcagaactgaataataaccactaatgatttgccagtcagttattatggctatgctgataacttctattccaagtttatttatttaacagataacttctatttatattaggtaatgttagtacttcaggttttgcttaacttggaaaacttgataaataatatttgactgtgctcttaatagttcctaattggaaactttaagtcactaaattatgagccactgagtcatttgctaataatgccccatgtatgttagctcagttgagagccaggtgtcatacacatgcaaaataaccagatacctacctaagtgtgatggtctctctaagcaaggtggcctcccttgcctatgctaatatggagttgaaagtgtttgtaaaagggggaaagttatgccgttaaacgaagcatccagtttgcaaatgattacctattgaaaaaggtcgcagtattggtgtaatattatctaagtggatgctaatatgcataaaagagttctctttcaagaagcttccagaacaacatgatgcaggtaggttgtctataatgttaggcagtgaatgaagagtccgggagatgataaccacctcaacgttcccatttaaatgtcactgttactgggccctttttaattctattccaggacgtgtacctaccaataatttttactttagaagtttcttggtgtggtaggaggagtttgatgatgaaaccatgcatccatatatatagaaacaagtggatatattatcagtatggatggaaatatattttacaggttaaatcattctaaaaatatttttatcaaataccttattctgatattgcttacatctgggtttaaatccatactttcctggagaaacatgttatcttttactcttgtctcagtaggtgccaggcattcaaatgctgtttttccagctcaaaggaattaaggacccaaaggcatttaccattgatatataggaagagtggcaacaataagtcacgctacagtgtgtagaaaagtagaaagcatccctaccaatccttaaaatgtttggctgagagctatacactgggtggcaggagaaactgattaaccttttactcctaagaagattcctcaggcatagagtatggttaatgccgtgagacatacagtatttaataggtgttcagcatctcagaaaaaaaaaataatagttattttaggaatatcactgatagatggtggtgctcaggaagcctgcggaatagaacccgaatatatttcgctttctttgcttggtgttttgctggcctttgttggaagtcttatggagcagtttaagtgagcagaagatgagctaaaggaatggaaggaggagacataaggaacttgcagaattaaataccctgccgagatacttgtccattcagcagcttcagttgcttagcactggacctgatcctgtggaggatgcagaagcaatattagaactggcccctgccctccagaatcgctgtctaattggggatacaacacagaacgtacagtaattaaatatcagagccatgaagtgccatgatgcaatgcctaccagagggctaggaaaggtcaaagaaggggccagagtgttgtctggattgtcagggaaggctcctgggaggggtctgggctggacttttgagacagggaagttaaggtcagcagaggtcggggaaggagcagcattccagaatgagcagatatttggagttggaaatgtagctgagggcctcaggaggtagtaggaagctggtctgggtaaagagaacacatgtggaaatggatgcagatttcattagagagacaagagtggccagattatgaattgtcatggaattcaggccaagggtttggatttcataatttagcaaatagcatgatagactttacatcaaaggtgagctgctgtgaggcagtatttagaacagaagagaaagaaagccagaagcaagaagaccatttggctggcagttttctgagagtaggaatgatatagatacctgaattgggatggtgcagctgagaattactgaacgattaacttcatattgcagagaaagaaagcactttacttagaaaggcgacaaggagggctgaacggtgtactaactttgcaaggctagttcacagagagaacaggagagttcttgcaggggggaaacatgggactttgagctagattacagggaataagttgaggaatttggtttcagacacattaaatcagacataaaagctagtcttcatagcagtgtcatgaaaacatttgaagccatagtctgaaattcaggtgagaagccaaaccatatcgaagaatctcctgcattcataagggaaaaacattagtttaagtgaagacagcagcggggccaaagcctaactgtgagggctaactactgtttgggtggaattataatattttagataagatttaagaggattctaattctagctacttgataggaatgcgaatgatgataaggcttttagagttagataagagagagggctagcaccctgatattctgtaattgaaacagagtttcaagtcctttggtcaagtattacccttattccttcaggaatagtagatattttaagattacagataggttatcttatctaatttacctacctattgttgaaattatttaatttgcatttaactgtgttttcactggcttatcatttctctcttctagagctaacttatctcttgttatattccagactcttggtgtaaattaccttcattgaaaattttggagaaatatagtgttttatttctttatggataaaatagtcccagagagagagacacaaggatggacacttagaaaacagtcccagctactcgggaggctgaggcaggagaatggcgtgaacccgggaggcggagcttgcagtgagccgagatcgtgtaactgcactccaaactgggcaacagagcgaaactccgtctcaaaaaaaagaaagaaagaaaacagtccaaggagagaattctaatgcctgacagaagtaatgtttagaatgagggcttctaactgaagttttcacagacataggatagaaatcttagcaccagattttctgccaataatagagttagatgtgtgtcatttgctcattaaaatggaggtggcatcctgtcctctaaaattatatcatgatctcaagaaaatgaaaatgtaccatttctactgcatggctgaaaatgatttgggctgattataaaaattagttgtaatggcatgtatcagtatacttaaaaataaaaaatgtactgcagaatgtgcaatggaatagaaaaggactttgattatcaacaagagtatacttcatggtaggtgaaaagtaaacatgaggccattcatgagaaaagtctgtcattaatgcatcagtgtgtatatgagggctccaaggccattgattctaagaataactaaactccctccaattctcttggccagtctgtttgggtggtgtctgggaatctccttaataagtcactgctatccacaaatatcactaggaccctttcatgacaagagtattaactttggaagaattctgtggctgtcaagtcaagcagttacctgaacagaggcagaatatattggaagatgatgtgaactcattcccagttgtcttagctcacttttacctcatgcttggctgtagaaaactttttgtcacagttcagattaggccatggtacaagtaacagcaacccaaaaaccttaaataggcttcaagaagataattatttctctttcccaaaaaatcctagaaatactccagggctggagggcagggctggtcatctctgttccaggaaatctttagcgatccagtttctttcaggctcatgctccaccatcctgaaggggaggctttcctcctcatgaaccaagatagtagctttcatattccagacagcaggatagaatgaagagccaaaaagaaaggcaaaggcgtgtgtccactgtattgttaggaaaggtcccagaagctgtctcatgacacttttgtttatattccattggccagaacttggttgtatggctataccgaactgcaagggaggctgagaaatgtagccttctctctaggcaaacatagcccaatgcataatctaagacatgaaagaaggggagaataaatactgggagaaagtatacaaccacaccttccttttccattgcagtggcaccatagtatcagcaggtcaatttatatagctgcctgcggaggtgcctgaagcagagtggcagttgcacagtagtgcagcagtcgctaagagcaggtaccctggagtcacatcacttaggtttgagtccagatttttctcatatgtaaaggggaaataatattagtaccttcctcttagagctgtgacaattaagtgaaatactgagtatggcactttcagcatggtacctaagacttcaaaaccatttgataaatgtgattagctcttatattaaaagtaaaatgaaagttttagagcatccatagacatgtaacttttctgtacatctctacaatgtggaggatgtatttacttttttccagctataagagtcagagtggttttcatttctaactgcacttttctccttttgaaaataagctgggatgtgcatgcttggctgggaggatggaggtggtttgtaacaaattgtatgaataattttcttgaattttccatgggttctgcatgtttcattgataccatcttacaggcttttctttataatagttttgatgtgaaggattactttacagtaagcatctacaggttacccctttccactgatgtaacaaagtgggaattgggcaccacatcaaaaggatgaggccattgttggccatccttggatggatggggttcaaagatggcaatgtggagtgggtattctctgtgtttgcctgtaaaaggatagacagctctgaattgcaaaatactattgtctatcaaaatgtaaaagtttggcttgttcttcatttagaaatggtgataggaaagaagtgggtgaaaatggttgtgttgagatatttttgccaatacctaaatgctcttttgcttctctctttttctttctttctcaaagccccctctttgttctgtggcttttcttttgtaactcctccagactacagctttgttcccccttcttccactcctttctggtcaggtactgctttactacttttatttgtctcttcaacttgcttctgcttgcaaataaaatatttgagttccatgtatggcttctcatacggatacatctcctcacagacaatccctcgagttccattaccaccatgcactttactcttctctgtcatagtcaccgttcatcatgacatttcactcctctggtgtttgtgtgtgtgctcatgccatgagacattctataatttatctgttggggagagtttgcagagggatggggctgaaagtataaagggggatgaaaaatctataaaatcattatttttcttgaagaccagaaagtttagttgaaaaaagccaatgtttatgtattttcatgaagaaaataaatagaaataaaatcccaactttgttttcaaatataaaagtaaaattcagtacacattacttgaaaagatgactggcgcccatgaattctgcagttcttcggtttgtgcatgggcattttggtcttgatttctgtcattacccagagagtttaatggctatttacatgacatttagggtatacattagataaagtctgttttctgaccgatttttaaaaattaacctgcacatcccaataaaaatcatagaatttaaaactagaaaaaacttagaagtcatctagtacaaacatttcatttcatagatgagaaaaaatgtggccttgaggggttaggagacctatgcaaggtcaccacacagttgatgattgggtttttccatcataggggtgtttttatgtgcaccgactctaacagtagtgccccagtaatgggacagttttcagtgagaaagctattaaagtggtttgtgtcctgaacagtaaaacaaaatgacctatttttactccctttacagttctgaaatctagagtattgccattcatttatttcgtgatggacacctggagtctaaaaaaatttctgtcattacaaagccatgaataataggtcagagatccctgtggccaagtgggcaggctcttccagggtaacacaggtcataacttctgctgcctgagccctgggaactgttaaaaatacagatggttggtgtttcccatttgtctctttttcttacacttaagttcctttaccatttaagatttataaagtttcaccaacctccgatgagtgattctcagaatcactgaacatataattgaaaacactttataaccccaaagagcaacaggtagagaagttaatataaagcgtgccatgaaacactagagactaacaaacatgaaccactggaatggagttttcttttcagaacagggccagcagggccagggagaaagttagctcctctcctgccatcgaatattaaacacgcgcgcgtgtgcgcgcgcgcgcgcgcacgcacgcacacacacacacacacacacacacacacagagaaactcaactctgaacacaggatatttaataccctgacatcttatttttgattagatacatcagtaaagtttttctgtaaggcagtatttgtttcaaagaaagaaaatatagatggtatttgtgtgttccttctctgagacctgattcacacctcttcacttaggtgaattatatagaaaacaataactaaatttatccccaaatagttttaacatagaaagccttgttagggaagaaagtgccacttaaccagaagtgataacatagatttgacaagagactgacatcagagcaaaatatttcgttgttttgagtgttagttaaagcagttactggataaaaacataaagctttaccttggaggtgctggttagattactgggccatcaataggaagtgtatgatgaaattattttagaatctatctccttagatacttagatattaacgagtttttttaatttgtttttttgttttgttttgtttcatttttataaaaactagtccttactttgattgaggttcttatgaagaatggaaaaacaggacaatggttctttaaacttatgaagcgaatttgcttgcacctgattgaattgaaacagcaattctgctgctttcaagctcctctgccattatcgctggtctgtaatgaaatcacgactgtgcatttgatagcatcaataacattcatctgattaggttgttatggttgttaacgaactgcaaacctactgtcattgcttgtcatttcttgacagtgttaagtccaaaagtgctgggcattgccatcgctcggtatgacttctgtgcaagagatatgagagagttgtccttgttgaaaggagatgtggtgaagatttacacaaagatgagtgcaaatggctggtggagaggagaagtaaatggcagggtaagttggccctctcgatgtgctggtgcatgtgaaagaaggggactgagcagttgtttgcacccattgtggcaccagggagaagcctctatactgtattacagctttcagcccacaggcctctgccctctggaaactggtgctgtgttttgctgataccagggactcgctgaaaatatttgaaatgaatatgatagtgacataaataaaattcacctgggcaagtgggacagcttgctgcttggaaaagagtcgaggagcatttcagttctttttagaccctgagccatagagctaaactttatgtgtattgcaaaatatctataagaactgctgatgtaaattggaaagaatgggacatagtacctctgtcttttcatcctgttctacagcagaaataggaatcattatgcagcagagcccccctgtattatacttaatttacatatttatttgtgtgctagtggattagaacactgtttattttattcctccatttcgatcatttactctattaggcttctaagagcagttaaaccaatcttctcacctacaatggacataaaaccccagtttaattggggtgttatgaaaacaaaatactctgtttgtagaatcctttgaagtgtcagatacaaagtcatgttgctgtgttggttgcttttcttttttaggtgggctggtttccatccacatatgtggaagaggatgaataaattcaaatcccgtgttgcaccctgcaccaaaaatttcagagaagggataaatagaagcctgcacagcatcgtgaattaactgaagtgtttaaaaagctgcatttctggctgttcaacatcctccctccttagcccctcctaagtcttaatgctgagatttctaaagatgctggtactgacagattaatggcttgcctagagctgtgcaagaaacagcctgccagtctgtcattgtcagggaccagggcaaaaccaagagctgttcttcccagaagagccctgcaaacacattggttcgtgcttccctttacttcttctggtcagataccatgaatgccagtcatcagtaaatcttaatacacttttgctttattctcacatgccattcaccagattatttgatggtacaaagaagcagaagtgtaattttccttttcccagcatgacgaaaaattggagttctgccatttgagcagcttactggaaagatccagccttacttgtcttaaattgtccaacaaggtgactcattgcccggcaaacacttttaccctcagatgttactcatgatattataaaatatgaggccagtgctcaggtttgcatcataagtgagctatccctgaagggttttaattacttatttggtgtcctgattatatttgcaaacttctttataaaaggtgaaaaaagcacacaaaagagagggtgtcttcatattaaaccttcacaaccttcatgatttcataggattattttggaaatatagcacttgactttatgaaaggatctgggctaggtatattaagggtagttgccaataacctgaagaagctggcattgtttacagaaacagatcaagggctataatttatgtcattttatagcagcagtatctattaatacatgccttttcctcccatccacctcccccgcacacacacaaagatgacctgggacatgatttttttattcccacattttcttggagcacaaacaactttgttgaggattttggaaggaaagcacaactgggtcctttattcatttctgggacagaaagagggtcagtggacttttgtgggcctccagcttctctcagagtctccccctctgcagcccatcctgggagtgtattaactggagggaagatgggtcttgcagtacatttgttttgcccagccatcactcttttttgtgaggagcctaaatacattcttcctggggtccagagtccccattcaaggcagtcaagttaagacactaacttggccctttcctgatggaaatatttcctccatagcagaagttgtgttctgacaagactgagagagttacatgttgggaaaaaaaagaagcattaacttagtagaactgaaccaggagcattaagttctgaaattttgaatcatctctgaaatgaagcaggtgtagcctgccctctcatcaatccgtctgggtgccagaactcaaggttcagtggacacatccccctgttagagaccctcatgggctaggacttttcatctaggatagattcaagacctttacctcagaattatgtaaactgtgattgtgttttagaaaaattattatttgctaaaaccatttaagtctttgtatatgtgtaaatgatcacaaaaatgtattttataaaatgttctgtacaataaagttacacctcaaagtgtactcttggaatggattctttcctgtaaagtcttatctgcgactctgtctcgggaatgttttgtctgttgccgtcagccgaactttgttatggagggagcagcctcacacaagcagaaacactcctgtggatggtattgtagcatgtattgtttattttagtcaatagaccctctccttataaatggtgtttagtcttcctgttgcatttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagccctcgtgtaatacggtgaattagagtggtatttcactttgtattattttgtaaatatgtcaatataataaatagtgactaaattgat

SEQ ID NO: 164 - DNA, 11233 bp, Homo sapiens
agctttcaccggctgggagtccggagctgcagcagaggccacacccagggcttggtggtcccgcgctttccggagctcagcaggcgcttgctgcttgaaccggtcaaagaaggaacgaatgaatgacccttttgccaggatggagacccgggggcctcagggagctgcgaatcccatggactcctcccgcagcctgggggacctcgggccttttccgcgggaggtagggcgcggggctccgctagctccgggcgcccggaatcccgcgacggcaggggcgagccgaagccagggcggcggccacgaggacagaacggcagatcgggccctcggacctcgggccggggaggaattggaccgtgagtcctgggtcagagagaaagtgctctttctcctgcacccagagaggtggttagggactcgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattatcaggtaacacaagaagtgttgcagacctcctgggccaagggtcgcatgaccacgaggactgaggagcacttcgtgaccgcgctcacttttcgcagcagtagagagggacagcctggggaacgctggggccctgctgaatcccgggctctccaggcacgaacaggggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgtaagcagcataatacctcctttgtggcttgaattccttcgctgtctggggacctaagtcattcagaagaggtggagaaaagatattttcagattggcagaatgtgggagttttgaaatgagaaaacctgttgttaatttgcattttggaataactctcaattgatctcttttctgttccccgcccccctcttgtttctctttaggacctagaaacagaagtgaagtttgaagtctgctctctgcaaagagggtgggagtgggtggagaagaggcttgttttaaaagccaaaaacagaaagtaaaaagaaatgggaaagtaaaaccaaagcagcaagtgactctcttctgatgtgcacttttcatttttctcccccacatttcagtgttagaaagaaaacgagaggagctagggaaagaaggagttggggacagaagactaagatttcaacgtgaaattccatttacaaaggctttactgcaaacaatagctaatttagtcctgtaaacatgcatttatcatacattttaattttaatattaaaaatactgcatgtaaatgttctgaactaaaggtagatagcaatatgtagtttgccataaaatgaatgcatgtcttattcttttccatagttcttcattaatgagacttgtagtcaagaatagattgaagataccattctccttgtgtagttcaaaaaaatctcctctggtaatactgaaacaactaatttttcttattttgtttgttcctctttattattaaatactatgtgaattaactctttagtagttggcctggttgaagctctgtgaggagcaaagcagccctctccaggtgaactgcttgactttaccacctgaaggagtatttactgcaagaattaacaaagcaggtaggactctggcttttgatgagcaaatagttgaaaagtgcctccttccccagtcttcccttttgccttcatttttagtttagagcttgaagtgttctcaaaagatcatctgatctacctcttgcctcctggcaggccagatagataagatgcccctgttttactcatgagccaacctaggcctagaggtcttgtagcatgtctaagtcacacagctagtaattgcatatgcttactaagtggatgaagaatgtgataatctccctcctaaaggtttggggcagcctttagaggatttatttgacccttacttaggggtcaaaagatgcctgaggatatcctaggttttctttctttttctatttttttcttttttttgagacagagtttctctcttgttgcccagactgcagtgcaacggcacgatcttggctcaccacaacctctacctccagggttcaagcgatgctcctacctcagcctcctcagtagctgggattacaggcatgtgccatcaccccggctaattctgtatttttagtagagatggggtttctccatgttggccaggctggtcttgaactcccaacctcaggtgatcctcctgcctccgcctcccaaagtgctgggattacaggtatgagccaccatgcctggccaatatcttaggttttctaactcatgtttatgagaagtactagaatcaccttaatgttcctgaattctgcaaggcctcttggctggagaatcatcactagcagttcttaggcctgtgagaccctcacttgggagaggaattcagcatctgagctcatctgtgttcaaaattgcttgacaggtagaaaagattcatcccttaaaatgaatctcttttccttaacaaccctccctgactccagtgggagattaacttacttggcatgtaagtttcagacctgagcttattaatttggttgaatcatcacatgtcccaggtgactaatcattgaatatagagaacaaaaaaagtctctttcacaataaccaaaaatggtaagtagcatcactcagctgccttctctggaggcaatttctggcgttcagctgcttgggttcaaaactggctctacctctttattaacttgtgtccttgggcaagttgccttatctctgtgtgcctctgtatcctgatttgttaagtggggacaataaatagtatcaacttcatagagggttttttttttttagggttaagttaaatgaaaatacttagaaccctgcctgtcatacaataaatcctcaaagttagttacattttttattattagcacggttattgtttagttcacttttcatcctaactaggctttagtcttttgtttagtaacaaaaagcagaaattgtataacacaagaaagctaatgaaagtcaagccggtggtttttaataagactcttctctactcctgaaagaaaggacttatttctagcttttcctaacctttaatggatcagtaagtatatttcttaaattctttagaaatgaccttcacatcttctgtagggactcatggtaaagctcaaaggactaaggtacactatccttaacagtcactgaaaagagtttacatacctcctagttctgggcagatgggagctttgaatactttctttgacctgtcaggttagtttgttttccctctgggattttaaatctgatgccctgttgtctagaaaagcagaatagacacaatttgttttcattttgtctttcagccaaaaacgtatttagtcaagttagcttaactcctttaaaccaaatatgtttgagttaattttgttttgtttttgagacagagtcttgctctgtcgcccaggctggagtgcagtggcacgatctctgctcactccaagctccgcctcccatgttcacaccattctcctgcctcagcctcctgagtagctgggactacatgcgcccgccaccatgcctggctagtttttttgtatttttagtagagacggggtttcaccgtgttagccaggatgatctcgatctccttgaccttgtgatgcgcccgcctcggcctcccaaagtggtgggattacaggcctgagccaccatgcccggcctgtttgagttaattttaagtgattttttttttccttttctcactgtttcaagcaatgaaaatttatttttaaagtgcttactcaacttccctattaactgcctagaacatgtttatagatttcatttaatatagagttccttttcattggaaacaaaaagtagtaagtccaaatactgttgaatttgcttcacaggtgttcctgatccaagcagaaccctgttatttgaagagcctgagaaatcttatcccgtttacaaatgtcctgggagtgcatccaaagtgaaacttgggcatcctcaatactaagaaatctctgagaatgactggatcttggctctttgatcttacctctactcctctgaaaaacatgattatctaaaattgtgttaggtggatgaaccgcatcaaagacttccagaagccactccagtgaccataagataaatgtcagaatcgcataacccccaggatcaggcaagtgttatcctctcttaaaactctttgtttacaaccatgatctccttttgggaatcattacatttgacttactgcttatttttgttggatgttaccagtgcttggtgataaaacttgatgtggctctttgctttgaaaaagaaaaaaactttttattaaaagaaacagttgtatacactgcataaaaattgggaaaatattatgaagaaaaagaagatataataaaggaaacaaaaatttacagatgaccccaaatctcttttaatatttggcaagtttcaagcatgaattttttgttttgttttgtttttgttttatagagacagcaccttgctatgttgcccaggctagtctttttttttttttgagacggagcctcgctctgttgcccaggctggagtgcagtggcgcaatcttcgctcactgcaagctctgcctcccgggttcatgccattctcctgcctcagcctcccgagcagccgggactacaggcgctcgccatcacgcccggctaattttttgtatttttaggagaaatggggtttcaccatgttagccaggatggtctcgatctcctgatctcgtgatctgtccacctcagcctcccaaagtgctgtgattacaggcgtgagccaccgcgcacctggcgtgcccaggctagtattaaaatcctggactcaagcaatcctcctgccttggcctcccaacatgctgggcttataggcatcagccaccatgcctggccaagtgtggttttattttattgtattttcatgtgaatatacctacatatatacatacatctttctaagcataaactatataaagtagtattaatgtaacctctgtatattttctgaatatgatctgtatataaacaaacatatactgatgctactcaagatgggcgttctgtgaaacggcagcgtgggcatctccaagaaggtttttagaaaagtagaatctcaggccccattccagatctgttgaatcagaattcgcattttgtcaagatcattggatgattcacattaaagtttgagaaacactgacatattctcatatatttagttctgtatcctattttgtcacttaccaaaactgaaaagtttttttattctgtattcccaattaattgttaacaatgccatgaagataataattcatagagttttgaacacagttaaagattacaggaaggtgaaagatagaggatatgaatgggtaaattggcgaagagatctctatgaagctttatagtgtcttttttaaagagccttattatttgaaagtttgtcctaatgaaccattgactcatcattgaatttcaaactatttcagaaatatggctattttgttgtctaggaatatgaaataatacattataaaaaactcctgtaaaggtgaaaaagcaggaagtcattaacacattgcacaattgcaactctgcaggctgagtcagaacttgtcagccacttgtgatgaattgagaggggtggggaaaaggtggagccagaatttgaatcaactgattcagataagtaaacaaagggctgtgactcttgaacaccatgacatctctataactgcagtcagtactttgctctgtaattagggagggcaaatctgtgaatttacttctctagatgaagataaagtccagattactttggagagagtaaggagttatgattggttttcaggcattatgcagccaatagtcacaaacaaaacattaagacttggttatcttcaaagcaaggaactaaccaaattcaaacttacatttctaaccttaaaacagaacaagaggccaagcacggtggctcacgcctgtaatcccagcactttgggaggccaaagcaggtggatcacctgaggtcaggagttcaagactagcctgaccaacatggagaaaccccatctctattaaaaatacagaattagccgaggtgatggtgcatgcccataatcccagctactcaggaggctgaggcaggagaatcacttgaacccaggaggaggaggttgcagtgagctgagatcgcgccattgcactccagcctgggcaacaagagcaaaactccatctcaaaataataataataattaataaataaacagaacaagagtattttgaggagactgcagccctccccaaaatagaacaaacagaggctgtgtttgcagagcttgctataataagagagtcagccaacatcatttgtgcttggcaggaaagcgaaggcaggtagggcaataggaaagctttgtagtggccaagatgatcttacccattcctcagcttgactaaatttcagataagcttcttgacttaggtccctgactttccttttcttagagcatttactttagaagactttgaatggtaaattatttctctgcccctttgaaatgtaaatctaagaaagatccaggtatgtctttcttgaggacctaggagccattactgtgaagtgtaatcactgaaaacaaacaaacaaacaaacaaaactcagaggtctctaactatcagtctctgtgggagggtggaagcccagcttctcaaagtgccaatcagcaaacatagatggcataatcacattgaccaatgtcccttttaacattgtctcgtagtttttctctagctcgccttaatgcttaaaatattcccaccttttgtttcaaaggaattaagttcaatctctctcccctaatgcaatagtttttgttttttgtttgtttgttttttgagacagtctcactgtgttgtccaggctggagggcagaggcgcaatcttgacttactgcaacctccgcctcccgggttcaagtgattttcctgcctgagcctcctgagtagctgagactacaagtgcatgccgttacactcaaatatgttttttttttttttttttttttttagtagagacgggttttgggcatgttggccaggctggtctcaaacttctggcctcaatgatccacttgccttggcctcccaaagtgctcggataacaggtgtgagccaccatgcccggcctctaatgcaatagtcttgaataaagttttccttgctgtttaactctgtcccatgcaattactcttcaacaatagtggaaaaagaaaggctttagttatgttctgcttggagcctattggcatggggggagctggaggcaggtgatctaggacaacttcttacatgattagtttagggatttctcaggtaggccctgagttggaaaaaaaaaaaaaaaagagagagagagagagaagctggcagtcactgaccaagtcctgaccttttgagctgattgctccagaggctgtgttttgacttcccaggttgtgacttccttctcacaaaacttgtaggttggaattctgtaataaatggtatcaacctcataagtttttttcaaggattaaggtgaataaaaaattcttagaacagtgtctggcctataataaatactcaaaattaactattattattataattagtattagtggtagtggtagtgtgttcagtttacttttcgtattttttttggggggggtgcgggatggagtcttgctctgttgcccaggctggagtgcagtggcacgatcttggctcactgcaagctccgcctcctgggtccacgtgattctcctgcctcagcctcccgagtagctgggactacaggtgcccgccaccatgcctggctaattttttgtatttttagtagagacggggtttcactgtgttagccaggatggtctcgatctcctgaactcgtgatccacctgcctcggcctcccaaagtggtgggattacaggcatgagccaccatgcccagccttcagtttactcttcaatctaattaggctttagtctttaatgacaaagagcagaagacatacagcacacacaaaacaatcaaatccaaaccagtggtttttactaagactcttttctgtcttttttcatattttaccatatatgatctggtcattgtccatatatatatatatatatatatatatatatatatatatatatatatatatatatatatatatatatattcagtctttcatttatgttagaccaatcctaaagacagagttagaaactgaaaaacccagtcataaaattctggaagatttagtcacagatttcttttatggagataatcacattatacttgtttattagaaacatccagaatgcagccttgcaagtagcttttttctggaagtgaaatatgctttggcatagtttaatcctgttgacatccaaaatgctatgtaatggatgagtgctacttactgaaagcaaagtcaagtctgcataagtccacctaggcatggggtattatctagtggtcactggggttatagcatacataagcattacctttagactgcgtgacttgttcctggcccaaacccctgagtgttaaatttgctttgtgtgaccattggaccatccttaggccattttctaccttcaaaacatcttgtgactttgagcttatttggaaaggccatgaggtccctggaaaagtgggcacaattgggtatcttgaattcagcttacttggaagaggaaaaaggaggcataaggggtaccacataatttttaacaaagcgagagaactttcagggagaacttcggaatgcagtcagcttctgtaaggattctctaactggtgtccctgtgtcaggaaaagccctaagccaacctatggactttccaatccagcctcaatgttatcccaggctcctgaggttatagggtttatcctacagtctttctatcctaactgggtggaataacgtacaaagttacaaatgaaataaccttatattagaaattgatcaggctgggtgcggtggctcatgcctttaatcccaacactttgggaggctgaggtgggtggatcacctgaggtctggagttcgaaaccagcctgactaacatggtgaaaccctgtctctactaaagatacacaaaattagccagatgcggtggtgcgcacctgtaatcccagctactcgggtggctgaggcagaagaatagcttgaactcaggaggcagaggttgcagtgagccgagatcgcgccaccgcactccagcctgggtgacagagtgagactccatctcaaaaaaaaagaaaagaaagagattggtcatttttctccctgtttgggattctgttggagtggaagaagggattctctgacctatatattcagtggcatgctaaggaccaggcaatgggtggggtttgctcaggagagaacaataagcagtgcatcatcattagagattttaaaacaatgataaagccagactaaaagtctttctgctttctttttttagcctgttgctcaggctggagtgcaatggcacgatctgagctcactgcaaccacctgcctcccgggttcaagctattctcctgcctcagcctcctgagtagctgggattacaggcgcctgcaaccacacccagctaatttttgtacttttagtagagatggggttttgccatgttggccaggctggtctcgaactcttgacctcaggtgatctgcctgcctcagcctcccaaagtgctgggattacaggcttgagccaccgagcctggcctctactttttattactgtcatgtagttagtgataaaatgcttctatctgaaaaaaaatttgttgttctaaattctaaaaaattctcgtgattattgcttaaattttaataaagcagatgtgattttcaaattaccacatttttatttttctttattttttctgtgtggaaggtcattgaaaagcctctatgttgtcctcctaatatctctgtctctccatcaccgtctctctctctctctctctctctctctgtctgtctcacacataaactcaactaaatgcattcattgtgagagtaattttttttttttttgagacagagtctttctctgtcgcccaggctagagttaagtggcacgatatcagctcactgcaacctctgcctcctgggttcaagcgattctcgtgcctcagcctaccaggtagctgagattacgggtgcgtgcagccaaacctggctaattcttgtatttttagtagagacggagtttttactatgttggccaggctggtctcaaactcctgacctcaggtgatccccctgccttggcctcccaaagtgctgggatcacaggcatgagccaccgcgcctggccaggttcagaatctttagagctcgctttgagtgtaccttgtgtcttcaatccttatatataaatacctgcacttcaagaacagatttaacacaaacaataccacagcaattgtggtgtctgaggaagagaacttgagttacttctatcctgccattatatatgacttatttatgtgtaacatttaaaataagaaaatagcaaaatgtattatttttgataagtgttaatttatttcacagctgagctgttttactggatttgagtgaatgtctttaattaaaacttattcttttcttaaaaaatagagatggagtctcactctgtcacccagcctggaatgtagtggcatcattgtaactcactgcagcctgaaactccttggcttaagtgatcctcccacctcagcctcccaagtagctggaactataggcacaagctaccatgcctggctattcttttttgttaattttttttaaactaaggaatgaagaaaataaaacattacatga

SEQ ID NO: 165 - DNA, 3362 bp, Homo sapiens
ccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccaggtgagaggggtcgggcactcagaggatgctctgaccttgaaagggtcctatctggagacgagggagtagaacgtgctgaatgtgtgcggttcagggagcatttggtaaccctgcatttgggagcagtgggcagtaacaggttttggagaggtggacagataaggactgtgatcagcgcccgggtccaagagggcgggtacctggacgtctgggtgcctcaccctctccccgaacccttcccacagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggtgagtcctgaaagctccctttcacactaaaactgtccagcctttgagcgtctatgaattgggcgggggcggggggttggggggggtggggggagaaatctccgccctgagaacactgcggcgccacctgcaaatgggtgttcagcatgcaggattccgctgaagtatcttcattgcaagtgtttaatcgggaagaagagagaagttgggaggtctctgaggtccttatcttcctccgtgtccctcaatgattcaatacaacggttcacctcgtagtggactcttccataaaaatttgtctggggagaaccttgaggtcaattgagaagggggatgatgaggaggacgatgggatcatacagatatcaaagaaaccagctttggcgttcagctgtccttttcatttttcttattgtgattctcacagttttgccagactggcctcgccttctgatttttgctgaaactgttgtcagccagaggactgatttatctgcattggccatttttaagagagatcttggtaccctcacaacttgacttctccatccttccccctccctctaccctctgctgccttaatataagtactcctccccccaaccacagatccactaacttttaatttttcaaaaggtggatttagacagctaaagaggtctccagaaataagctaacagggcgacgaccctccttaggacccagcagtactccaggatgaactaagtaaatctctgtaatatagaaattacacagtaaagtaactggccggtgagattgcaatgttccaggcagctggaattgcatttgcttaacttagtctggtaggacccatatagcaccaggggcagagaagttatttttaagaacatttttaaagtgactgagtttctttttcttaccccaaaggtaatattaaaatgggcagaaatctcacttgcccctaccacagttggtgggaaagtattttaaatggctatactggggatattacctatgactgactgtatacagtatacacattggtgcttctgtccatctggagagttttgcattaacagtaaagaggaagtttggcttgtgtttaaaatgatgtcactgcaatgaagtatctcaagttgatgctggcataacagactgccactgtcacagctgttagcagtaatgcattacaaccctgaagttaatcactatttcctgcttccttaggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggtaaggatgttaagactcattcttagcacatcagaagtgtcttttgaattattttagtgaaacgatgcaggtttaacagtaactatgtacttttttcctactgtcttctccttcgtaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataataccta

SEQ ID NO: 166 - DNA, 14023 bp, Homo sapiens
gccgctttgggggccgcggtctctccgcagctcgcgggtcacatggcccgcctgagcaaggggagccctgcgcctgagctgcgaggcgggaggaggtgaggctccggcgcacacccaaaccgcgctgcgcccgctccttccgggccccggagatggcgcctccaccgggatgagctagccagcctgggcaataccagaggcggccctcggcgcgcgcaggggaccgagctggtcgccccaaccgggtaggtttctgttgcgcacgatctgcccagcccttctggcgcggtggtcggagccctggacactagagcgaggggacaaggattaggggtggccacagctggcacaagcagggcagctgggggttggggagagtcatcgcagagggcctgtgccccgggcagtgcgcctcgggcaggcgggttgcctagcggccctgcccgcagctccgaccgcttcctgccggaggattgcgaggaccccgcaggggtccccagggcagcaggggcccgcatcagtgcggggatggttgagtgtctcgggggcgcctccctggcccttgcctgcgccagctgcgctgacaggtcaatagaaggacgcgagcggggcgcgtgccagtctgggtaagaccctcgccgagcctagcagggccgaagcgccaaggggcctggcgcctaatggccgcccgcaagcaggggaccctcgcggcgcgtccacaccttaggttcgccgggcgcgccgagagcgcggcagcagtgttgggtttctgcgggcgacctcgcagccaagggctgggggagggcgactgggcagaggaaggcgtccctcccaggaccaggaaaaaccagcagaagggaaggagcgcagcgatggagacggtcagctcggcctacgggtgggaaactgaggctcaagcgtggcagggactgcccaaggtcagcgacagacactagatccagggccctggacatcgtcccccattctttttccaagagggagggttaattagatccacctgggtgtgtctcgccctctttctggcccttggctccggcgtcgctagtgtcgcactgcgctcgcggtgtcttggggcgtgagctcctgcagggtcgttgtgacccgcatcctctgctcggcccaggctctctccgggggaccgcagggcggctccaatgatgatctcaccatgcggaccattagcaacacatgcgggtgtgtgtgcgcgtgcatgtgtgtgtttctccttctataggggaaatagcttttttttttaggggtgaatttctagaatgcactgcactaggtactttatgaggtgagaagagaaaatcaacattattagaattattagaatgttgtaaggatacacatattagaaaacatccagtaaacaaaaatccaaaggagaagcaaaataaaaataacttaaaacttcaacttctagatggtttagattttctgcatatcttaaaattttctctatgtatacacatttgaagttttaaatcaaaagcgtggaccaaaaaatggtatcttgtcttaatttgcatgtctttgattacccatgggaattaacactttttcctctgtgtagtagccttttgcatttctgtaggtgagttgattgttaattcttctgcccatttttcagttggagtatctttctcctcctgacttttaaacactttatgtgtattacacattgaagtagtaattctttgtcacgtgttgcactatagcgagtattttctgttaatttttactagttctaattccaaatgatcttttggatactttggtcaattttttattttgatggttatatgggcgtataaatttgacaaaactcatcgaaatatatatatatttaagtggtgcattgtactgtatgtaaactgcacctcaataaaattaatttttaaaggcctagaaaattatcatcctgggtaatgagagagaatttgcctagtcagatattaaaacctgttataaagctttcataatgaaaataacatggccctggcaccacaatgcagagagagatagatgccaaaatccacaaacagatatatatatacatcatttaatttattatagctatagcaacttaaatcacaaatttaaaaatggacttaacaggtgccctgactgtcatgttcaccttcccagtgtctaacacaagactcagtgttgaatcaaatgcttaattatgattataaaagtaatgatctttgcagaagtgtagatatcaaaacaggaaattgccatccccatacccttcttttctccttcactaaattatactccacattaaaaataaaatggtcatatctctgtacatttttctgtaatttgcactgatatagtttgcatttctcccttctggtcttagtctacttgagctgctgtaacacattctcaaagactaggtggcttaaacaacagacacatttatctctcaaaattctgaaagctggaagttccagatcagggtgccagcatggtcaagttttggtgagggctctctttccggtttacatgtgagaaagcagagaagagaagtgatctctcctgtcttttcttataaggacactaataaagaacatgcattactgaggtctgcacccttatgacctgattaccttccaaagaccccatctccaaataccatcatattggagattaggatttataacacgaattttggctgggcaggaggaggacaaacattcagtccaaagcacaaacctagctaagatttcttttatgtcaacatatttaaacctttctcttcttaacatttccacagcatacccttttatgattctctaaaaatctgttccctttgctaggcatttcatttgcctgcagttcttcctttcttccttccaccctcccaccctcttcctcactctctccttctctctttctgtcttctttcctttttcttccttccttcctttcttccctttctccctttgttcctctgcccctctttctctttttcttcctactgcatacaaaacagcactcaacatttcttatccatctttggtagcatgtgttggcatttctgcagagtagattcctagaagtaggatcgttatgtcaaaggggatgcacttataaaatttttatagatactgccccaacaccccaacatttcctccaaagattgcaccaatttatattaaagtgcctagttgttgaactgtgacactccctcgaagtaaattaaattcagatgttaaatatagagattaattatggagaaagggagctctattaccaagtctttccacctaagcattatttttctgtttattaatgactttttaattaccctttggtagaattttgtagtatgtgtgtatattctgcatatttctgaaatttatttctagatatttgagttgcttatttttttcccttttgactgggatcttttactcccttagttcattggtgatcatgtacatgaaagcagtcattataatatagataatatagatacagatatggatatgtaatgcatatatatagtacatgtgtatatatacttgctatgtatattatatattatttttacatattaattctggtaccaaccatgttttgagtctattgccatttctaatggtttttcagttgattttcctgggctccaaatttatgtaggcagtagtgcatattggttgagaatgtgggttctggacacagtctgcctgggttcaagttttgccaccctgcttaaaaacttagttttctaaagtataaaatgggcttaatagtcatacttcttggaggctttttatgaggatcgatagatgagatgcttagaacagtgcctggcacataagtgttctggaaacatttacaaataagtcgatctctacacagtatatgaccagctctttgatactaccaattttatagctgaggacctgagacccatagaggtcaaaagaagccaattatttgcttaacaagcattgagcatcttctatgcatagttctgtgctgggtctgtgagggataccaaagataaatcagactgaatctactaaaaaaggattcaagagtccaatcagatcgtaagtcaaggaccataaacaaggccatggaagacaacaggcatcatagaaaaacatgagctttgaaatttatccttgtccttgaatttcctcttgcaacttggtagcatcagttttgtcaactaaatgggattaattccattgctattttgagagttgctattttgttcagaagaaatagatgcaagggtctagcacaacattgggatatgtagtatggccttaataagcggtagctataaatagatgagtctgaagtagaaagtgacaaatgaatgccctggaggaaaagttcatagaaagggccccagtacttgaggggaaaaaaagagattctttctggttggaaaggtcagggttgggttttggaagaggtaccttttgagctaattcttgatggttgagttagacagtgtgaggagcaaaaatgcagctgggaagatagttggaactggattgtgaagaatcttggcaaataatttggactttattctacagtcatgggggaatcattgaatagttttacagaaaagagtgccatgttctgacttatgcttcagagtatcagatggatgctgatcaagtaaaacatcaccatcatttgcacagtgtcctatgcctgacaaagggctatcatagctgttgtctcttcatcgtcacagtctcactgtgttgccaggctggagtgcagtggcataatctggctcactgcaacctccgactacctggttcaagcgattctcctgcctcagcctcctgagtagctgggattacaggcacgtgccaccacacccagctaattattgtatttttagtagagatggcgtttcaccatgtttgccaggatggtctcgatctcctgacctcgtgatccgcctgcctcggcgtcccaaagtggtgggattaccggtgtgagccaccgcgcctggttgaagtatcttttattttcctgtttcacagagaaataaaataggctcagagagataaatgatttttttatacaaattgatcaaattagtgagtgttgggacgagaattggacctagatcttttggcttgtgttgctcattctggaggtcagaagctctgttaggagcctgttgcaatcagctggcttggaggtgctgaggaggaactagagtgtggcagggaggaaagcttgacaaggggaaggcgaggggaaaagagaggcataataaaagaggccgtagaggtgggattaggaagtgactgcgtggaggtgagaagttagaactaactagtgttttagactgagttgcctgggaaagtggtcgtgccattcatatagtggatttgggaaacacagaacattcttgagcactcatcccctgactcacaccctggtattgtgtcttccacacccgtggatcctttagtttaattttcagaagttgcactaaaatataactattgttgtagctccatttattcatctaagccctagttcatgttcatttctcagagtctgtgtcctttactgtcttccctgagccctacactctagatatggtaacaggtagagaattctgtttagggaagggttgtgtttcaaagagcacatgcaaagcatagataagaactggatatgtattgttctgtagaatcggagctgtaatggtgtaactgttattaggtcagctcataggtgccagtcagtccacagtgtctctggagtgtgggcctcagcctgtgacatcatgggcaactggaattctggaaaaagacaatcagagtggtaacatagacatagccctcttgtctcacccttatgattgggctgggagtaaaaaaactccttccccaaactagcagtgaaaaatcctatgtttttatatctgttcccctaaggccatttatcttttatctttttttgtttgtgtgtttgtttgtttttgtttgagacagggtttttctctgtcaaccaggctggagtgcggtggtgcgatcacagctcactgcggcctcgacctgctggggctcaggcaatcctcctgcctcagcctactgagtagctaggactacaggaacatgctaccatgcctggctaatttttgtatcttttgttgagactaggttttgccatgttgcccaggctggtctcaatctcctgggctcaagccatccacctgcctcagcctcctaaagtgctgggattacaggcttcaggcaccacatccagctggccattcttcttaaaaccagatcagtaaggtgaaataaattataggtgccattggacaccacaggctactgtgcaacaattggttaaatcttttaaaaaaatgttttaaaaagtaaacaagaacatactcctgaatgactacataactccatgtggttggattttcagcaaagcagtcatctaatcttgaatgaaggatctgatcccagctcctgtgtcctaggtgggtgtggtagattgcattaatgttcaaaatgcccctccctggagtacattttctgcccctccctggaatacaaatatttctccagtcattggtctcaggtgtggccatgtatcttttggcactcccttctgctctgttgaatttgagttattatgtgatttgttccagtcagtgaaatgtgggtggaagtgatctgtgtcacttttgagcagtggctttgagagccagcttgtggtgcactattccccttttttctctctaccacaaaaccagcaatgttaaaaacaaacaaacaaacaaacaacaacaacaacaaaaaacagttctatctgcctgggtcctagagtacaaacaacaggcaacagaggcacaattgacctgtaaaggacaagtactatgaacaagaattaaaccttagttcttataagccactgagattttggggatcattactgaagcctgtccttattcgtgtagtgtgtaatgattggggttgggggccgggtcttaagccctgtaagcattctaaaaaaaatttccatactccgtgagcagattgctagatgctttcttttctcctgaggatttagaaattggcctgttgccttttttttttctattgaatcttcattttcccctccttctgctctgtgggaggagtaaatcttcctgtcccattgttttggccaatgaatgatgagtggacttgatttgtggcacactgaaacaaggatgtaaatgtacctgcatgttttgacttggcctcttgtgcagcttccaggcaacgtaagaacacgccccaggtggctgtttcctctgcagcttgatctagaaggaggggcatgtggcatgagctaattctgacctacattctggagctgaccccaactgagccacagctatccacaaacccgtatgcaagaaatacatgttatcactttaagttataaagatttgaggctgttaatcaccccagcaaagctgatcaatataggtagggaccatgtgtcctctgaaccaaatccctctcttttcctgattgtcagtagaacagcagtctcacagacgtagttttaaagtaaaggactatgtgagatgttaatgattttattgtccccagtaggataaattccctgggaccaaaggttctcctgatgtcagttctaggtgtttccatttctttcccccctgacatatcatagtaagtgatagcctttactatgtgcctggcattttccaaactgcctgccctatctcattgtctctagttccctcctctagattgatccagctcccttgtggtaataacaaaggcagggataatagtatgagcagaaatccactcgaatgcctccttttccaaggccaatactgcaggagtgggagttcagcccaattctagtattggcttccatcagcagtgatgtggaagtggtgaggccacgttcaatcacgttcaaccacatggtttgttaactccattgcgctgagcagagcagaggaagaagcaaccagtctgcaatatgctggatgttcacaaaccagcaagactggggttgcataattcaaacctctccttgctttgttccctctttgggtactatccagatctcttagtactaggatagtctgtctcacctttggagtcccatagtacaatctgcttctgtggctgaaatgaaacttgtttctctacttgagaaattaaccatgtcactgtacatttggtattctacacaactgtagagggcagagtaggctaactgctgtaataaagtccaaaaattattggtgtctagacacagtggtttatgtattgctcacaacacagtccactctagtttgggagggtactgggaggtgggcagcggaagggacatctgttccatgccgtcccaacactgggatatgtatgtaaaggattcaaggacccaggcttctgccatctggtggctgtacctcctctagatccaccagggctctccattcagctggcagatggggaaagagaaagtcgagatggcacatctgttctcaactaccttgtcccaggtgtgacacctgtcactttgctgacaagccctagtcacatgactccacctggagaaggcaaactaggaaatgaggtctttctgtgtgcccaaggggagaccatggatatgagagcactggctgagtctgctccacagcagcctcgtatggttcctgggcaatcctccctttgcaataactcacaaactatacagttttcctccaaatgtgtgtaaaccttatgatgcgtctgaggcaacagatttactttctgtactgcagacaccatttagttttgcattgaccttactagcaattattattttatactggctttgcccttttcattctgttttttggcactagtctgttttccatcagaatattagacctgcttacttctaaaatatttttgtgagtttgaacacatggatagattttaatggcatttttactctgcattattttgctttctaacacatttaatattcacagtaaccctatgagacagatattattatttccattttagagctaagaaatataagatatggagaggtaaacttcccaccaaatgagaggcagagctaggattcacaccaatatgagcctggcctcaggcccatgctctgaatcatcatatcacacagcattttttcctggaccaaactgagggcaactgtctcttccatattcacctctgcctttccccccccgctccctcattgaaaagctactcatggatcttcctccagatgtttcctccctccccaagcctggggctctagagtttgcttgcttatgggaaatacttcctctcattggttcccatgatctataaaaataaaatgggagaacaatcaggattaaattaatatgcaatgttaagtatagttgtgtgagattagaagcatatgaatggaaaatgacattaaataacaaagatacttcagagaatcctaagtattccttctcttgttggacaagttttttttggaaattgctatatgcacagttaatcaacaagtattttctgggcccttattctggaacttgctctaaatgtgtatatttcctttgtgccaagccttgcttttttgcccccgttttaagaacccattgtctgtgtagctggtgaatagaaataatgatcccaacagcctacctggagattttctggcattgtaaacctaactaagtatctttaggcgtgatgatttggttgaatgcaccgagatcgtattactcatagaaataataaaaacatccagaggttgttagcagacacaaccaaagaatggtttactgtagaaaatactttagagtctgtagaagctacagagcctcctattataatttctggtttgatatgtgctgagctcagttcttgtccttttgtttttttgtttgtttgtttgtttgtttttttaagttactcttaccattccctacttcctctctctttaggtttgatttctgatgactctggcctgagttccaggatggttttttcttgggaccagacatgaacaaaagttgacctcatgagcacttcaacctctccagctgccatgctcctccggaggctgcggcgactctcctggggcagcactgctgtccagctcttcatcctaacagtggtgacgtttggcctgctggcccccctggcctgtcaccgacttctacactcttacttctatctgcgccattggcatctgaaccaaatgagccaagagttcctgcagcaaagcttgaaagagggtgaggctgccctccactattttgaggagcttccctctgccaatggctcagtgcccattgtctggcaggccaccccccggccctggctggtgatcaccatcatcactgtggacaggcagcctggcttccactacgtcctgcaggttgtgtcccagttccaccggcttcttcagcaatgtggcccccagtgcgaggggcaccaactcttcctgtgcaacgtggagcgtagtgtgagccattttgatgccaagttgctctccaagtatgtccctgtggccaatcgctatgagggcactgaggatgattatggtgatgacccttcgaccaactcgtttgagaaagagaagcaggactatgtctattgcctggagtcatccctgcagacctacaacccagactacgtcctgatggtagaagacgatgctgtaccagaagagcagatcttcccagtcttggagcaccttctgcgggctcgcttctctgagccacatctcagagatgccctttatctcaagctgtatcaccccgagaggctccagcactacatcaatccagagcccatgcggatcctggaatgggttggtgtaggcatgttgctggggcccttactaacctggatatacatgaggtttgccagccgcccagggtttagctggcctgtaatgctcttcttctccctgtatagcatgggtctggtggagctggtgggtcggcactatttcctggaactgcggcggctgagtccttccctgtacagtgtggttcctgcctctcagtgttgcaccccagccatgctcttcccggcacctgcggcccgccggaccctcacctacctgtcccaagtgtactgccacaagggctttggcaaggacatggcactgtactcgctgttgagggccaagggagagagggcctatgtagtggagccgaacctcgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtttgccacaggtccggacctctccctccacacagccacactgcctcatgcagtctgacccacccagtgagggtgcatttgaacactgattatattctccatttgtttttaagctctgctttgtgttagagcttgtgactgccaaaaattttgtgcacagtgatatgactgttttaggatcttaagggtagaattttgtgaaaggtgagatcctttggaattgagttctttctcattgggtatgaaaatggatgtatgtttagaatatatgcccaacgaggcaggaccatgtggatagattccatttgtttccttgacctgatgtaataaaaactgataaaagccgtgcagtgcccggcatcttggaggcaggtgatctggcttttctgttacctgggattttcttttcctatatatctgtagtgcactgataattgatattgttagtgagaactttaaggcacgacaagatctggaagagcttgtgaaccatcaaagtcagattgcttatgttgagtagtgatttaacattgaacatttctgtactactctgactctttgaaaattggacatttcagaatgatacaatataggggagctctttacaagtagcatatcatttttcctgactttcctggctgactgcttaccttcatttctttttcttctaggtagcatgatgttatagaaaaaaaaaaaaaaaaatcatggactgaagtcagaagacctgaccttttatttcagatctctgccatggcctaacgacgtgaccaccttgggcaggtcatataatcactctgggtctcaatttcttcacctgtaaaatgaggacagtaatacttacatgttaaagttgccttgaggattaaatggcagaatatatgtaaaacacctagcaagtgcttagtccatagaagacgcttggcaaacttttctctcctataataaacatatacaactcaagcttatttcggaaaaagatattggtgatgttgtttaaagtatgagatagggcatggagctgccacctatgtaccagctattccagatgaccaagccctgctagaataaagactgacttttcattgtgacctctgaaggatgtgcagctcagctttcacctatccccacgttcacccaagccaaaaagaagaattgttcattcaaactggaaatgatctccagcttggaaatgagactcctcatgagcttattctaagatcagagtctgaaaattattttctcaaaagttacaaataaatgtcttttaacagtactgtcagactagtgaccaacaagttactttatgaggatggatgatgatattagagttcaagcaattgtccagtttgtttcgatgccacagtttgcttttaaattcccatagtgagcttccatcttgagacccactcaacacagaaggattacataaaggttgatcacccacgctctacagatgaacaaattgagacccagagatgctaaactgctctgcaggtcacaaacctgaacagcagcatagccaaaatgggaacggagctcttctgacttcaagcccctgcacttttttcttaaccacattaattttatgaatatctatgtggtcaaagtctcttttgtaaaatctgagtataagctgaactagatcatgtctctgtaagctaagatggcagaaacacattgtcatgttagtttggaggagcaaacagatataagtatgtgttgtaatgttatagtgagctgttatgtatcccccagcaatgtccaaagtgatcagagctactagatgacttattacaatgttcagatcccactccttcattcctcctctctcagtgacctgtctacccccaagctttagaactgagctctctccaacttagaactcattagagtttgttgcattagtgattggatctcctcatgaaagttttttgaccaatgacagtagagcccctttaagctagccaggcccaagatagggaagcactgctggtttacatttctgctctttctaattcagttgtctattgcatgcagacatcccctgcccgacttctccattatggaaggctaaggccatccttccttgtccagtttctctacctacacactaacatgccttttccccatggagtgaactctgccagttgtctttggacattttctgcagatgcaggctcagttctgctcttttgttcccacccacttctagatcttcctccatttaatcccttattcttataaggagtctaatttttgtgtattgtccttgattagggcagctgacagctttacaccaaagctgaagtctctcacttaatcctaagcaaggggctagggagaactaagatatccttcccatatcaagggatataggttactagaagggtggaggtctcttaacaggctcactcacctttcagagtttaaattatggtcaggcttaagaagctctctcttgtgactgagtgtattgcatagacatgtctgtgaaaataaaagcacccattttgctaagg

SEQ ID NO: 167 - DNA, 258472 bp, Homo sapiens
aactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatcacccctagaaggtgctttccccaaccctcctggtgccaaggagagcaaacctccccggggatttgcccaaagtggtgggaggagggttaatatttgctttgttattcggataaggggaggcaagtatgccttgggtgtgtgtgtgtgtgtttgagagagagagaaagagagagagagagagagagaggtgtttttgcagcgggaaacaagcaggaagaggcacagaggccggcgcccctgctcccctcggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggggtgggcgggggcgggcccggggcggcccagggcggggcccgccgcttcccccgccctcattggccgctggcggactcacgtcacccgagctggtgctctcccccagcccctagggaattggagctgaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaagctctcccatgcatttcgcatgttgtttcaaaacggggggacgggggggcagccctgcgcaatctcattgcagatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctggagaggtggattttgagggggattccctacggagaagtcgaggtgtcctctcctgatgcgtgggcggccagcctggctttcccactagagcgtggggatccccattccaagaagttgccagagttcgacagtttgagcagataggtgagcctcccagctttggacaccttggatctcctttggagactccagggtactcatcctgggaggacagagagaagggcgctgggtgggggctgtggctgacctgcgtgtctctcctgcaaaagatgtatcagggttctccagtgtccttaggggacctggcgcaggctggggtggagtgtgggtgcagagagaaggtggggcgaggggaacccaaaggacagagatgtggctaccagagggctgggtggaggtccctgagattttaggctccatctcgctcctgatcccaggaagagagaggagtgagatgagcggtgggtgcttttggttattggttttgccttgaagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagagacaccaacacaataaagaagccgaccttccttcttcactcccccccaccccaaacttggcaagacccaggacccaaacgccattataaaatataatagtgattattattagttatacggaagcttacgtgctggagtccttacatagatttttacttaatcttctcaacatctctgaggaggctactatcattattgagcctatggccccgttgaggaaattggttcagaaaagggtgcgagataaaaacaggcaagggcttcaatccagatctttcagaagtgaacccatgctctttactccttagtacccacccaagcaagctaggtgctttcaggggatgtggggcattgagataagttgaaaagggattttaattcttgagtgtgatcttgctgcagaaacctgtggctccctccccctcccccacaccttttcatgggtgcgggggagtgggagggagccataggtttctgaaaaccattgttctcagtggttttctcttctctttgctgccccctttgaaaatgtgcccttaggatcagagatcagataactaggcctctttgtccttcattctttcttggagaggagcacactgattttgcatcacaacctgaaacctgcagttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattatttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctattttcccttttctttttacttttattatatttatcatttattttctattaacacatgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctgccaggtagtaaaaaattaataaatttctggtcgcttcacttttattaaagtataatttaggaaagaacacagcttagggaattttcacaaactgagcacacatgtgtaaccagcacccaaatcaagaaataaaatattaccagtatccctaagtccttttctcactcacttgctttgttttcaggttttagctattataaatatagcttttgtggatattaaagtctacgtattttggcaaacacatatatggccttctacagggaatcctagaaatggaattgttgagtaaaaggatatgcatgcatacagctttataagaccatcagttttctattgctgtgtatcactaaaaaacttagtggcctaaaaccacacaagtttgttatttcacagttttcatgggtaaggagtctggcacattttagttgggtcctctgctcgagtcttcacaggctgaaatcaaggtataggctgctgggtcccatctagaggcatgaccaagaaacaaccctcttctgagcattttcacggctttaaaggaattgagtttcttgtggttttagacctgaagtctttattttcttgctggctgctgggccaggaccactctcatcccctggagacctctccatagccctctcacacctcacccttcaaatatctgccttcaggaagagcccactctccttgcaaggttaacctgattcgttcaagcccaccaggattgttttccttttggttcttctgatgaactcagagtcaactgatttaggactttaataacatttgataaatctcttcacctttgcgtaatctaatcacagaagtgaaatctatcatcttcacagtcccacctaggctgtccacactcaaaaggaagatgattacatagggcatgtacatcagggagcagaaatcttgggggccatctcagaattctgccggctacagacaaacagccacatggctttcctaagtagttataccaatttacattcccttcagcagtatgtgagagttccagctgctccacattctcaccaacactagatattttacatctgttttcttttagccattctggtggtatgtagtagtgtctcatcgtgactttaatttgaatttccctgattatcaactgaagttaaacacctcttcatatgcttattgatgatttggatatcctcttttaaacacatttgtttcagatgctttgtcctgaaaagtttttcttttgggttgtccatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttctttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctaatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatgttgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttccagcaaaagacgcctgtaacaggctgaagagctaagcaccagattcattgctccttcttcatgggctgcagcaagaccacatttcccagcctgccttgtaaataagcgtgatcatgtgacaattctagcctgtgtaatgcaagcagaagtcatgtgtacttcttccatgcctgatgcataagaattctctatcgattgtttctctgtgttctgctctcctctggggcttgatgtaattgagaacagtacattttgacaccaaatgccaaagcagcatcacaagatgaaaggagcccaggtccctggtccgtgaattagaagaccttatatgagtgagaaataaactgctattacattaagacactgagatttgggagtactgcccaaactaatatgctgtcagtaaatatccctttgcttaagttgctagagtgaatctctaaacctcgaaggcaaaccgagccagatcacaacaaaaattgttccaaagttctgtgagagcacacatattttcacaatatactaccaaacaacttttcaaatatttgtgatttgtcttctccagcaacaaatagaacccattctacacactgttcttcctgctggcaaccaacgtgccctactcataataggtgtttaatatgtgctccttgactatgactacagttggaccacaaggtggtgatttgtccataatctcaggttgaaggtgctggaaaaactattttttaagaaactgttcctgtagaatccatttctctataggcagccattcagctaggaaatagaattaagtgacaaccagcaagtgggcaactggcatgcttctttgtttctctaaaattccccaacttcgatattatcagtagtagaacagatgagctctttgaacaaagaaagtaaagtctgcagttacaacctgatcaaaatccaaaagaagggaaagaggggaaatacacctttttttctcaattgaatgaatatctagaaatcaatttctatttcagaaggtcttattagctatagatcataacgtcatagcacatcagatagtgatgctatagttaggttcacaataattatatattccactcaaactaactgctcaaagaggtctggctttaagaataaaacatgaaatctgaagttcaatttttcattgagttcagatccaacgtttcaaaaagaaactctgtgctgaatttgtgaattattatttgagatacaaataatcacgggacagctcaaaaactgacatttctatttgactttccttattaaggtgtatttatttagctaaagtccacaagtgattaagaagtcaagaaattacatctgagtcaacacttcagtctgaaatgtatagttgtgtattaatggatggtttatatgcgagacacatatgaaaataatttaactgccttgacaattttttgtcactgaagctaatttgaccacaactttttggaaattgttgtgatgtgctgagattgtcgataaaaataattgaataaaacaagttcttacattgaaagtagaacaatgacacactcttaatttcctgacataaagtagacttcagactgttacagcgtattggcagtttctccattagaaaattgacaagaatggggagaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagatggtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctattttaagttttaaatcattcagtttaattattataaaatttaacagaagagaaaatcaaaagaaaactatggaaattgttaaacttcagataaatatgctatacaaaggagatattatttcctaatatacctccctaaaattcataagaaattattgtgtctcatatttaggagtttgtagttacatattttatacatacatggtagataggttacatatatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttgagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagaatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctatggcaagaaataggattgtcaaggaagactgttgagagaaaacaaagcgaagtcctaggacaaaatgttggagaactttggacatgaaaggagaaagaggaaccaggagaggagtcagaacttggacggttagagatatggaaaaagaatcaagagcacacaggcctgtgaaaggaaaggaggagagagttaagaaggaaagaaggaagcaacctcagccactggttttagagacaaagtcattgttgaaataggaggagtcaccctagcacagtggaagaggagacgagtgttaatttgggtccccagatgtaggccctggaataaggacttaaatgcaagtagtttacttaaagagtgattctacaaaatactggtagaggagtggggaattgagataaggaaaggaaggcaggaataaagggtacatcataaagcaagttgtcactgtgggtaactggaactcaatcccactggaaaactgggagctggtgtagaatatgtgcttcagagttatcctgcctgaggggtgaggaagttggggtatttatacacgcattgcattgacatattaattaatgattgagagttactccaggctgatgttaacactccagcattttgtcctggcatatgctcagacagagcagaatttggccatccagaaaaatacttgcaaacagatgcagaggctggcacccacaaaatggtaaggcctatccaagaggatctgagtgtgaaagtaaacatgtctgctacaggaaaaaagcccaatcatgaaggaaagcatcaagtgtgatgaagtggaggtaccaaatatagaccatcccttcaagaggtatagtggttaaaatagaaaaatagtgttacagtcacttgatgtggttttaaaggtatttatgaattaataatttcttagcacttgtcagaccactggagattgctatcccaccagaatattgtgacatacctagccaatcaagtctgcattactctaactggtttttccagtcatttacatttttacaaatgataattataattatgaaattacagcctttcagaacaggaagggatcctagaaagacattaatttaacccttcatttaataaatgaaggaaataaatgagggaaagggcatcgaacactatgtttgtatgcttaactattccaaaaagcatttgagccttgttgctcattggcggtggtttagacaatgcattattgatatcactgaaccagctttccagactggatgagatagacaactagattgggtgagactcctataagtgattagccacatacaccaacttggtctgaccatactaattcatttcaggtcctcctgatgtgcttttttggtttgtttttttaccattttacccgtagaatttttataaattctgattttccaaacaaagctattcatagactcaaggattccacaccaacaaccattgggtttacacttggtaaaagacagaataggaatttatacttccttgactactcccttagtgactaaacagtgctatatatttagtaagcactcaataaataccaaaataaatactgagaaaaaaatttaaaggcttagcatcatcattagattttcactgcacacccagccgatgtctcatgagatggtgcaatcaggaaaaccaagtatgctaggaagggttataggaacatcctatttagtgcctgtgttaagtggatttccttaattgcccttaatagcctaaaattttgtgacttaatcattaagaatccagtgacagaggagaataaggtgacccacaaatcctattcctctttgcctttagcttctcctctatttctgtgggaagaaaaaatatcacttttatcagggcaccaccaattctcttcagtgatgatggaagctcaaacccaagaaggtagttgacatccaagagtcaattctagtcagttccagctgactatgtttctaggaactgtcagccaagaatgggagaccaagagagaccttgaagaacctaaaatgtgggaagaaggatgggaaacaagccatttgtgatctcttgaagttcagtagcagcactttaggcagaggagaagggacagggatccttggagagttgtgtcttaaatgaggtttgtcattaacccaaatttggacccagcagccgaagccagaaacaaaccattctggccataaactagaaaatgaggagaggaccaaagaagagttatgggagtttcaagccaatggaccaagaaattagcaagagctacagtcataccacagggacgtatagaaggagaagattattaaggtcattcaacaaacatatactgagtaagttcagtaaacaaacataatgcaacacactaagacatggatttgggaacaagtaagcaactgggattcaatcttactggcctaagatgattccaatagatagatgaaaaatcaaaccccaaggtgaaaacactttttttttttttttttttttttttttttgtgagatgaagtctcactctgttgccaggctggagtgcaatggcgcgatctcagctcactgcaacctccgcctcccgggttcaagtgattctcctgcctcagcctcccaagtagctgggagtacaggcgcacaccaccatacccagctaaattttgtatttttagtagagacggggttttaccatgttggccaggatggtctcgatctcctgacctcgtgatccacctgccttggtctctcaaagtgctgggattacaggcataagccactgcacctggcccatgaaaacactttttaagtctctgcttgtgttgcatttactaagtttcattggccaaagcaagtcacatggccaagtttagagtcagtgtgggaggagactaaccaagggaatggatacagggagatatgaacaaaacatggatccaatttcctactacaggcccctctgacagttacaacttatctgtgttgtcccatcaaagggtgaggaggctgggatgtttaacctccagctaccatttcttcttggttgatggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctaggtgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcacgtataaaatgaagggttaaacgaatgtctttctaggatcagttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagttttgtctgtctagatgacaagagactgggagatgaggccaaagaagtgacctggggtcagttcatgaccagtcacccatactatgctgaggaatttggattttgcaggtaggtggaaggaggcatcgaagggtacttgggaagtgtggcaggatggccacatacaggacatcctaggataagaagttgagctaatagtgacttggagaagccttgatctctgcctggtttctttgtcctgtggaatcactaattctggcaacaagtagcacatcatttaatagatgatgccactaggaagtcaggttatatgtctttgattccattgtcactggatgatggcatcagtgatactaatggcttgattaattattgtccttgtagtcacactgaacggctggtagagcagccagttctatccatgaagattagtccagctaagaacaaaacaattaaatgcacctcccctgacatataaatatatgaatgcagaacaaatcccgtaacttagaagccaagaagaaaagaaagaacagtggtgtatcaccatgatcctagctcacctaataggcacattactccctgatattccaaagaaataatgctcatttttaattttttctttctggaatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtgagctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtgttgagccctatgaagatgaggcacattgaaaggggttgattctacagacagaaagataacaggttcaagtttatgcccaaggacaagcacacttatagttctatagttctatagtctagtttataagaattcatacaatctgaggtctctattttgctattgcaaatgtctactttatgtgttggggtgtgacaaactgttttagcaattggtctctcgttctaaatgcaaaggaccttctcagaccatgctaacctggtgacacatcctaataagttgaggctgaatgagatcttttgtcacatctggttactcaaagacatgatgtcctcactccacaggccttgtgctattgagagaggagctgaagtcacacataaataatttaggctcctccactgcatgaaaagcatctgtttaaggagctgtcaagctgtccacctctctagtgaaatcatatttactttattcatctaaataatgtggcttgtttgccttctgtgtgaaattgtcttgcactgtttctcattggtgggttttatgggacagcatatgattttctgtgcatccatatgccactctacctctgggaatggaatggcttcttgttcagtagttttgattattatagccctttatagcttatgagtcattgggtttactcaaaatgtccagctcctcattctcatttttttctctatggcccagccatgcccgtcctgaaaaatttttaaaaaggaataataaaaataaataaataaaagtcatgtactctatatttcatttccaatgagttgcttcttgtttgggtaattttttattgtattagagacaaggccttactctgtcacccaggctggagtacagtggtatgatcatagttcacagcagcctccaactcctgggctctagtgatcctctcacctcagcctcccaagtagctaagactacaggcacacaccacctaatctgactaggtttttattttttctaaagacaaggcctggcaatgttgcccaggctggtctcaaactcctgggctcaaatgatcctcctgtctcagcctcccaaagtgctggaattacaggccaccatacctggccttgtttggataattatagcaataggagtccaccgaagtaagttgtgtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgccttgttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctagattttcgttttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttatctgtgtggaatttaatagggtaccaataaggtttcactaacaaattacactttatacgaccttgccaaatgcagcattcttgtgggttattctagctttttaaagggatatcttgcttgtgaagatactagcatgtaattttctagcttagacatctacttttcacccccttttctcctttatttagaaataactctgaacccaaagctgatgtttgggagtagttaacttcttctcttgttttctatagctgctccaaagagcttggacctgactacagaccaaagtaacagagaatgctagcctcatctgtaattgataggatttttttttttgctagaatatctgagagtatttttacctcgtgttcaatctcatgagtttcttttcattccatatctcttatgatgtgccttctgtcttgtgcttagcagagtcctagacagctcagagctaacaagtgcaatgtgcatcactcattggatcacaaattgagtttggccagcacaatgctttcaatctgtttgacttgtggaggagcacgtaccctccagtttaccacaatcctcaccactttctattgtcttttacctgattcgcttagttagacagcctgcttgacccccaatatattaaatgtcttaccaatgcccaaagaactccataaccttagtcatccacactgaatagcacaactacttaataactcttgctagaatctagaacctcctgatctttttaatttactcagcaggtatctatgacatgatactctgcacctaggacatgagcaaaaccggtgttgtccccatagagcttgcaatccaggcattccgaggactgtgttctgagagataattctttccagcataccaagataattttgaaagatgaatatttaggcaacatgtcagtacctcaattttctttttcatttaagattcttctgctccctactactgtattcgaaaccagcctagtggatggctcttcctataagcaagaactatttccttactataaagtgtgtacaatccacttggctgtgggttggagcggctctattagaattgactggggatattcagttggaggttgacaatgagaacacgacaaggcagatgatcagagaaattacagtaattactcacaatcagtcttcgatagtaagtcacaaaattaaaaaggagaatgtaagtcacaaacgtaaaaaggagaatgtaaaagtatgaaccaagagaggttccatgttcctggtttaacagtggaatagtaaatgcaggatatcctccagaaaatgcctgaatgaatggtgcctctactctctgctatggaagttagttgggtccaacgcattccatgggggacgtggtccaaagtggacctgaagagtgtggtctgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcacacaatccagggaaaccagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgcagagcttatccctgttggtaaaattcaggtccccaaatgaaatggacaagcaattatcaactgagccagttttcaatccttggtgattgtttcgtctgccagtttttgtttcttaaacctcttgacagcagtccctcttacaaataaaattataaaaatcctatatagcaaatgatgtccagtgttctaccaaactagatcccgactaagcctgactgaggaccatgaaaaccagcacagtggacaaacacaaagaaagcagccaaaggaaaagtgaagagtctgatccgggaagccttaactgttctgagggttctgaatccatttgagaatctgtaataagcagtagactctcctgagaacaagcgaatgcacagatgcacaaaatttggaatggaggccatgccaaggtcacagaccctctggagcatctacagattccctaagggaagagaactctagtgtttaaaagaagcaggaaataggctccatgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcattcacttctttttctccttccttctggaaccatgcatattttgccttaagagaacaaagtgatgatataaaaaagggtgtgtgtgtgtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcaggagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaaatgttgcattaagtcgggcgcggtggctcacgcctgtaatcccagcactttgggaggctgaggcgggcggatcatgaggtcaggagatcgagaccatcctggctaacatggtgaaaccccgtctgtactaaaaatacaaaaaaattagccaggggtggtggtgggcgcctgtagtcccagctactcgggaggctgaggcaggagaatggcgttaacctgggaggtggagtttgcagtgagccgagatcgcgccactgcactccagactgggagagagcgagactctgtctcaaaaaaaaaaaaaaaaaaagttgcataaatagcacacaggtacacctatgttcatggcagcattattcgcaatagccaaaaggtggaagcaaatcaagtgtccatcaacggatgaatggataaaccaaatgtggtatacagggtggaatatttaaccgtaaaaaggaaggaaattctgacacatgccacaacatgatgaaccttgaagacattgtgcttaagtaaaataaggcaggcaccaacagtcaaatactgtatgattccacttatataacctaattcgagaaatcaaattcataaagacagagtgtagaaaggtggattccagggctggggggggaatggagagttactgtgcagtaggtacagagtttcagtttgagatgattaaaaagttctggtaatggataatagtgatagttgcataatgtgagtgtacttaatatcactgaactattcacttaaaaatcattaaaattgaaaagttgatgttatatatatttatcacaataaaaacattacttttaaaaagaagcagagtttccatatacccttctttattcagcttccccaaaattaacgtcttaggtaaacatagcaaaattaccaaaggcaggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttagtgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacactaaaacaagccagaatcatggtaagatatgttcctctgatacccactggcacttaacaactccaaattttctttctagtgttaaaaattctaagttctaggccagatgcagtggctcacacctgtaatcccagcactttaggaggtcaaggcgggcagatcacttggggtcaggagttcaagctcagcctggccaaaacagcaaaacctgatctctactaaaaatacaaaaattagccaggtgtggaagtaggtgcctgtaatcccagctactcgggcggctgaggcaggagaattgcttgaatccaagaggcgaaggttgcagtgagccaagattgcaccactgcactccagcctgggcaaaaaagtgagactccaaaaaattaaaagtaaaaaaaaaattatcagatccataatgcttcctgcaataagaaacaaaaggtcaaatttcatactacctgatagtgttcaaagtagaaagtttttggaaagcaaaatacagcacacatacattttcttcctctcccctcactttttttattttattaaatcttaatattatccagagtatatcagcagggttaagtagagaaaacatttaagaaccattgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagctgtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaagctgcgctcttccaggattgtcaggcaaagcactacacatgcttctcaatgttgcctgggcttcctcataacatggcagcctgagaggagttggacttcttaaattgtaggtcaggactttaagagcaagtgtgttccagggaacaaggcacaagtctaatggccccttatgacttagattcagaagtcacatggcatcacttccaccatactcgtaattaaagtgatcatgttccccagatgcaagggctggaatcatggacctcatttcttgatatggggagtgtttaaaaaaaagctgtggctttaaacagccacactcttcaaaattaaaacactagaaaaatataatttttaacagaagtggaaaagagtctcttaagctgactgccctcccctttctccaaaaagtctaagaaatattccccaagtatccctctgattgaaataacctctcctttgggtttccatagcagcttgtgaataactctgctacagcacattctattctaacaataaaaagagtaacttatgcttgagtgcaagatattattccaagcacttttcatgcattatctcacttaattcccataacaaaaacattttataagtaaaaaatctgaggcccacaagggttaactaacttgccaaaggtcatagcgctgttacgaggaagagcgagaatttaaaccaaggcaatctggcttcagaactcatgttcttaaaccactccaccacagagtactgttaatagattgctgtgtgcaaatcttccttccctgtgaattgtgagctatttgtaggctgagaccatatcatcattacctttgtctctccagcaccaaacacagtgcctggcttatgacaaggaacacaaaaatacacaatagaaaaatgcacaaaagagaagaaactaaaatgtcaataaacatatgaaaagatgctcaaactttcaaaacaattaaaaatattcaaataagatgaaacattttgcctataaattggctgcagttaaaatatcattaataaatgtcaatccagtgttacttagagaatgggaaaaaggatatttttattcttatttacttttcggtgaatcttggaatatacaaccttatagggaaacttttctgaagtatctatcaaaatgataagtgttcataatctacgacttagagattgaattcctaggatatatcctacaggaaaactctcatctatacaaacagtgataatcacaaagctgttcatcatagcatttttaatagcaaattgattaagatatagttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcttccgtgtttttaccatgtgtcattgcttaattcctttccatttagaaataatattccattgtacatatatatcattttgtttactgttttatcaattgatagcaatgtgggttgtttctagtttttgactatcatgaataatgttgctataaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccattttactatcccaccaacagtgtatgagggttcaaattcctccctatccaggtcaacacttgctggtttgggtgcagttgggcaggggttgattttacccattctagtgtgtgtaaagtgatatctcatggttttaacttgcattctctgatgtctaataatgttgaacatctttctgtatgtttataggccatttttacttcttctttgaagaaatgattcctctaatttgcacatttttaattggatttcttgaatttattgttgaattgtaaacatttttaaaacattcctgtgcgagatccttatcagagatatgattttcaaaatttttctccaatctgtgggttgtcttttcgtttccttcgctatttcttttgaagtacaaatattcttaattttaatgaagtacaatttatgttcttacacttttggtgttgtatctaagaaaacattgcctaacctaaagccatgaagatttatttatatgttctattctaagagttgtacaatattagctcttacatttgggactactaatcattttgagttaaattttgcatgtggtatgagataggaatccaaattcatttttttcatgtgaatatctaattgtccaagcacaaaactgtgcttgaacagactattcattctcattgaattgttctagcatccatgttgaaaatcaattgaccataagttgattatcataaattatttctggattcagttttattccattaaactactatatgtctctcctatgccagtaccatactactttgattactttagctttgaagaagtgttgaaattgaaaaatgtgagtcttccaactttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttatattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaatctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcaccattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgtttctaggttttgttgtttttactattgctatttgttttcctgcacccccacccctgtttttttttctttttttttaattatactttaagttctgggatacatgtgcagaacatggaggtttcttacataggtatatacgtgccatggtggtttgctgcacccatcaacccatcatctacattaggtatttctcctaatgttattcctcccctagctctgcaaccccacaggccccagtgtgtgatgttcccctttctgtttccatgtgttctcattgttcaactcccacttatgagtaaaaacatgcagtgcttggctttttgttcctctgttagttgactgagaatgatggtttcctgcttcatccatgtccctgcaaaggacatgaactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggtgatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgccattgaatctgcttggttaacttaatagttagccaatgacagggcagaggttttcttaaagaccttgaatcaataaggctttttgtttttaccctttgctaaggggctctgttgtgtatatcgggacatatcctcaattctcaagcaggcagttttaaactctgctatggccttcacctcctgtttttaaagagacatcaagtcaactaaaggtgagcacttagggccttcttagatatttcctggttgtgtgtacagctctgcccatgtgtatggccttctaagtgtccaggaatatattagagctttgtaaagccttcaatggacatcttattccctagattcttttacaaaggtttttgtccagccttttatttgccccagttcatattgctacttcaggaaattgcaaccttaaaaatttgccactgattatttttgacaaattccctggggagtaggacttttccaactgagcaaaccctgggacagatcaaataacaacaaatcctataaatggaacttttccagatagcttccaggcaattatttagggatggagctttttaaataactctaaacccagtctgcaccctctactatgtatttggctactggttttcacagctgctgtgattgtgaggttgttcatgttcaaagatgctgcagagctatgaagaagaggatggtcatagggcaatctaaaacagcacagagtttgccattatcactgagattcaacttttttattgaataaacacccttcgggttgctgcaaacctcttgtcaatttcctgtgttctgaataagttgatttggcaatttttttcagagttctatttgcttttctatagcagtagatttttgaaggttcttattctatcatacctgaagtttccccaccccaacacacagcattatctttgaatgtaaaaaaaaatggaagcatcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaaaactttcaatagccaatactttgagtagtggaatgctttttgatttagggactcttttgagaatctgatgaaatcatgtgtcctatttccaaaaaaagtacatatttacattatttgtctataatttgtaagcattcaattaaattaattaatcaggttaagaactgcaaacagcatgtcttcatcaatgtgaagacgtggagaaaagggagagatctgggaacttcaagcccctatatttatacagaagagaaaaagatgcccagagaggaaaccacttgcccacaatcatactgatggtaacagacctgagccacatccaggcctccaaactcccaggtcaaggctcttcccaccaagttaccttgaatcatagaacaaatgattggcctgtttaggttctccaagactcttagaggccctgtgccaaagacaacctctcattactgtgacttctctgactggttctgacctgatttcaaggatccttgagataggaaggtagagggaaaccagacctgccatccaactggtatttactaaatttagatgttcacactgtgctcagcctgataaaaggcaccaagggttcacagaaaaagcccaagacacagacagacagttgaagatctgtcacagacagctatgaagacatgactacaaaacatcgcagcataattctgaagcaaccaggtggtacctggggtatgcacactagaccaaggaaggcaaggagaatctgatgcaggtgtgaatgtaaaggcaaggctccatggaaaaggaaagggaatcaaaggatgtgcagaaagttaaaaaatgggggaaagaatagaaggtatttggggagcaggaggagagtggacaccacatgaacaaaggcaaggagaagagaaggaggacattgatagggaaatagaggaccaggactgacaggaggtttgccagtggtttccttgcatacttccctaccccatggagcccctgcaagcagccccagctttggtgtccctgtccctgggccaaccccagaagctaactatgcctatgtctacttgactctccacagcttccctttgctgaaggtctgtaccacttttatcacaatggccttgcaaaggccaagagaagacgcagcctacaccacaagcagcagctggagagagaccccagggtgagttttccccagaaacctgcctcccaatctctgctgccatggctgagcccaccaagggggtgtggaggggctggcagggaattttgaagtaaaggcacttaatgtactatgatagggcaaatgaatgctttgcagagtcatatcagggactctctgctcctttgtctctgcataataaataatcacaggcccctttgtatggctggaggaagaggaaattgggataccacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttctagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaatcactaggaaggaaagtatgtaataactcagacaagttgttctctgtacattgaaggcagcgtaacctctttctcaggactctcagggaccagctgatgaaaagcgtgtcagatgtttgagttaaggactttcacatgagattcttttgagctgatagaatctgaaaactcattcttgtggggcttttcatgtgaacatttccctgggtttaatttgggcttcaattaggaattcagataaaacagtctctcagcagattgccaaatgacaggccacaggcaattttttctttaacttctcaagagttcccaccttctctaaagaggaatttctgctctaggaagccactttaactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatggccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgggactaattgggtaataaaaagaagagatcagtcactggtgattctaatcatttgtctttctcttcaaaatattatctgttatcaccaaaaggggtgcctatttccccttcattatctattataaggatccaggtagccaattgcctctatctggtagttgtaaccatctgccttgcccatgaagaccaacagaaaatagcagaaaaactaaagaagaccaagtatcctatatcttttccctatcttgtcatcaaggttaaatgctggggatgttgtcaataataaactcattctaggaaaataaataaagcacaaaaatctcataatttttttcaaaacgaaaaaaaaaactgctaatgatgactgcctttttccaaaatattagattaaggtctgagtctttcctgcatgatgttctcgtggttgtctaattttggcatctgctgatagaaaaatagagtggcaactattctgaaccaaaaatcattgactatgaacagtgcaaagatagtaaactaaagattctgccttgtgggtttatagctgttaaacaaaagggtaaataagtctagagtaggaataccccaatttgggggttctcaaacacattcaaacaggttgcaaaaagaaaagtaaatgaaagaaaaagggagagaccaagtagccagaaggaggtccaggcttttatgtcttacatagatgtggcaagttatgctttataaacacagaatttaagagtaagttgttttagcattccctgaaatgtactgtctcctagaactgctaacgttaactacggttgcagccccagcccccagcttccttctccttcctgtccctgcaccacttcccagcctgtctcactcactgtctacaggcttgtggtaaggaacacaaagcccagggagggtggtctgagctgctattcgctttcagggcttcatctactgaggtagctttttgaccaaagaaacctccaagctctgctagcaacccaagaaataaaaaagaaaaaggtagaaacccaaggtactttttggctttttttgacttcagaccagaaatttcaatgatgtttgcctctcatgtaacaactaatttttatgctaaaaggaaaacagaaaaaaaaggactagaaagagctaaagtgctactttccatgtgctcatctttgttcatcaatatgcagacaatagctaagaaaacagattctgatgtagactgtgttaaagatgttcgcttctctttccagttcttcctgctaaaagattagctgactgccaagtatcatcatttagatgctaaaaagcaaaagttgtgtcttgtttatttcagtaatatctttgcacagtgagatgttcaggaaatgactgagcatgtcaaatgaatgaatgattactattttttcttcagggttttaatccatgtaatagtattgcccttctcattttatattttcctccgtatcccaaaatttgtctccattaggaaataaaagtactatatagtcttctccctagcacctcttttacatacattcttaattgtgggtaacagaaaccaatgactgtttcattacttccaagttttatcacaaagaatcccatgaagaaccagttcttaatttccaaaacccaatctgccttcttcctaatcatattcacagtcgtggtacaggcaccaaagcgggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgccaataacccacaaaatttagcttcactggataatataatcacttcagaaatctcataataccactggagcaaaagaaaagtttcctattctttaaaatcaactggacatgatttatatgatttgtgtgtattgtggccaaactcttctttcctttcaattatagtagttaattatttgattatttattataaattaaaagggaagagaagggaaaatgctgttatcttttggaaagtctattttcttttctttctttctttcttttttttttcctgagatagagtctcactctgttgcccaggctggagtgcagtggcacgatctcagctcactgcaagctctgcctcccgggttcaagtgtttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggataaggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctcatggtttgtaaggagacttaaccactccatggtgctgctctacactgatttgtattccataattttccctgctcctctgcacaaagagaattatagagcaggaagagtcttaaggaaacattgattcagcccttgaccttgaagcattaaaatataattttaccattgaggcaaaatagacccagagagagagaaggtgacttccctggggccacacagctataactgataggaagaaaataaaactcgtgactcctctcaatacgaagtctgatttaaataaaaaactaagtgagaattgatactgcttatgaatctgtcgttctttaaacaattgtttgcactaattagtcactgaattttctcaattaaaaataatgtgctgaaaagaagtgaagttgcctcctgagtttatgtcacttatgtgaattcagtgagctcagctataaatggaaaagtgaaaaagaagagggaaataaaaagggcggcacttgagctcactgttctgctcaatttgcttatgccctggagtggccttgaactgaaggcagctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtcctgctaccaaaggcaattctcagtgaaagaaactctgagccacatttagcagctggaggaaatgtgtgagggccctaaagaggaaatctggagagtgcaccacagttttcattacacctgccatgcccacttcactcaatttgtctgtaaattcacatttgattcaagaggcattttctgggatctttgacctttctggaagagtggacatggcttcccagatcaggagctctccgtgcccaatccagctccccatccacccctgctgcccttttccagagattgaactgaactaagaggggaaaacatgaatctgtaggcacatgagctggaccatattttgaacacaaatagtgaagccaagagacccaagtgaaacagtttctgacctagcctcccatctgtggccaaattcattttctagataacatgccaagaggtcagcgggtgtaaaccattcatgagtgatgcaagttgagagttacttgacagcatcaggaaaaggagaaatgcaatgggggaggtatgcataagaagcagggcagaggtatcttcatggatgccccaacctgtgggaaaaattcatctgttctaatcctctgctttcagaatgtggcagggaggactttcagcatctcctctgggcattgcagatatgcctggcttcccaactcaaagagctgctgctggtgctataattaactatttgtggggaacaggggagaattatttactacagctacagaaaggcacagggaaagctgctaatgagtaagcctggtttttttctagatgctgtttttttctagatgttcatttttaaatgatgggtactgttcgtgctgtcatgcttcctaaaggaaaagtgggaactctctgggaggcatcatgctagcaaagccagagatctcttggaagttttaactttctttgggagaattcttacaagccctggtatagagaaaagttaacacagagaaaattggtggctctgtatcgtctttacaattcacaaggtgaagagtctctaatggtgggctagcaaacctttaggacttcctgggaaaatcttagatgtttgaagggcaaaattctcctgatctgcctcacctgattccctccccaaccttccccaagatgcaaaaggaaatgcatttatatatccaatgtgtatatatatatatatatatatatatatataatgcatttatatagcctctattatatcttctaaaaatgattatatgtgtatgcttattaaattcataatgtaactctcttatttagttgttggctagaaaaccagcattcattcagcaaatagttatcaagtccaaactatatacagggcactcttctgcatactgaaatataacagtgaacaagacaaagtcctcctcccagggggcttgtatactagtggcaatgaaggagagaaacaaaaaacagatgaccaagcaattgtatgaatggtggtcaaaatgctatgagaatgagtagagcagagtatgggaagagggagagccatagaggggtgtttctattttataaaaagcatccaggtttggctagtctgggaaagtggcatttaaatatagacctgaaggagatgaggaaggtattcatgtggatatctggagaaagggcactccagacagaggaaccaccaaggaaaaaggcctggaatccaagacacacctggtgtgttccaggaacagcaagaatgcgagtaaagctgcaaaggaatgagccaaggacagtggggaaggagatgaggttagagaggaaaaataaagcaagatcatgggcgacatgataagctggggaaagaactttgaattgactctgaatgagatgtggcttctgtgcctatgggcaaataatagacaatggggtagaggtatggatgagggacaactggactagagagatccatgcaaggcgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagaggaagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagatgatgtgaaatgaacagatggacttaaggatctaggagagaggtcagagttggagatataaattgagaggcatccatctattgttagtgttcaatgccaggagactagttgagcttacctacgaaatgagtgtagatatagaagagaagatttgtgggactgagccctagggtactctaagatttagaagtcaaagagataactggggaccagcaaaggagacagaaaagcagcaagtaatctagaaacaggatcagaggtcaagagaagaccaactttagccattgtgttctagctcgtctacattttaccatagtaacttggccatccctataattatttcttattagaggtatcaatgtttcttcacttttcccctctctgatctatttttcaaacgctttctcaacggatattgaaatacatggttcacacatgaacttatgaaattaaaggatactgatgtgtttgggctgggtagtgtgctttaaagcagcaggaggtcacatttgactcagaatgttgagaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttaaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaattttttttaatactctttagaactctttctgggtattttaaaattggtttagctatttttcctttttgatgcctattgacatgtttgtgatcacatctctttctataaacaggtttcacggtcttaaagccaaaccaagggaattttgaaaatgagtggaattgaattcctgccatttccagtaatttcaaagctttatgggttcaggagaggataacagtgcagccaggtctagaaatgagtaaacagcagttaggcaaagagattcatgtctgaataacaacccaattgctggagtttatctaattggtttgccattatctgtaccaaaaacattgtgtttttcatcttctctacgatgagcatgtcccatttagcaataaagaacttattgcttgagagaaaacaggtaagacaaaatagttttccattccccctgaaaagggagagcagtccatcccaagtaaagaatagtttaatggatgttaatttttaaggacaacttagagaatcaacatgagaaagtttcttctcccaacagaagcaaagaaaagcaattaaaacctattgtgtggaaagagacccaaataattgtctattagggagaaaaggaacatgatagagtccaatttgaggtcattcttgagttccaatacttacactgacaccaattaactgtgctctccttgaacaaaccgttgtttcccccagtcttcagttctcttgtctgtaccatgaggagtgtggactagttagtctgtaaaatgccctctgaggtcctaaatctgagattccagggactaacctgaagcctctccaactggttaatatcaaagccacgactaaaacccagcaattctaaccagtttgtgatccttcctttacatgtctttcttttcatctgagaaatagggctttttctttaaaccaatgctataaagtgtttgcaagaactagcatttatatgttggtatcctcaacttatagaacacaatttcaaatcctgtactgttcaaaccaattcaatagtaccctaaaattccatttcttgtctcgggggaaatattagattatgagatagaggttattcatccacttcaaagataatagctcctctatcatgttttataaattgggatttggtttaagatttccctggtatcatgggtgtgaaggagtgggggtccttaaaataaaaaataatgtttgaaaacctttgatagctaaacaagttcgattctttagcctagtcaatcagtgtatccaacagggataacaagcttgatgcctacacaggccatgcaaataaattacaaattgaggtgggtcagttgtaagcaaaacagctactcaagcaagagaataaacggcaaaatgatcttctcctctgtgtgaggaacacaacagagagtggtggggactgtggtgaacctgagtgtacacaccctcttaaaaggaggaagcggattcttattctcagctaattgttacctccaataatggacgccctggttgccacatctacaattttgaagaaaagtagcaactaccaatctttgtaaagattcttttatctttttaaaaaaattagtgattaaattaaaatttcttaacacactgtccaatctaaagaaaatacatcatcagaacaaatttttccatgcactaccattttgcagtccctactctacaacaccccaggacaggatgaaacctgatagaacacctctatgactagtccgtgacttcattatttgccaaggtagtccacataaaagttcttccttaagggaattccaaagctacttccttgtagcgttggttcataatccacattctcctttctgaggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttgtggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaatgacaaagttcagaaccctctgccaggatgatatgaatctattaatatagactctaaggagtatttcacactgaccccatattaaaaggaaattctaaagcacccaaagttctgaaaaatcattcaagttaaatgaaaaaacagtgtctcaccagggaggctatttgaagactgtttatatggcttaactccaacactctgaatctggttgatttgtgtgtgtatatggctctctgagaaatcagtttatttgccatggaacaatctaatttggtcattcacatgactaaaagtaccagaccaacatgttttcaatccagtcccttgaggcaatttgaattctgttgataacttgtccacacacctgctactgatggatgtttcgtcatgaaattttaatcagagagccaaaatcaatgggtaattgttaatttcaagggtgccaggtgacactcaagtgtagaccaaaccaaatttttataaaacttaataaagtgatttcctttaaatgagtaagtcaagatatctcagacatagattaattcagctaaggatcatattctccagagctgaaatattaactatcattgaacttctatcagtgcttccaaaataattattctaacacttattcatgtgacatgggcaagtcatttaaccttcactaattgtcttcattttatcatctctaccattaaataacaatgaaagtccaaatgactggaaataaattgccttaatttttaatccctatcatggaattacaatgaaagtgcaaatgtctgccaatacatgcctaagacttcaaagctggaagtatgactccatctaaagtacatgttaatttcacaaatacattataactttgccaaagcagaaaaggtgatagtgtcacctactccttttgcatcttcttagttctctacttgttttccttgcctgcccctactccatgaaaaatatgggtgtgaattaaatcagtgttccttaaactgtgttacgctggagtccttgggttttcttccagaacgttgtgaataataaagatattagttaggataaactagattacgctgcagtaacaaattaacttttaactcccaatggtttaatatacaaatgtttccttttcactgtgctacaagtcacaagtccagcatgagctggatagatttgattaatataatgctgttgaaagtttcaccatcttgaaacgccactatcctagcacatgaattccaggacactggaagagaaagaggaagtgaaagcataataagctctacccacttgtaaatgcctcagcttgaaaatgttacatatcactctgctcaccacccattagcgagaactaggcaaaatgaatgtcttaatgaaaagaagctaagaagtgtggttctcccatgtgctcaggaaggagagacaaactggatttggggagcagtagaagtcccttgcatagtgtattttttattcaaaacaacaataaacatgtgaataaaagcccatattctattattctgggtgatccttgggattgagactttcccataagttcagcactcatgtttataattgtattggcagcaatactgccatccagtctctggctattgagaaagggtgggatacaccccgggatgcttctgttgtcctaaaatgattggaacatctctcttcatgtgtgaccttctgcaatagggcctggctcctcctctatccataggtagagtctatttattcacccatgtgaaggctctgtaacattttatctggtagaacgtggtgggagtgatactgggccaattctgggcatagccagcccctacctgacctggtagcttctactccttcctcagagaagctaaagaattgtgattaccctgagaactccatgctgtgagtaggccaagccaggtggagagattgatataccgtggggagagagagaggccaaggagcaccaagataccagaactatgagtgaagaagccatctcagaagtggatcttttagccccagtcccaactgctgttacctggagacaaactacccagtcatgtctttcctgaattcctgacccaaaaaatcttgagccaaataaactggttgttttaagccattagtatgtggtgtaatttattatgcagcaatagataacaagaagacaaacgaattttcccagcagtgcagaggggatgagtggtggagaactgagtcatggcataaagcacattaaaatgaaccccaagacactacaccccagcagtctacagcatagtcacattgtgttttaatcagcattgcttctttggctattattgtttttgtggtgtttatatttaactcgtaaacttgtcttagttttatagttgtataggaaccataatcattaggagttgttattctatcttattttgtgcatattatttatacatatatatatatatatatatatatatataatgttgggcgactaatgaaaaatggttttcttataaaagagtccctttcttgtttaaatttattcgagtttaagaaatcaatgcatttgaaaagatctaaaagaagtaggcttttccaaagtataaactttggcatgaaacagaagcaatgcatcccttttggtgcagtgatatcagcaggtaacagcatacgtagtgagaggagaatcaaaggaagaattaggagttccgagttctaatcacagctcagccatttattgtctatgtgggctccaggtaaccacttagttttatggtcctcaatgtccccatctgtgaaatgattaatgacattacctgtgcttattacatggggttactctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcagaactcttgtccctctctaaattcttgtaaccttctaatctctctggagtgtaaacttgtggccaagattttgagctctggataaattctagttttaatctcaggtccaccactcactcacttgccagttacataagtttacgttgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgattacatggtgactgatactgatctctgaaacttgcctatgtagtagcatttttgttcactgctgtcctttagtaattctacataccataaaaaaattagttatgcatggtggttttattttcatcttaccaaaatgatagtttacagttttaaaaatcaaatgcaagccttataattaaaaacagaagcattttgctccagctttctcaaatccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacataccatgtttatattttttctggcttttgaatatagatgtatcacaagatggggctaggttaatattcagtgttcatattattgtgagtccttaagtactatttacagctgagccatttataccaataacatcccttcctctctcaaacagctttttgtttccctgtagttaataatggccctgtgatgccctctctcaccactcctattcaacatagtgttggaagttctggccagggcaatcaggcaggagaaggaaataaagggcattcaatcaggaaaagaggaagtcaaattgtccctgtttgcagatgacatgattgtatacctagaaaaccccatcgtctcagcccaaaatctccttaagctgataagcaacttcagcaaagtctcaggatacaaaatcaatgtgcaaaaatcacaagcgttcttatacaccaacaacagacaaacagagagccaaatcatgagtgaactcccattcacaattgcttcaaacagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagtttatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagatatatagaccaatggaacagaacagagccctcagaaataatgccgcatgtctacaactatctgatctttgacaaacctgacaaaaacaagcaatggggaaaggattcccgatttaataaatggtgctgggaaaactggctagccatatgtagaaacctgaaactggatcccctccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaatttttgcaacctactcatctgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacacagttcatgggactgtaaactagttcaaccattgtggaagtcagtgtggcaattcctcagggatctagaactagaagtaccatttgacccagccatcccattactgggtatataaccaaaggactataaatcatactgctgtaaagacacatgcacacgtatgtttattatggcactattcacaatagcaaagacttggaatgaacccaaatgtccaacaatgataggctggattaagaaaatgtggcatatatacactatggaatactatgcagccataaaaaatgatgagttcatgtcctttgtggggacatggatgaagctggaaaccatcattctcagcaaactattgcaaggactaaaaaccaaacaccgcatgttctcactcacaggtgggaattgaacaatgagaacacatggacacaggaaggggaacatcacacaccagggactgttgtggggtgggaggagaggggagggatagcattaggagatatacctaatgctaaatgacgagttaatgggtgcagcacaccaacatggcacatgtatacatatgtaacaaagctgcacgctatgcacatgtaccctaaaacttaaagtataataatgatataaataaatagataaataataatggccctgtaaccccaacactttgggaggccaaggtgtgtggattgcttgagcccaggagttcaagaccagcctgggcaacagagcaagacctctgttgcctttttttttttaacttgctcactttcctatctccttatgtctaatttttcccctacattgtctaatagtttcctaaattttttcagtatggtcaaacgcatcccctaaacgatccattgctttatttggttgtcatccaccctagagataccatcctttgacttcacgatgtagtggttgctttctggaccagctcacacctcttaccctagcacttccttcactattatcccaggaattccctgttggctggatagtgttggattcctctttcctggaaccccttcatttccctttctcagattatttccgcattccgatgcagaatgtccttcatgagaggcgactttttaggacttttaatctgcgttcaaatcaattaatagtttgacggttatcaactattaggttgggaataaacatctctcagaaatttgcaagtgtttctctgttatctttgcctacaatggtgccattgggaggtcaagatcattctaattcctgtttcctggtattcctctttctctctagaatttgctcttagttctctgcattttgtagtgaaactcgtttctcttatttgatttttttgtttaagttcatttttttccatgaaagctatgtttctattgacatgacatttgagtattcattgcaaagctttaaaatgtgtgtggcccagtggtggctcacgcctgtaatcccagcactttgggaggccgaggcgggtggatcacctgaggtccagagttcgagaccagcctgaccaacatggagaaaccctgtctctactgggcatagtggtgcatgcctgtaatcccagctactccagaggctgaggcaggagaatggcctgaacccgggaggcagtggttgctgtgagccgagatcgcgccactgcactcctgcctgggcaacaggagcgaaactccgtctcaaaaaaaaaaaaaaaaaaagtgtgtggcccatccacatgcaaatatccttgtttctctgataaaattgctgattgtattcttgaagtgttgattcaataagtgttttcaaaacaacacttttttatttttttattttatttttaattacaaaagtaatgcatatatgcatttttatgctaaacatccaaacaaatgtagaagacaaaaaaaaaaaacacacttgttccaaatcaagcttatatcctccgcagaagaaaacactattatcaatttaatgtgtagctttcagacattttattatatgtcaacatggttatacatgcacatatggaaatagagagtttaatttttgtggtaagagttttttaaccaaaattgaattgtatagtatatactattttgcaaattcctttcttccatttagtagtatatcttagagaatttgacttataagtacacacatattgaatttttcttattaatgactgcataagattccaaaatgtagatatactatggtggaaatttctttcaaacttttcactacataaacaacattgcatgcttctttgtgcacaaatataattgtttctttaggatagctgtcagaagtgaaattgatgggtcaaatttgtgttttggtcttgtaattatgccttatcccagaatgatgccatgtggaagttagacacaggcccttgtgttttagaaagtgtggcagagccttctcaacttcagagtcacccagaggaagttataaaagtcagaagggacctatggctacatatagtgggccatgtctaataagaaggtagttttgttccagaattctttaggtagggaaatgctctaacatctgttagctctacctaagacaaatagaagattctccattaattccccaagtcaggaagtgataatgaggtacacctagtgcctgggtgtttaagatcaaaatgatagctgagtaattaattggcactttccatgtgccttttgtctttctagctggccaaataagcatatctgacagtgtgtggcaaatgataaactcccacaccaaccatgtggaggcccgtatctgctgcaaaaatcagttgttccgatttgcttttcagcaacctcagtggattgttcctttctatccactgcattttcacttgtctggaaggtctttcaagcaatatgactataatttgcaaccaaatctgatctcccgccatatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctaaacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaacttggctggtatggcttctcatccctggcccaccttttatcatactctcacctttatgtttgctgccccctgttggttgctgtgaatcccagtgaatgctgtatgttagccaagcaattgcaggccatggccagcctatgcagcaagccaggtgttctgataccttttcttgcaggaatgggaatgtttctgaaccctctggaaagtgccctgccactctcacctgattctcatgcttactggtcccacctatggataaagattctctctgggaattgcagggaagctgccattcctacctagtatgatgtcccagtaagccacttgactgttgcccttaggtacctccccttccccatattattcttaatctttgaccttcccagtgccattcacacaatccataacagttctctcctaccctggaatattctctattagtctgactccacctttcaggagtttctcatggtgtatgctccactgggggcacccattttgctttctaatgcagttaaggatgtctatataggcatgtatatatttacatatatatatatggatttatgtttatatagctgtgtatctgcacaaatggcagacagacaatccctacctctctctccatacacacacacataaacacacacacacacatatgtatatatatgtatattctgcatatcatattataggatgatacatatgtatgttaatatcaaagggttcaaagaagggagaagacatgggaagtggctcttagtctgccatttgcactgagtcctctgtagctttaagaagaaatatcgatttatttcattggttgtgcttgtttttgacccaaatgttcactttagcccatggtctgatcttttcaaagacaagcttactcaagcaaagaaagaggaaagctccccattgtcacgtcaattatagataagttcatgccaacataatacctcctcctcatcttatttctgtagctcaggataaaaagataatctccaaaggaggcctaaaaaacagccacattaattaaaggaaagagattttttttttctaggaagtgcctaataactaacggacaagcaaaggagactcattagtggaagtatttcctttgaaagggcacacacgctgtgaaaaaaaaaaaagaaagggttatgccaggcttttctctttgtaaataaagtgacaccttttatctttttttctgttaataacacaggctggggagaatgagtctgagggaggcttgtagataagctggcaggatttgaagattattcagatctttagtttcttatttctctatgttctagggtaagacttttcttcattgttcatggccttgtataaagaatggttaggattggggatcttagggagttaggcttaagagtggtggcttagactccattatcccagttaactgatgaaccatttgccatgaacacctttggtaggtcatgctccatttagcaactgggcagggaatccgatcacctcaaacactacattcaaacagaaaggcaaaagatgctataaaagctagatggagagataggtggatacacagataaataaacctgatagaaagatgatagatagagatataaataagtaggtagataaatgaatagataggtaaagagactacagaataattagctaaattctgtagaaagacctaaaagggaaaagatattcacaagcgggggcattcagggtgagtttgaatctttaaggagatttcaaaaaggcacagagtgatgtctaggatttgcatgataaactggaatcttacttggagcacattttaccaacaccccataatgaaggttacacacagaaacagcctcagactctccagaaggaactgtcgaatttgatgagcacacatagagctagactaaatggatggggtgctgaggctgggcttccataccttaagtacctacgaatcatgtgagtgattaaaagatttcttaggtcaggcctaatttctaatcatctctcactcaagccagcatatggccactgtatgagttcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacaaataaggaaaacaagcctgccaaatgacagtttgtcattgcaggagccatggccagaatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttcagcagcaccaggcttggccccgtatacatgaactctgactgctccatcactaacaaggcacatctaatctggaactgtgccttatgctttgctaactgtgacatacagcacactattggcaatggctttcgtccactccatccaccatcaccactggctctactttgcaggagttatctgatccattttctctgttgtttccttgtgagggagagcagacatgcacaagctattgtcaaaggacaaattacaacaaatttagtttaaagatctcgctgggctttatagcaattttagaattggtcaacacttaattccataaaatagaataagtgttccaatgagcctagcagaagaggttggctttctagacagagaatgtaattgtactaggtttgttgcccgatgtgcatggcaaatcaatatgccaagacactggattgtgacagagaagagatttaaccatagggccaccaaatgaggaagagggagggaaaatcaaatctgtctccccaaggagtttggggatagagtttttaagggttatggagtgggctgaagcatggagattgttgacggggtgaagagtacagagtgaagtcatgggacagggagataaagaaactatattctcactctgatttcattactctgtggggggtttcaaactggttggcaacaactgttttgctggaattcaggatctggaaaacaccttaagcaattcttaaacaaaagtcttgtgattttaatgtcagagatcttatctataggaacaatggggatgccagtggtcaggatcagtgctctgtgactatcaggttcaaggaagtgggtaaaagtgaaggctgattatttactcttatttataactatatttctgtccagaattcttcttaaccctgtgaggatggcttcaagaagggttgaagaaagcagaaacaaagaacaaaggatgtattcattatttttcaaagttactttttcttgtcgggtgggaacagggaaatagaacaatagaaaaataactgattagttaacatcaagtcatgtcaggctacttattttgtgtaaggaatacagcagaaggaactttattaccatgtcgattgataattaaaactgacctgcttggaaaatggctgttatttctgtctcccgatttctcagaaggctggataatgtcatagtttaggtttggtgatgtagaactttagcatgggtgactctattttgatctttagtctggtctgttgaagtctagtgcaaaagtttagtccaaaacaacaacctcctataatttttaacactgtaaatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtactagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatgaagtaacagctcttcctggagccccattgccaaaaactagcaataaaggaagaccttactacctaacacatgtggctacttgaaaattatctgaaataaaaacaagccagaatcaacataatagtgtataacaaaacccagatgtctcttgaataaaaggttaatcaaatgctaatgttaaacgaaagagtttcaaaggcaggaggaagaatgttagagataaatgaagaaattaggtgcagcctctgtatgacttggaagagcaagctctctgcacaggatcgtttttttgttttttttaggaaattaagcttttctttcacacctagaatgtgtcagatgctttataagaaaggcactaaatacttttccaggagcttaatcttcaaagtacaatctactaagatgtacctggaggaagaaaaatgtagcaattcttgcaaagcaatgctttggatattacctttctgccatattttggtagacgtttatatataaatcctggtttggtcaggaatccagtaagaatttgcaatgtttgtaaaagcccacctgctttgctcatgaattgcagaacagctcatgcctccctccacagcaccctctgccctggtctccatcccagtgaagggggttgtgctcacagtctgtatcagaatcagtcagggttctccagaaaaacagaagcaatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaaaaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgtgtgttaaaatggggaggaaataagagaatgatacaaatgaagctgaggaagtaaacaggtcaaggaggggagggtggattctttcttgtctgctcaagcataggagcaagtggggtcatgcaattttattttataactagtggctaagcatccacttatcttatggaagaaggtcctcaattctccaagaaccctggtgcttcagagtcagcagtgccattagcaaccacaggtggcgctgtcctttctcaggagagcaccaatcctacaactcctttggttaagattataaccctggccagccagtattcccccaagccaccctagtgggaggcctggggagccttcctaagcccctgggctttgtgtcatacctggccataaggcttgcctgccttcatgctccagatagctttactctggtggcctcgttgcccttgcctaacacctgaccttgatgtaccctcccccagctcaccctgaaagagcagcctgactgggaatctggggatggggtgtttttcctttctgtcccagaacgccctgtcttcctcatgcaaggtgatgagctctcacccaagggctggctctgcaggctggatcacacagctgtacatgcccttccccacttcccattctaaatccacctgatcaagctggactccttcaccaggcccttccaggaacggacaactctgctctgaggagatcccttctcatggaggatgactcagcatgtcctttcatgcagcttccatctaacctctacctcagcaggtgtctgctaccctagggcacatgaggatgctcccaaagccagcagaaatccaggacagcatttcaagaaggggagaggccagggattctgcaacatggtctgtcacagaggagggtggcttcgatggacagcaatagcaagaccagagcaggtgcaattccaagggtgcaaagacagctctggatgctggagaaagtcaatgacagtgagtccctactcacctgctccaccactaatggctgcagcaatgccacggctcatgttctgggctgaattgtttccccccagattcatatgttgaagtcctaacccccagtacctcagaattagactgtaattggagattgggcctttaaaaggataactcaaatgaagtcactagggtgagtcttaatccaatataatgggtaaacacccatgagaagggcaaatttggacacagacacacagaagaaagaccacaagaagacgtaggagaggaaggccatctgcaacccacagacagcagtgtgagaagaaaccaacccagatgacaccttgatcttgaacttctagtctccagaatcgtgagaaaataaatttctgttgtttaagccccccagtctatggtactttgttacagcagccctagcgaacaaatatactggcttcaatctaaatcaacttgcagttagcaatttcaaaagactgcgtgaagctatcccaaaaggctatccgcaaaggaaagctgcgttcttgtgcagtactattaatagattatagaaggaaataaggatgacagatgttactggaaaccaccttgtgcctagaaagaagcatttcctttctctcaaccgaaggacagcagcaaggtcccagatggtgctgaataagcaagtgatcaaatatcttatcattttggatataaatcaatgcagtgatattacctctcaaactttgctcaatcacttagccttgttagattagtcaatatctaggttgaagagcaaaatgagaattggaattggccttttcaaagtcagatttgtgtacctaaaacaagccaaattagttttgcattaaaaaaaataacacagcaagtcacatatgcatatttgagggtcactatgaagctccttgtttaacaactaacactgattgtaataattgtgccactgtggttctgaatgtcaataatgggagaggttctgtggagatggggtatatgggaaccctctgtactttccactcatttttgctgtaaacctaaaactattctaaaaaatatagtttattaatttttaaaaactgaaaatagtaactatttaaaaatactttgactattcaaaaaaccaacacatcaattagtctgtatctatcaatatatatattttagagagtatcactttaaaaataaaaattacccatacccaaagctaaacatcacttaactttttttgtttatatcttttcagtgttttgtctctattttttttattttacaaagctgactttctattgtaaaatcaatgtttgttttactttcctttataatatagcttttgaaagctgcaatgtttttcattgtatggttatagcatcatttatttaacaattcctctatttaggaaaaatggccatttctaattttttgtagtaaatgagattcaaaaaacagtgtcaaaataaattctcttttgtactctttaatgtacatctgattatttgcagaagataaatttctagaagtagaattggtgcattcatcagtttgctcattgtttaggttttttaatacatctctgtcaagagggtattattagcatttttcctctgtcatcaatttggcaggtcagagatggcatcttattttattttaatttgcatgtacttgatttttagtgaaagcaatttttttccacatatttctcaatcatttatagttttctttggtgagaagacaggtaccttgagtgtgtggcttacagcatctatcacagatcactgcctggcacacagtaggtcttcagttagtgactgaattaatgatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggatgttatcatcctgtttactaatggaaatattaagactactcctagacgttaaataactggccctggtcatactctcaagagacagtagcacctagttctgtctgatattccataagccttcacctacagtgctatatcgcttccttttaaattatatttatgtgggatttttgaaggaggtaattgtctttgtctattttctgctgctgtggcagaataccaaagactatgtaataaagaaaacaaagaaaagaagtttatttggcctacagctctggaggcttggaagtccgagagcatggtgctggcatctggtgaggaccttcttgtgttaacccatggtggaagggcaagcaagcatgtgagatagcgagaggaaacggggaccaaactatactttcctgaggagcccacccccacggtacctaaaccatgccctcaataatggcatttatctattcatgaaggctccaccctcatgacccaatcacctcttaaagttcccacctcttaatattgttacagtggcaattaaatttcaacctgagtttaggaggggacactcaaaccatagcaataatatattcacctgcatcaaaaataatatatataggtgtgaagtttaaaaaaaaaaactccttccctcatttgctcatttttacccctacttactttaaataaccactattactaatgttgcacatacaaccttcttgagcctcttttatgtatatacaaaatatgcatatatattcttctcccatctttttacacagatggcagcacactataaacaccattgtgtacctgctgtttagacctttcttattagtacatgagcagcttccttgtttttgttgtgttttgttttgttttgtttttgtttacagacaaatgatattccattgtatgaattgattacattttagctaaccagttcaaatgttacttaacatttgggttctatcaatcttttgctataacacagtgttacatttattgttgaccacatatgcaggtatatctgtaagataaattcccagaaatagaatggttacagcaaagggtatatatatttgtaattttgatggatgctaccaattgtcctccacagcaattgcagtacttatatttatggtacttctgaggtatagaaggtttttattttatcagttagaaattgtgtttggctgctaggaacagagacctaaccacagcagcataaacagataagggttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacattgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaagaaagaaaaaatatttctatatttataagataaaattacaaaagtattaggcaaattaattaacaatatgcatctacatggttaatctatttggaatttatttttgtgtatggtgtgatacaggaatttcttttgtagttagctaattgactcaatatcacttactgattaatttatctagacctgattgtttgaatttattatatacaaatggtttaaaatcaaatatttggattcaatttccattaagcttattgattattaggaagaggagaaattgatacctttacaatgttgggtcatacccttcaagaatatggcatatctcaatttattcacatctggtgggttcttcagcagaatatcatcattttctttatttaggtcttacatatgtcctgtaggtctagtctcaaggctcttatagctgggttattattgtgaatactttttcttattaagttttctggggtgtttttttttatttttgtttgagagtgtctagctttggggcccaggctggagtgcagtggtgctatctcagctcactgcagcccctgcctcctgggttcacacgattctcctgcctcagcctcccgagtagctgggactacaggcacgcagcattatgcctggctaatttttgtatttttagtagagacaaggtttcaccatgttggccaggctggtcttgaactcctggctttaaaggatccacctgcctcggcctctcaaagtgctgaaattacaggcatgagccaccacactcggcccttattacattttctaaaactttattgctaatacatagaaaagctatgaagtttttacatgttgattttctccagcttgctgaactcttattaattaaggcacctataaaatgattctctcaaattttctaagaagaaactctcataaagaataaataatggttatttaacttgtgttttataatatatttatatctcacacatttttcttgctgttgttttggctacaacctccagactaatgaataatagctgtcagtgtggacatccttgtcttgtttaagattttaataagaatgcctctattttgtttttatgtcctttggcttctaacaaattcccattatcatgtttcagaacattttttatgtttctaatttatacagagattaatcagacatggaaattttatcaactatatcaagtatacttgaaacatgtatccacataatcacgttgcattttcttttaacgaattaatttaataaagtgtattatatgaatagatttcttaatataaaatcattttgaaatgactagattagattttactttgtcatgagattatgttttattattctttggattcgatttgtcaatattttatttagaattttaaaaatctatattcctaagatatatttgtctatagtttcctcttctggcagccttcttctcaggaattgttcagcccaacaaatgaactggaaccttcgtgtttttctgtgcttctttacagtttaaatggcaaagaaaacatgcctcttgatggtcaatgtaactcatttttaaaatgggctggtccagtccctttttgaaagtgtatctttggggtttcaatttcttttaagcttactgtctatttaggtttctaccatttcgttagtcatttttggtaatttacatgttccttgaacgtacttattcacctcaattatgaaatttgttgttgtaaacttgtataaagtattttcttttttttttttttttttttttttgagacggagtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaattttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcgtattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcagaaatttcactagatgtgatttattttcagtaatcttgtctgtcattcagtgagagttaacaatctgaacactaaaacttttctgcaaatcaaaaatatgtttgcctgttttcctccatctcctctgttctcttcttctcaaactcttattacataggtataagacactctaggtctctcaacacttcttaccctcccttcctttacttctttctctttgctctgggataattccttgaattcattttcttatttattagtttggtgtttagcaatgtccattttattgctaaattaaatctggaattttaatagtttttaattgcttggagagctctctttttcctatctcttgtttttctcatagcaaattgttcatatcatagtgatagaagcatccctcacatttcactgacattcaaaattgtaataatcttccctgcattttcagttgtttcagtgaggtctgcatttatacgcagttaacacacacacacacacacacacacacacacacctctctcaagagtttaatgcatgccagatattgttttaaatgccattattaccacttcccaagcaaggagactgggcagagcctggaagccaacccagacagtctgattcagagccaggaacactctaccaccgtgcaataccagcatttgttctttacgctcagctgggtctcctatttcaagttgctacttctacagatttgtccctaatttttctatctgcctcatttttatttacttatttatttattatttatttattgtatatttatttttatatatatttatttatttatattatatatatttatttatttatttattatttattttagagacagagtcttgctctgttactgaggctggagtgcagtggctcactgcagcccaactcctgggctcaagccaccctcctgcctcagccttccaagttgctgggactacaggtgtgtgccaccatgcccagttaatgttttaaattttatttttgtagagacgggggtcttactatgttgcccaggctgttctggaactcttggcctcaagtgatcctcctgccccagtctttcaaagtggtgggattacatgtgtgagccaccgtgtctggcctctcacttttacaaataaagataatgtatccatattgataaccactgtggcctgcacccagcccctcctcaagcaagctgatagcagggcatccacaaatgtgcttgtgtgaggggtggcacagacctggggttcaagccatgccagcttctaagggtacacaaagttatagttccataacctcagagggtgcaggactctgatgtgtttcaaagccccagaatctggtgtctgtccgattttactgctccagcctctgatggccaatgagcagaaatgtgactgccagtgtaaagcagcaagacagcctaagcaaagcaggctcccttgggccacagacgtggcttggcaatggtgagtgccaagggcctctgagcaggacacagggtccgctacacagctcagcgtctcaaaaactcccaacatcccagaacaagacagagttaatcagctacataaattgagttaattagctacataaatcatgaaatataagttgttcttatctaaaattataaagaattaccaacttttaaagataaacattaaataagatgaccttttgtagacatccctactgctgacactgccaaaccactcgcgcccctctcagcacttcacctgtgctcacctggacgccatctgtttcctgtcttccagaaattcttccaacctggcctgtcaaactcagccttctgggttttccagctctgttgcatattttatcctaaatgaacatcccttcagttatttcagcagaattttgatagggaaggaaagagagcacgtgagctcaaatcaccttaaaaatgagtcttgtatttctggcagattttatgctgcatatttttaaattaattatcataattttttatcagaagaaagtgtgagaaggatttttcttggtgaagtcacttcaaccctaaaagtttgggtgaattcacggctactgtaaaggtaagccacaagcccacttacgacagctcttcacagtaagataatgtatgtctaaagatcctccattcgttggactcaaagatatttatttttgttaaatatcatatttccttgcagaccagagagcagcatatctagagagtaagctaagcttaaatgagcttcagagtggcccctttatatatttatttttaagggcatttaaaaagattaatgtatccatgacataagaatacaattataatcgtataaccttcattaattaaaagagctgacgtttaagcagagaagttagtaaacagggtattgtatgcagtggggacagccaagttcaaagtcaaaaaaggagctgtttacattagagaaatagcaaagagtccgaggtagcaagaggagaaggaagcagagagcgatacagaacagtgccagacagagacgtggagtccagatcctgttgggtcttgtaaaccatggcagtaagcttgcatttcctttgaagagggaagtgagaagatctgggatttgggagagtagtttggtaactccattgaggtggtgttggtgagtgtcaggtgctatggtggagttgcctgggcagagagagctatgcatcctcgagcatcatctggggaactaggaatggacttatcatgaatggatccagattcaacactaccgtctgaagcagcactagctcaggttgactggactgtgcacttcaggctgcaggaggggctcagggggttgccatgggtctctttccaggactagcccctccctggagcttgctcattacatggcaatggcaagagcggtttatatactttgacaggatattatttggttcagagtcatcagggttatcctcttcgtgaatgtccttccttatcaatataaaatcatatcatgtaatggtttttgcctttgagtctacttcttccaggataaacactgccacctttactgtcttattattacatcagcctgatacacctttgctcattccttcattttttgccttcctatgtcagttatttttaagctaattttttaaaataacatacaattggattttgcattttgatttaagctaaaagtatttttattttagtaaagcactttaagatattttctatgtattatcaaaacaaatacatttgctcttataacttctagactagctcctttttccgccctttattttatgcattatatttttattgctcttttccttcctcttacgctttgaaaacttaatccatctttttattcttctcatggttgtcataaaatataaacatattttaacccattttctctaattataaaatgtcaactatcaaacaatatttattatatcaatcctgagtaagatactaaattttagcacactgttacttcctctgtacttgactacttttcaattttaattgatagaggtggggtttttatgctttgctttcagccaccctcctccacagtctacattttatgactcagcttaaaaggaatggttctcaccacatagaaatggggtgattttggccccaggggacacttggcaatgttgggagacagtcatgattgtcactggtgggaaggtgggtgtttgctactggcatctagtgggaaaagaccaggaatgctgttcaacattctacaatgcacaggacagagtccacaacaaagaattgtccagcccaaaatgccaatagtgttgaggcaggaaaattccattttagaggttttgtggctcttatgataattgtaagttaatattactcattgtatttaaattatttttaccaccagtactttcatatcctcactcttaaatttttaaattcctgtttatccctcgacgggctagaaaatatttttaagtaatttttttttcaagtagactctatagaaaggaggaattatacttccctaagctgccagtatttgagcaaatctttctaacactctcagacacactcactggaagcagatgaagctattagtcagtcattccccagcctctgagaaggaatatttttcttgtagatgttttccctcatatatttgcacatgttacacttccatttgttaatcgcctgtccttatcttacccgtttacctattcctatagtctatgatgcaatacttttatgcattttagctcttgcataatgtatgtgttacaaatatttaacctataatatttaagatatcactgatacttaatatttctaatttttaatgtacagaaagtttaaaagtttatttttttaaaatttacctcactgtctcttccttcacttttttgctagaaaggtcttgtctattctgagatcaacattttcctaagtgcctcatctatttgttttcacatgcgatcattttaagccatgaggatttattttggtgtttgaaaataccctcaaattgttaagcaattctcataatttggtttattaaataattcatcctttcctctctaatatgaaatgctacttttatggtgtaccaaacacaagggcctgtttctgcagtttatgtcttgtttcatcaaatctatcttttcttaccctaaattttatttcaattattttggctgtataatgtttttatatttgccagttttccttcattacaattacttttaacaaccatatttttaattttccttgcccatttattctttcagaagaattctggagcaatttaatccagtttcaaaaaaatagcccttgggacttttggttagaattgtattacatttccaaataccggaagaattattgcaatactagatatcctcagcccatcttccatttctcttttcttctacaatttttatttctttattgtttcctctgagttctggaaatttttcttaagtttaccttttccttcgctaatccaatttttcacataatctgccattcttctggtgcaggggttttgaatgtagtaatcctatttctgttctttatgtgatccttactgatatcaaatcatttcattttggggactctcaggtctattttcataactttgggaagtagaaaaacactctttcccctatcccttgctatatgtctattttggtgaaaagcattgactaactctttggaatgaacaaagctagtcttcttagagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggacagtgtcagagttcaagggatggtcacaacatccagcctgactcccaccccttctgctgaggcagccatgagttagccccagcagtctccacagttcactggctacacctgccctcattagaagtccacagccctgtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttaggaggatgacattgacatctgtgtccaactcgctgtctctctggatatttaagaagtagaaaggtggtcaagggaaagttgaactttatttatgtctcagtttttatagtgagaatatttttatttttctcatttctcattttcatattttttagttaataaaaatagaaaggttttaaacaataaagtccaagataattcctaaaacactgaatttttcctaatgtgagttgagactttaccaaaattaccctcaaaaggagcaagttgccttcaggcgaagtcctcacaaagcctcttataatagtgtgtaatagtaagtgctctcaaaattatattactcataaaataaatttgtatttaggagaggcataatttcccttaaccttaatcaatgctaattgagctcttagggaaatgacccaatgaaataagtataaaaaggatgaaaagaaacttaatgaagatgtagtcactattgcttgggaaggggcctgcacttcaagagtggggtgtcgttgttaaaaagccttctaaaatcaatttagaaagcaagacactaggattgcagaccatcatctacaggataagcaaagagagcaaatgtatttgacgttagaaatttgggaatgtgaacttaggtcttaggataaaatttccagcactggctggatgtggatgccaagagttctgtatctcatcattttggtggaggagacattgctagcagctctgctctgacaactctgtgtgagactcaaaaagcagctggaggaggaggagggctctgatatcaaaggccccttggaggagttaggataaaatagtgtcaagaactgtgagagtaaaaaagcagtggtttgaaatcaatattccatatacataattttaaatgtgtgtgagtaaacaaataaattaatttccataaggagacatttgactgattcatctacagtccaaagagctttgatatttaagttgcctataaaacattttttggatagtcttcttggagaaaatgggatatcaccttatattagagattggagatcaccttttatttggatttttatttatataaaaatacatatattatgaccaggcacggtggctcacgcctgtaatcccaacactttgggagtccaaggcaggcagatcatgaggccaggagttcgagaccagcctggccaacatggtgaaacccagtgtctactaaaaattcaaaaattaaccaggcgtggtggtgcacacctgtaatcccagcttctcaggaggctgaggcgggagaattgcttgaactggggaggcagaggttgaagtgagctgagatcatgccattgcacttcagcctggtgacagagcaagactccatctcaaatatatatatatattattatatttttttctcctcttcaatttacatacttggtacagcagccttgaccttcacaccaagtcaaagtgtgtgaacccagaaataccaatgtttaggatgtaggcaagtaaaaaaatcacacgttttgtctaacatctctccataggctgtccctgcttaacccagaacttcaggcaaccccaggccttgagaaaacaagaatattcttattgggttacagtaggagttttgtgctcaagtcaaaacaggtgatactaaatttttcttaatcttcgaattccatgaccctatatccactcaacaactccctccaccaacccatgtcagtttctatcaattattctttgtcatttgccctgagcatgtttaaatttaccaatttaaacatgctggtaaatggtctgaaccatttgaaaacaatctgaaaaacaattttttcagattgttttgttgctgttgtttactattgcttcttatgtcccattccttgcctccaggcctcatttttcttcttactgaagcacaccccttggtagctctttcagtaagggtctgtaccgaaaacacttttggagccctttatgtccgaaaatgttcttcacatcatgttcactcttgattaatgtattagttggtaataaaattctaagttcacttcctttacctcaagaaacagtggagctattctctttatcttcatgggtagacagccctgtttcaactcctgaattcacacagagaaccaggatccaggccgtgctgtgaatgagatttgtttgaccccagtcatcagaaaagctttgaggaacgcactgtgatgttgttattcagtactggttacgaatagcatggaaagcttcagatctcacccttttcccaatatgttgttggtgttgttattcttgtctcctgtttctggttgaagaagagctcccttccttgtttttgaacatggagatatatttaatattacccttttgtatttgatctatgtttggaatgagaagaaggctcaatgtgagctcactctgacatcttgaaccagagaacttgaaaaaatttaataaatctataatccatttttctcctaaacttttttctataaattctcatcttttctcatttgaatttccccacatctctaatgtcaagttgctttttcctatattgttcaatctcttgccaggcaaagggatgggtatagctcagtgatttaaaaatatatacatatataatatatatatttatattattataatataaccatacatatctatttcatatattatagataattatatataatatatattagtataaccatatatgtctattacatgtatattatatattactatattataaccatatatatctattacatataatatataatataaacatacaatatatgatatataattatatattaatataatatataatatatgtaatatatatgtatggttatatatttttaatatataatataatatatattatattaaatataatatatattatatataatatatattatatttaatataatatatattatatataatataatatatattatattatatataatatgatataatatatattatataatatattaaaaatatatactttttttttgagatggagtctcactctgtcacccaagctggagtgcagtagtgccatctcagctcactgcaacctctgcctcccgagttcaagagattctcttgcctcagcttcctgaatagctgggactacaggcacgtgccaccccacccatctaatttttgtatttttagttgaggggagttttcgccatgttgtccaggttggtcttgaactcctgacctcaggtgatccaccccccaccccgccctcccaaagtgctgggattacaggtgtgaacgaccgtgcctggcctatatatatatttttaagtgagacctctcaatttatgactatatgtattggaggtctctttccagaaccatatatatatacataatatataaatatatattataaccatatatagctattacatagctatatatggttctggaatgagacctctcaattcatgattatccaactgggagtcttttgggaaagttacttcacctctgtaagcctcaggtttttcatctacaaaatggagataataagcataacaatttcttaaggtggttttggagaattaatgatacttggtaaggaaagtgcttagcacaaagtgagcactaaataaacattagttattttattatgacctattgtaagtttttgtgtttttattcacattatgcaggatcctaatgtctagatatatttctgccacataatagccattcaataaatacttatgaaggaattaatagcagtaacagctcaaaagcctaaaagagagaaagtaacagtatattttgagttggggagatggaatttcagcataacattctttaatcagcttttcaatccatgatttcttatctttttaagagccaattactggttaatagatagaattttctgaaacggagcacaggaagctattgtagggacactggactggcaatctgggtagaagattcttttcctcactttttcttgtttacctattttctctacttagaaacttttctgtgttgtgtaatttccataaggcaacttacacatttttttaaaatctgtgagcctgatgggataattgattttgaagtcactccttctgagttttaattgcagctcaattcttaattgtgtgaccatgtacaattgagcttatgattcagtctccccatatgtaaaatgcagataataatagatagcaaaagtttttgcttattgttttcaaaaagaagccatagtagggagagaatttttcagtacccagaagctgcgacaagaatatagttaaaagcaattccacctggcctcctattgtgttttattttgttttgtttctgactgaatcatctgctacggttaagcccacctcagcaggctgcagctcctcccagctctctctcctttcaatctcatttcacaagcctagtaatgcttccattgcctcctcctgttaccatttttttgtttcctacaggttgagattcagtacgttctaagagggagttcagtttctgctccattgaaaaataattatgacaaagcagcattttccaaaatatgtttactaataaatgttaggcaagaaaatgtttctatggcccaggaatttagggaaacactcgtataaataatattaaacagatgtctttatcttaagactatttgacattttaaatatcagaagattctgtcgcttttctgaaaaaggggacaggataagtcacttgcaaaatgaaaatgtttttttttgaggcatctggagaactacttttatgaaaggcacatgttgggaaatgttctgatggagctaaatccaaagaggatagtaagacaagagggatgattggagggaagaagggaaggaatcgtgtgtaatctggtgacaagagcagcaccatcaaaaccccaggcttggctgcaaatctcggctctctgccacttcccagccatgtgattgaaactggtcactttaattcttttacaagctgttttctcatctttaaaatgggtataatactacatctctcaaaaggtcattatgagaatttaattagaaaaatcaagcacatagcctaataagtatgctttcaagacaataaaaaacataaacacagaaaaatgtcttattttccttatgtattttttgcattcctagcatttgcaatggcatcaatcatagtaggcactcattaaacttttgctgaataaataaatgaacaaaaaagctttatcaattcactgaataggtaattaatcaaacctttgcaggtttagcactatgccatatacacaaaaactaaacaaaatattatcattgtaattaagttgaacaggatgcattttgctactgttaggcattcgcattgtgagtgctacagtcttttcttagcctgacatttttctgcaaatgtgttacttccaaaatgagggcagaatttgcatgaataacgttttggtactaaacactgtatttattaggatgaaccatttttatagggctttctaaaacacaattatatggacataaagatggacaatacaatcttatctccctttagccaaagagtattgacaatgcaatttgtgcaaagtttatgtgaattcctgtagttcctcagtcgtttcttggtttgtagataaattatcatgttgagtagattctttgttttcaacttggcattttgatttgttttcttacttgtttacttgacaccaaacaattaaattatgcccccccaaaaaaacgcataaaaataagcccttcggtgactgaacctgcatacagactgatgcagaaaaggctgaagcttcccaaagaggattgtttgaattctcaaacagaagatggtcccaggcaggcaataactgcttctgtctagtgggcattagatttataaagtgaaactgcttttctccaagtttaaaagtataacatgtaaaagtttgaccaggcctcattgcacaagtggagtgctaatgagaaatgggaggactcactgaagggaggacactgttcgcataggaacagtgactcagtgcctcgcagtacccttccctgatttctcattattgctccatctatgcaagactgggttaaaccactgggttcactaacagaagcatttccagtgactccagaatctttttaacgtcctatgtaaagagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaatgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtggtggtggcagtggcagaagagaagcagcctgagagatggctagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctggggagatttctggaagcttccaatcatggcagaaggtaaaaggagagcaggcatcttccatggcaggagcaggagcaaaagaaagagtgaggggaaggtgctacacacttttaaacaaccagatctcacaagaactcattcacggggagcaggcatcttccatggcaggagcaggagcaaaagaaagagtgaggggaaggtgctacacacttttaaacaacgagatctcacaagaactcattcactgtcatgataatggcaccaaggagatggtgctaaactgtccatgggaaacccactcccctgacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccccaaaaaagaactaaacatgcaaagatctgagggaagagcattccaggcggaagtgcaaaggtcccgaggacagaacaaattctctgtgttttaggactagaaataaagctgggtggctgtagtgaagggagttctgtacatgtatcaagtagctattgttgcataataagccatcccacaatttaatggcttaaaacaacaatggtttatttagctaagtattcttgcatgtcattaatttaaaccgagttcagctaggtgggtgtctcatacatctatggacagctgtgggtcatggaggcaactttgctgatcttagccaggacctctagcatttctggggttttcgtgggagcatttgaactgactcaactctgccccatgtggtctcccatcttccaggaggctagcccggcttggtgactatgtaggatcccaaggagagcagaggctcccaggcttcttgaggcctaacctgagaactcacacaccaccacttctgccaaactctatcacagagtaaatatcaaaggaaatcaaaggccagcccagatttaaagggaggggaaacagactctgactcttgatggaagaatctgaaaagtcacatggcagagggagtgaatgaagtagacggagcagtggagtattgtggccattttcgcacagtccaccataaaattgaaaagattgaccagagacagatcatggagggcttggcaatctgtactgatgaagccatggaccagaagagaagtgagtcaatgaagagagtttctcttttcacatggccataaaataatagtgagggctatgacagcaaagaggaaacaaaagctgtagtgatgagtgttagacaattgatgagctgggagagaatttgttgatccaaatgcaatcttctcatccttactgtgttccagaaagttaataggaaagctgaagttcaaaaacagtctccaaaatttatttaaaaagcaatgaataaaaatatatatgtcaagaaataataaatactctgcagagtactaaaccatagtgtattagtatgttctcacattgctataaggaaatacctgagactgggtaaattataaagaaaagagatgctgggcatggcggctcatgcctgtaatcccagcactttgggaggccaaagtgggcagatcacttgaggttaggagttcaagaccagcctggccaacatggtgaaaccccgtctctactaaaaatacaaaaattagccaggcctggtggcaggtgcctgtaatccctgctactcgggaggatgaggcaggagcatcacttgaacttggaaggaggaggttgcagtgagccaatatcatgccactatactccagcctgggtgacagagcgagactccatcaaaaggagagaagaagaagaagaagaggaagaggaagaagaagaaggggaaggggaaggggaagagaaagaggaggaagaggaagaagaagaagaaagggaaggggaaggggaagggggaggaggagagaggtttaataggctcatagttttgcaggctgtacaggaagcatagtggtttctgcttccggggaggcctctggaagcttccaatcatggcggaaggcaaagggggagcaggcatcttccaaatcaggagcaggagcaagagaaagagcaaggggggaggtgctaaaacacacttttaaacaaccatatcacatgagaactcactcgctatcatgacaatggcaccaaggagtgccatttccatacacgagtcattccaaccaccacactgtccccctgataagacttgctgagacatttgctgatacctaattggcttagaaatgcaaaagtacacctctaaagatgaaatttgaccctttcccccaggctctgtctggaggttgggttgctatcacgaggttaaaaaacattgatgataataaacaatcatgataatattttcttatgtggaaattttattacctgatatttgcaacatttaaaagagctaatgaaaataataatatattaatagccaacactggttgagaacttgccttgttcctcttatcttgacctctgagatgccaaaaataaatgttgccaatccatgcatgtgcagttattcaagctatattttcttgaattgaaatataagtcttaaaaccagtctgttccctcacagcagattgatttccttgagattagagagtaggtttcatttatctttatgtatctagtaggtcatatagcatcctgcaccaagtaggccatcaaaaaatattcatggaggcagtggctgacacctgtaatcccagcactttgggaggccgaggcaggtggatcacgaggtcgggagttcaagaccagtctggccaagatggtgaaaccccgtctctactaaaaatacaaaaatttttatttttgtattacgggcgtggtggcacacacctgtaattccagctactctggatgctgaggcagagaattgcttaaacctggaggggcagaggttgtcgtgagccaagatcgcaccactgcactccagcctgggctacagagcaagactccgtctcaaaaaaaaaaaaaaaaatcatggaaaaagtgaataaatggtcttcctcagggatagaaagggtaaaaaatgttttttaattagaaagatcaacaactagagtagtttgagcccattaaacatagagcaaacctccttggacaccctccattttcatgtctgtgtataaattgaacaagataatgaaaccttctgcttataagaaaaaatgttagtttctattctgcattgtagtagattttaaaaagatttccattgaaaacatctactttttaacatttggtgctaaatttgtaagttcctgtttccgaaaaaaattcacttaagttgactaatttatttcctgataaatattacatgaatatctcatatgaatatatttctttaaaaatttaggcacctataacctgattcttatcccaatagaagcaattaaggggcaggtggtggtatcacctttaactgaagtagtaagctgttggtcttccaaggtgacccagcaagcagatgactgaatccaaaagtgggtgatttatcatgtcattctgggagaacatgaagaagttctcagcttttagaatgtaccttaggccaattacgtgcacgttgacaaagatggatgtgtcttcattatgtagtttattatggatagatcagggctgggacaagaacctacatcttgtgatcctagtacagtacatttttaggaagcacaacccccatagatgaccctacaaggagcctatactggagtgaaataggaggctgtgagttttacaagacatcaaacaatggctgcaaacttgattttataggtttagtaatatctccagggaataattctctttccctttccctacttctgtaattggtatatactctaaatgccattagacccagcttgctctaaagatctgtagggatagtatttctctctctccctcattcagtatgtgcccatgtcaggcctaactgaacacagggaccaaataaatagaagatattccattcagattttatagcctgactgctttactctgcaacctctattattgagaattatctattttgactgcaaacacgtcatttcatcaaaggttctttacaaagcagatgacattgaaaagcagcctcacatttttcaggtttagagactagatttttatggacttggaaacttggaagtcagctcaccattctggcatagtcttcctgccaagcccaaattctgaaatcagtgtgggagcaatcagtgggtgacatccatctcagagtcaaagaaacaggggacttctgattccttgtaatttctctagaagtaaatcctcttttccttgactggcactcttctcttttgagggccaataacaacctactcattaagaaccatttaacattttccaaaaatacttccaaaaccattaactcatttgatccatgtatcaattctatgaagtcagtaggccaaatattaatatttgtagtgaacaagaaagccaagcacgaagtgttcaaaaaactaacccgacaacaaactgaaaccctggatattatcaggataacaaaaaaatcacctgacctgacccccagttaggaaatttcccactgtcctatgcactgttctgcacacagtaggaaatttcccaattaggggccaggtcagatgattttttttgttattctgataacattcttctcttctagactatgagaagagaggtgctgtagtggtggagaagcgagtgtgtgtgtccccaagaatattttaggtatggccaccaagttagccctaaagaaactacaattaaactaggaaatagagcagataaactctgtgtctagaattctaaacttcttagatttatatgtcctaaacccaagtctttcccgtctcttttcaggctgttcccacaagtactgacattacttccaaagaggagaatttgggtcactaatctagcgaaagcatcttcccctctgaattcaccatcaagatgaatgctatccactagaaatataaaggaagccacataggtgatcttaaattttctagtgggcacattttaaaaaggaagacaaggcaattaaaatataattttaataatatatttcacttaacccaacatatccaaaatattaccatttcaacacatgatcaatattctaaactacattagtgagatagttacactcttattttcattcttagtcttcaaaatccagtgtgtattgtccactcacagcacacctcaactcagaccagccacgtttccagggcctcaaagtccacacctggccaggagctgacggtctagctcctgtgagtaagctagtcctcagattttataaaactctctcttcagggttgtgctcaccttccccctcccactcctgctgctcctgacctccatcaccagaagagacccccaagagcaaatcatatttttgtttccaagagggcccactgacaacactaaaacccaggaggaagcagttgacttaagaccttcgagtgactcactttgtaggaaaagcagagaaaggctggcaaacaagaaaaacataagctcatttttctccccctcatcaacctcattccccaacctgtttgcatcctgaagagggcagaggcctccaaagttgctttagagggcagaggcctccaaagttgctttctgggtcactgcggggtgattcacccaacaataggctataatttacaaggtttttctctgcaagtcaactcttgctaatggaaggacgacatgaatgttgaggctgacaggctggaagataagagtagttgtttgttccctcagcccattgaaaaatccagccccaaacccatttgaagaacagttcctaatagataatgagacacaaatcgtgtgtacctgattgtaaatgaatagctcatatgcacaaagcaaactgtaaaacctccatttctcagccaggatagcactccattaatgatgtgcttttgtttcttccaaagactaagtgctcctttccaggagaaaatagacctcaacctcacctccccacccaccatgtccctacccccaccccaaagagactgcattaccctgagtattaatatacattgcctaacaaataggcaggcaaccaaaaactgagcaattttagccatttaaaccctgtcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcaattgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgctagtcagtggcctcaaaaattgaattttcacgtgttgtctttgccacttaacattatcagaagcttcttgaatgtttactaatagaagtgtgactcctttcatgcttgctgtgtctaatgttatttttgtgttagcaaaattgctcttcaggaatatgctgatggctaacttgcagaaatagagatttaggatagacataatgaaggacttccctacaacactggatattaaatgctgaaaaaggcttttcaattccttcctgaaataagccagggccataagcacttagcccactctatcgaagtctccccgagaaaaccctgcggctttctctgcggattcctccagcccaacaccgaggaaccagggcctgggacttctggagtccctcccaggactaattcccgctctgatgcccagcacaaatttatcataactgcctgactctctcagtgtggtgtggtggtggtgatggtgtgtgtcttcctgagtgtgttggttggggatgtggtgggaggggttggccagagagttgaataaagaggaggaaaaaaaaaaaggaattagatttttcagaactgcacaaccaaagatttgcacacttatttatagaggtgacccgtgagcttggttgaccctggatgcttttctgcgctataagggaacccgtgggtggccgatcactctctggccctccagagggggcctccctcctgcgcggaaagcgtcccggtgcacagcgcccagctcccgggtctctgtcggacctgcgactcccggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggccggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcatagaaggcactgggcacctggtgtgggcaagttgtgcctgctcagtaaatattaactaccgactcacaggacatgcctctctttttgctaccctcgcacgtttcttttctcgtttccttctccattgtcactgacccagggttggctgatataagtgaaaaacaccaagggtgccgtctgttatctaagtcatgcaaatgctttaaaattatatgtctgtgtatgtatgaatatatgtatcaggctctgggcacatagaggtgaaatatcatgtaagcaagcacttgtataattttcttcagataacaagcttgaaaacacagcctctacttgtttccttcccttccctgtctccctttctctaccagagctttctggaccatctccaaataaactacttgctctcaaatcccagtgtcagagtctgattctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccgtgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatatgcattaattctctctcagttcccaaactctccctaataaagaagaacttgagagttgactcagctgtcccccagtataaagtggtgggcatgagggagagaaatgtgaattactgatacataattttccccctattaaactttattccttggaacatctttgtgaattctgcaaattcacaaagatattcatagtcctatattcatttgaattatccaaagctccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacagtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttacagacagtctcttaaaatgtatgtgtcattcaaatttgttttgatgtgtcagtcatctccagcattcatcctgggctttggatgctacttagttgcacgactggatgtgttctaagatctgccatgcaggttatattctgatttacttgcttacagtgagctcctatttggaacatagttctgaatgccaaagaaaaccaaagacagaacacttccagctcaatttccatctataaagtggtcaaagaaaactccagtccttgaacttgtgttctagtcttttatgcactgtttagaggttctgcaggggctttatgcctgccctctgtgagagatgaagcatgttaccggctcctgatgaatggacatttaagatccaaaatgtattgaagtcgagttgtcatcacgtttttcatttgcccaagtcctatatccaaaaaaaaatgatgtttttcatcatttcatatagatgaaaaacaacattaccagcccctgtttcaaaggcaaaatgcattctgcattgtatatgagttgggtaatgtcaagtgtctgtgattgcagcgtgggagttgttttggtctgttttattttgacttaagtcaggaaacaataagtatgtttgtcattttccaaacaatatggtccaaaaccacttgtggctggtgttctttcatctccacggggcattccacccaacaatcaccatctgccagggacgcctatgaatgtcaaagttctgctaggtttctctgaagcctgcttctgctttcagcagctttgaataagctacagggccacaatttacttctattgtcatttcttcagggagatagagagaaatacatctgccactttagacaagaagcccatgggaagagtacacacacaatcagaacagccagagcaggattattcaattcagctgcaatcagaaatgggggaataagacagagaagaaaagccccatcttgttatgtgtaatgctcatttctgagccagtgtttgaagacagatcatgctttgtgagaaaaacatattttttcatcagataggatgtaatcaaccaagaattaatcattagtgagccattaaataattaattgtaaattgtaactaatttctgattattaaaatgactttttttttatacctgggctcctataattccccattttaaatagttaccaagctacgccccgataagataaagacaaaaaagttgcaataagttagctttggctatgtaacaaaccattaagacataatagattaccacaaaaagtatttattagttcactataatctgggtcaggcatttaggatgagttccgctaggcggatcttctgcttgtcttgcctggggttcctcacgcagaggcaatcagctgatggtgtcagtaggagccgattggtcttgaacggcctcactcacatttctggttttaatgctggctgctgtctgggaggtgcaagggattgggccctgtatatctccaacagagtagcccaagattgttcacatgctggtggtcaacagtgttccaagatgcagcaagacagaacaagccccagtgcagaaacatttttcaagcatctgcttatagcatgtttactatattccactggcaaaagcaagtcacttggccaggtctagggccagtatgggcaggaaatcacaagggggtgaacactgggaggggggtataaatcaaggacgttactgcaacaacctaccacagacgtatccttgaaaatgcttttatccgtatcaccagaccaaaactctagggactttgaatcatgtaagcatgtgccaaaatggatctcagctatcttcaaatccttctttggacaacttaaattcagaaaggtgacttttttgggcccaaagtcacatgactaactcaatactacattaattatgaaggtattggcaagcatctggaatcactgatatagtagtttcacttaatttttaggataggaaaatttatttataaggggaaaatctatcaggactaaagagtctagaaaatattttcagaaagaaaagacagagctcaggtgggcaggtaaacaagcagatgtaatgagggaaaaccaactgaagctcaaggtgttatgtttttcttatattattttcagattcataaggcagtacttctcaaacttcaatgtgcacatgaactgcctttccagggagaactgtcctactgcaaaaggtgtatgcccaggagacacttagctctcatccatgttgttcccagaaatcatatagaactcataggacatactctgaaacctgaattcctcctcctacagtgcaccttagggagactcgttcccttggtcgcaagacacatcctcctggaatcagtgtcttcttttcataactgcagttatccactgcagcagagaagagctgaattctcatgtctcccctccctagccagcccacttgatctaaaagtgttctgtacccaggtcaagttcctcaggcagcaccaatgtgaaagtgaggaagtgagacaggaaagggaagaaacaccataaagtgtgtgttttcaaggaaattaccagtgtgggcaactgggactcaggcttgctgagcacctctgggaaactgtggagaacatgactcagtcatccacccaatgggaagaaagttgggtgtttatccacaaactccctgtcagagaccgctggagggtgctcggggaggattagttctccagcacatcactcttccttaggcacacagctagtgagtcagagaaaagccttcaggcagagacagtattttggggtttctaaaagcagcttcaagcttgtacaggagaatgcagaaggaatatgggaaaggctagagtccttctgccttaaccatcgccggagtactaactagaaagtcaggactagcttaaatgtataatggttgtgactaaaaccaaggcaagcacatgaaaagcaacacattagtaaaacaagcaaaatgttaggcatcaaacagccctgtcggttatttctgccttttcccccttctgttgactggttgggttatgttgttgttgttatgccaaccaataatgtctcagctgccttaaataaagtatttgttttcaacattattcacccaagttactcaacaggaaagcaaagattttttccttgctttccattaggaagcaatattagttagatctggatttcattctgtccctgtcgtctctcaaaactgtgaccttggccaagttatcctccctcaacttcagtttccttatctgttaaaagacaatagcaattctgaccacataggattgcagtgacagaagtatgtaagcagcccatccatgaaaggcacacaaatgttgtcctccttcttccccactctccaatactctcctcactgctgaggattaaattcaattctacttaatcaatttatgttgaagttttactgtgtgtagactctgtcttggattacatagcaagtatagagctaataatcctttctttctaatagctttccattttggggaaagacaggcatataaagctctaacaaaatcaggtaatgataagtacttctttcaatgtgaagagcatcatgctctgatcctacagggagaaacaaattatcctctattttcttgtaatttacataacagtagttgattccataattcactctcaactgctagagtctgcaagattcccaccaactgccatcttcagcagaattgtattacacatgaaaaaacctttgactaacctctaattgattccgacattccaagaactattaaaaagagttgaaaataatctagaaactgctgacttgtatcaggcatagatttattcagacaaaacagagagacagaaggattttgaagtgagatggttttgtcaattgggcataacaaaggaagaaaaataaaaattatcgttcatgctttgaaaatctctcttgtgatgtacctctctgctacagtacctggcatttagaggtgtttaaccaatgttagggaagaaaactaacactggttaaacacctctaaatgccaagtactataacagagtactcattgatcattttattcaatcttatctactcttcaaagcccacaaaagaaacctgttgatcaagcaaagcttatcacacttcctgcaataagagagaacattgtcttaatggagaatggttttagggcctgagctgggtgatttcgaagttggtcttgcaaggcagggcacttgttgggactggaaaagtttatgaaaagtttctttgggttggtaagcatatggaggtaagggtcttgaaaggagtattgatgagtaagtcatcaatcttgataagtaagctgtttcattggtgttatgggataaactgtgcccctctaaaattcataggttgaaggcccaaccccccttcctcagaatgagactgtatttggagataggccttcaagggggtaattaaggttaaacaatgtcatatggttgagccctaatccaatatgacttatgtcttagttcatttgtgctgctataacaaaatgccattgactgaataatttatgaagaacagaaatttatttctcacagttctggaggctggtaggtctaagatcaaggccaaggccagcagttatggggtctgtcaggagcccagtctctccttccaagatggcaccttgttgctgcatctaccacagggaaggaacactgtgtcctcacatggtagaagtgatggaaggacaagaaaggtgaactctctctgatgcttcttttataagggcattaatttattcatggaagtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccgcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaatgtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctgaccatttctgggagcagagattctgtgatttccaactgccaatacctgcaactcttcatcttaggcagttcccacttggccctggttcagggcagattggaagttctgagtagtgaatgctccccaccagagaagccctcaaccaatgattgatgggagttggtggacaaataccccagttccctcctccctcacgtgggatgactctgagacatgttttctgtactattcccagaattccccaatgggattgacacctagttgtggacagtagtaacaagcctgataacataccttgtattggctgccttttctccccattgttgctttttgggattgcctcctagataaactatactcaagtctttgtcttggggtcttctggagaagctcaaatgataccaggctataaccactggctccaatctgacagtcacctcccatctccaacacctctgtatggatctctaggtttcttaagcaagaggccactttctttaacatgacctggaagagctggcatgatctggcacctacctacctattcttatcagggttcttaggtttaacaacagaagtagaatctgggtaactaatgcagaaaatgaatttattacaagggcatctctcacagaatcagattagcaagatgggaaccaggctgatttagagacgagtaaccaaggccctaccataagaaccatcgacttaggacactcctgcagaccctagcccaccttggtcctgatcaccctcttcctgctgccagattccacaacccagatactccccctactgctgaatgttcagctatcagtagcccccatggaactctctaaccagtatgtaccctcctggccctcccgaaagacttacagcctgagaaggagctgtgggcttgatatgcttaaaaagcatgctcccacagtgcatggagaaaggtctcttcccctacttcagcatctgcagaaggaaatggggatgtcccaaataatcagggtgctcaaatactgggttgccagaagacagaccccctactgcctcacagccccctcctcatcctgaagtccagccctaccaggctttgtgcagtgtcgcgaggccaccatgcttctccttgccacacagtgtgcatagaaggctcccctcttctgcccagtcaaactcctcttggctgcagaattcaggtcagccttcctcgtggaagatttcctgagaccacaaacatgtcagatcccccacaaatgcatgcacaacagctttcctttgagaaattcatctcccttgtaattgcatgtcatttgcctccctcccaagaagtcagctccctgtgggtccaggctgtctccacttttactcaccctgtgtgctcagcaccaagcagaaggtccagcacatattaggtaccaaataaatagctgttgaagagatgaataagtgaatgaacacatttataagcagctcaattttggtttttcacaaatcactacacagtttgtaaatagcaaaagacattgtccttttggcttagaggtgaggcagctcatattttcaatgagaaagatgttctctcatgacagacactaaaataacccaatggggcgtgtgatcaccttgattacatgttcccaaagaaatacttttttaataccaaatatttttcaaagtttttataaagccttccatctactcaatggtaggtcatatctcaattaactattgctacgtaacaaatgtaacaagtgtctccaaagctcagaggataaaaacaacaatcattggttattgtccattcatctagacgtgggctggggtaaactgttctagatgaggctcagcagaaagcgacaatgctccacgtgcctctcatctttcttaactactaatgggctatcccaggcatgttcttctcaagccaccagtgggctagcccaggcatgttattctcaagccaccagtgggatggcccaggcatgttcttttcaagccattagtggtatagcccaggcatgttcttctcaagccaccagtgggctaacccaggtatattcttctcaagccaccagtgggctagcccaagtatgtttttctcaagccaccaggggcctagcccaggcatattcctctcgctgcaatgacagaagcaaaagaggtcaagtggaatcacaggagtcctcttaaggcctaagcttagtcatggcccactatctcttctgcccccatgccattagccaacacaactcaacatgatcaagtccaaagtcaagagtaggttagtacctccacccacaatgggtacagcaaaggatgaaaattcaaagccaacgagcaatctacctcaatattagaggtcaggtgaatgataagaagcatttagagaagcaaacagccaaatggcaatcaagccctccatcagcgtgtatgttgtatgcctttgaaaagctgtcagagacagtacttgtcaaaactgtcaaagtcatcaaaagcaagaaaagtctgaaaattgtcacagccaagaagaacctaaggaactatgatgaataaaagtaatatggaatcctagatgagattataggtcagaaataagacattagttaaaaactaattaaatctgaataacatatgggctttaataataatatatcaacatcgtgtcattagttgtgagaaatgtaccatactaatggcagatgttaataacaggggaaattgggtaaggagtatatggcgactctgtgctttcaacatttttataaatctgaaactattccaaaataaaaataaaatggttttaacaaacacagcagtcagagatggaatgtggtttatgacagcaagaattattgcttgtctagactcaacaagttcttaaccttattacagtcttacaaatgacggatttgttatctagggaagaaaaagccctcttctgggactctgagacaaaggatttatttgtacccacctgagacgtgctcagagagggactggaggtgcatggagagggctcctgtcagaatcttcaatccgggggaggccagctgcctgggatgtggggctgcctgccctcagtccctatgcagcctccctttgggctccttccagcctcactccactgtgatcttactcttctcagtatatctgtagtcttctcatcctcccccttcttctgtctcctcatctgtgtgaaaagactggatgaattctagacccaactccaagcttctatacgtttgcagtaacacaatgtaaacaggctaacttaaaagtccacagctacaagatcatttatttttcaaaatctaattgaagtcacagctcctttcaaagaaagcactgttcacctcaaagaaggtatcctgagaccacgaacagatcagatccccgacaaatgcatgcacaacagctttcctttgagaaatccatctcccttgtaaatgctgtgtcaatcacattcctcccaagaagtctgctcccggtgggtcggggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcaccctccacgaagtcaccgagcagctgctaccgctgtgtctccgccagtgccatttctgcttcctcgaattttaaattggccagaataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgcttttatacacgcacgcgatgcccatgttgagaagaaatttgctaagcggctgtgtttgttgaatcctgagcctgcctctgcacctagaacaatcccaccatgaaatgaaatgaatgcttgcaaagatttcttacttcctcctttaaagagtggtaggaaaatgaacaaagaggataaaaggaagcaagctcatcatgcattcaccaacgttaaatttccaaacggtagttacaaagcatttttaaatttaagtttcattaaagatttggaaatatattgctttttttctctgacttctcccagaaaagtttttgggatttgggaattttatgtgtaggttttccacaatggagtttccttcccatgtatgtgtgtgtgtattttaatatatatataattatatgttacacataccatatgcaatatataaatattacctaacatatattacataattatatattatgcaattatatatattataaaattatacataattttatatattgtagaattacatataattatagaattatatgcaattttatatatattaaaatacatagacaaacataatttagtacatatttattagcagtggggatatttgtaatgcagataattacctgcagctttaaatgacagttttactgatacactgtatgtttggtgagaaagggtgctatgtatggtaaacggaagaggagaggaggacacaagttcaaagtcgaaaaaggttttggagattatcttccaatctaatgccctattttacttgcctagaagatgaggaccagaggaaaaactgacttggctaacaacacacagtcaacttgtggctgagctgtgagttaaatgatgaaactgaagcaaaatcacttggatttctgcatgggagttgtcgacagtcatgaaattacactcaaagactccagtgcattcaactaaatgtcaattagtatctaaactttgccagaacacagcaaacagcagagctaagacatcctgtgggtgatcttccctccctgcagcctggcttgatgaattagagttctttggttttcagaacgtggttgctattttcttctccagctccattagcaggttgggaatggcacactagctttttaattaaaaataataataattaaaataccaaacacagtgttgactaaaaacaaaccattattcttccttaatcacttaggcttagtaatttctctttgtatttggcaaaacttcaaaaggagtaaatcaatgttaaatccaaaatttaatgactcgagggtttttggagaaaaagaaacctagcagtacatcacaataaggcaggagccagaataagtctgggctgttttacaagatgctgtgttctaccactaaaaagagggttatcataaatattattagttatatatgagctaaccccaaaacatcttgattgccttacaagtcaccttttatttttaaacttatgaaaatgttcccaattattcagaagcaagatcattttatatagagttctactgttaaaaacaaacacattctgttttattactgcaaaccctacatgtttctccacaagctttgtctaatatttaaactgaaagacttattacacgtattgaagtgcatataatgttccaaaatagacggtcaccaagtttaaaaacttcgctctctcagctaacacgtgcatatctttaacaattgacaaattacatatgcaggattgttacacaaaatgaaaattaaaaaagaaaaacaattgacaaagcgaagcatatttgcatgtattaactcatttgttttgatcttgtcctatattcctaaaagtcacagaagataatctgttacgtaaatatatggtcagtgtggaaaattcaagaagtatatgaaggaaaaacagaaatctccctctatatcgagcccctctttcatctccacaccccggaggtaatcattattatcattagtttggtatctatctttttataacagaactggccaatagaaatgtaatgtgagccacaactgtgtacataatatgaagtagccacatttctataataaaagcaaaggaaatgagagaaattaaataataatatatttatgtaacatagtatatccaaaatattatcatttcaacatgttatcagtacaaaattataatgagatattttacattgttttcttgtactaagtcttcaaacaccagtgtgtgtttcacacttagagcacaaatcaattcagactgccaagtttcaagtactcagtagccacacagggcagtgactacctatgggacaatacagctctagaccttcctttctatgtgagagagagactgtgagatagtatatcaactaagaattcttggccgggcacagtggctcacacctgtaatcccagcactttgggaggccgaggcgggagtattaagaggtcaggagttcgagaccagcctgaccaacatggcgaaaccccgtctctactaaaaataaaaaaaaattagttgggcatggtggcgcgtgtctttaatcccagctactcaggaggctgaggcaggagaatcccttgaaccagggaggcagatgttgcagaatcagggaggcagaggttgcagtgagccaagatcgcaccactgcactccagcctgggcgacagagtgagacttcatctcaaataaaaatacataaattaaaataaaataaaataaaataaagaattattttgctgccaagaacagaagtaataatcactgaaataataaaggcttcaatcagccaatgtaacaggaagtctacaggtggccaggtctgaggctggaccagcagctaacaatccaggcctcaggatgctctctgcaattgtctcaaccatcccctgtggttgtaagatggttactgcgggtccagagagcacatcttcctactccagcttccaaaggcaggaagcagaagcatagctgagaaaatgagaaagagctctttcttcactcatgaaggggaaaaaaatctttgtcagatgccccctttatatcttttgctcagaacagatcacatggccttcccaggttacaagggaagctgggtaagcagctgtctggctcttttagtctccacagtgagaatcagtcataggagatggggattgaaaatgtttaaaaggtaagcacccaaagaactgacatggatagatctaaaggtagcgctcctgactcaaacagcgttcctacttcagagctggatggactcttccagcccactccttgtgggctgtgctgatcacacttccttcataaagtatgtaaaagaatgtttcagcacatctgcagcacgttggacattattagattctcaaataaccccgtacagtttacactttcatgagtgtcaccttcattttacccagaagttaaataactttctgaggtcacagccaagaagaacctgagtcatgaaccatctattaaacccaggccttctgtctacaaactcactgctttttccattctcagctgcaatccacctgacaagtaaagaatacttcatgaaaattgaaagtataattaaagaatctcaagttgaattttatgacaagtttgaaaacccaatgtaagacccttcccaggataagctctggcatttataaaaatccaaacagccagtctgtgactgaccaccagaaaaacagatcttggggcacttaaatgatctctctactgtgaaccactcagaattgcttttattattggagagaaggtaaaaataatgacagcaatggtggttcataatcttcaaagtatttttatgcccatcatctcgtgtgattaaaaaaaaaaaaacctctgaggttggcagaagtgtgcaaccttatttgataaatggtaactaagactcagaaaagtaaagtaattgggtcaaaatcaaacctgtaggctaggaccctggtcttggatgctaggaactatgagaaagatggatatcagaagtcattagaagctcttctattatcaaaactttctcagtggtctaggcactggttataataataattatagttcacacttacagagcatttattacatgctaagcactgttctgaaccctttacatttgttaacttatttaatttcacgagaatcctataaaattgtgcatcagtgctatgtcttcataacaaactaacgaaacttgcaggtgttcacagcaatatagacagttacttctcattaacagctactaaatgactggttgaggtttggctgatctagggtggactcagcttgggatggctttgagcccaagggttgcgttaaagtttacttctgattcatacaaataataccttgcttgtaaatttcacactcaatggacctcacacacaaatactattttcttagtcctcctgagtgggagttggagtgtcttggtggaaatgggaggattctgacaagtagagaaatgccctgatagccacctctatcaaaaagccaagtggagttgaaaatagggcactggatttgataagaaagagatcactgatgaagctgtcacctgaaatctgggagggacaccatcaagcacagctttctctagggcaacagttctcaaattgtgtcccctgaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcatttgtaatcttggttgtatgcaccctgcctttattttactatatatgcaatatagtctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattatttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctgggatattattgctcatttgttagtactaagaagtagtttaagagagcagtctctggggccacttcatgtatttatggcttcaaacagccagggttcaaattctgcctcatccactttctacctgtgtgacctcaggcaagcccctgtgtcctcatctgtaaaatagggatgataatagtaacaaggattaaataagtgtaaagggctaagaaccgtgctagcacatggaagttattcagtaagtcttcactgtgctattatttccatacatttcttccttctaagtcactgcatatatatatatatatatatatatatggcttcaaatctagatagttgtgtattcatagtatgttcacaacatgttcaattcatctggcccattctctcacttcacacctgaagaagcagagacccagaaaggttaaataacttgcccaagtaacacagcttgtcagtgttacttaccagctcaagtcacttgtgcctggaatcatttctcccagcatactctccagattggggatctgaaagagcagtggagtgggcaatctacttttccagagaaggtctttatatagaaaacagttttgcctggagggagccagaaacctcctgatgtaggaataacgcctctcactagagtcatcagagtcactggaatgagaaattaccgggtaccacaggcacactgaattgtaatttatttttcaaatgtgtggtaagttgaggacactggaaatgagcatggtacaatgagaatcagaaaacagtgggttaaaatttaccaattaacttgggtatgccacataattcccacaagccgcattctctgcatccacaaagtgcagttagtggtgcttctctctcagtgtggtgacagcgatcagagcggattcttacgggggggcaatgagtccagggccacggatggccaaaaaatgttctttgcttcaaaaaaggtgatggctgactttggggcagagaaactggtggtaaagttaaggctggggagggccaataggaaggggccatgaggggtggagaacaacacctggaagaaaatgttcctgctctgagagaagtagaagacctggaaccacaggaccagtacttctcacccacacatctattgtatgggcctgggatggaaatctgcgccaccaactgaatcttcaagcaagcacataaaatagtggtatttcatttctaattacacattctgtcagtcatgttgggtttcccctgcaattaactggctctttacaaacgcattagcatatacagccaaaggcattggtttcagactgaggcaaatctggtgtaaaaccggcaactcagaaattgtgtgactttgggcaagttactcagagtttatgaagttcaatttcttcattcgtagaatggtggacaattattcagttactattgctgtgtagcaaattaccccagagcctagagaagaaaggaaaccacagttttttggctcactattttgtggttcaggaatttgggaagggcttgcggttcccacttgggatgccatatacttgcagtcagacggcagcggagattgggggggttgtctgaagactcaacagggctggatgtccaagatgtcccatcacatggctacaggctgggagcccagctgaggatcaaccataggaccaaagctcagcctctccaggaccatagcctcagggggctcagacttctttacaggctgactggcttgccctaggccaaaacacaagatgtccttttctgacgtattcttgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccgagcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacaccatcctttctttaagccacagctttataaaaacctagtcactcaaacccaggctagcaactagttgaatgccattgatttcttagaggaattaaccaaataccttctctgggtccctaagatgcattgatctcctgctttcctccccagcactgtgcgaatgtcactgaatgatgggaggctgtttaaatgggtagaaatattgattttcttttctacctttttgaaagttctttgcttaccaggtgctgagcaaacatcaggcaaacggcagtccacatagaaatagatgatgtgaggagcaacaatggcagttctggcttctgaatgtgaagctggttaagcagcaggtgcccccactacacactgtggttttagattcaaaaactacacatcattgttcacacttcgtcatttgctaattgataatacagctcgcccctgtggcactaagtagcatagtggaaaatatttccaaccaatccatggaaacagctccatccgtgtctgaagagggtcgactgaaagctgagatgaactgagggccagtgacggggtaatgaggtgcatttcggaggctggggtctgcatcctaggtgtccatgtgcaaaattggttatacccttggaaatgacaacaatgttctgtcttagtctgtgtcagagatgacagataaacacaggttaagaaatttctgggtttctttgatatagaggacatccaagaaaccatgcatcaacattaggttgctattgacacccaaggaaactgatgtgtggttaacttctccgaaagaaaaagccaggggttccctcagggagccaaagggcagcagattggaaatcactcgcaattcacaccattggaaggaaaccaatgatggaggatggagaagagccctgtttccaatatgtgcttcctaaaggatacagtcccagagaacttgcctcaaagaacaacaaaggagaatccccagagagtgacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaactcaagcacttccacacctgcattccctccagactcaggttctttcttctgagaagaaaccttacattttttttgggggggggggttgtgtttttgttttttgttttttgtttttttgagacggagtctcactctgtctcccaggctggagtgcagtggttccatgtcagatcactgcaacctccgcctcccaggttcaagcagttctcctgcctcagtctcctgagtagctgggattacaggtgggcaccaccaagcctgtctactttttgtatttttagtagagatggggtttcatcatgttagtcagactggtcttgaactcctgaccttttgatccacccatgtgggcctcccaaagtgctgagattaccagtgtgagccaccgtgcccagctaaccttatgtttttaaaattgttgttgttggttttgttttcaagtgaactttttgcctgttctgtcaggatcatttcaggagagtagcaaccctaaagaaaactctctttttctttgacataaaacttatttttaaaaaattaaataaatacttagtgagttcctactttgcatctggcacttccgggaactcagaaacagagtgagagaggggtcattcccagggagagggatggtactaggagatgagacaggactgggaccttcctagagctctgggtgctattgggagggcaaacaaatacatgtcattcctggaatgattaggagacactggcaattcaaagggaagacaatctcaacacactagtgcgatgggtgagtccaaattgatagcagaacttccagcaaatcgaccctccttaaaattcaagatagaactcttagaaaggatataggaatgttcacatagcatcttgtttttgaagtgattttgtggcctcatcaaggaatcccgtctagttttcattaagaacagcacacatttttagggagatttattcaacaattactataacaagaccctcccctagaaagcttcttagggatacacagcacttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaactgcccagctcccctgtcattgctgccctcggtctaaggaccagcaatggaaaagagtagagtggcctcctaactatgcatagactatgggctcagtttactgtagattacagtgaacactagcaatggacatgtcataagttaatgctttgaccttcggattttaggacctaagactcaacatttgccttttataacatccatgcaacccacccctgcctgttatgtgacgcattccccctctcaggcctaagtttatagctctctggctataaattcctaagcatggggtctaccccaaatgctggcatcactaagaacaaatgggacaagaaaacccaccctttacttctacctcctgaggctcctcagtaaggagatattgaagcttttagagtaaacacacaggcggcatggaggaagagtcatgcaggtccccatgaaaagatatctgacttgagatcactcccatttgatagcagtagcatttgctgttgagaaggcattcagaagtattcccatcccccaaactaactagctttattgttgaatctgtttctctgctctgtgtcctacacgcctataattttccccttttgacattttaatctctttctggtaaaactgctaaaattcacctgtcattaccagtccatttctgcattgtgaattctgctctttgctgctttcaaaccagatttaatttgggttttgtgctgggcatcctcttcttgtctctatgattcttcaatttaccttttgttcctttttaccttttgtatcttttgtttaaaaaggtaaaattcttcaattttactgcttatcttgtgtttttttcctctccgtcttacggatttgggctcctattttgttacaatcttgatgtacatcctaattaatacaccaaggaatttcttctggttcttacgcttagttattttgcagtgcagtgtttttccctgaatcttcagcagaatgttcccctcccctgttccttgcatttttcattccagctctcctatgtgggcttcttttttctggcttacttatttttaaatgagataagctttacccaaacccagaattcaccaccagactcactgctgggttgtccctgatctgtccattaactaagtcacctcctgagagatagcactggaagagcatagttctttgccaaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccaccgtactccagcctggaaggcagagcgggactgtctcaaaaataaataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaaccctgcagagatggaccgtcaaatgtgtttatctattcagccgcactgaatagctacactacttagcagcaattcttttgaattctagcagcagatggactatgagttctgcttttcatggcgtgtcttgagtacttcagtgagaaactcaagagcactaggcaaggagttagtatccagaagcctctttcagaaaaatgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatgaagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcgtaatctccgtgcactgcaccctccaccccactgaggtcaaccaatcctcctacctcagcctccctggtagctgggactacaggcatgtatcaacatgcctggctaatttgtgtattttttgcagagatggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcgcaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatctgatagttaaaaagcccatcttaaatgtttgtggaaatgaatggaattggatggttttagtagcttcaatttgactcatctaagaaaacagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgattcctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattgacaaggcaccactgttgactaaggggctaacctttgaggaagattaaaaacagatgtccttgaagaagaaagaactgaggaagtgaatcttctctcctcttaactctttagttcattgtcctcatccaaaaattaaactaacacactctgaagaaggtttaaggagatcaggaattttcaagaattcatttgtattctgtagcagacagcttgtttgttccccattgaaaacctacaagaaacaatactgcaacctttgttatagcaaataactggtgggtgtatccctccatgccaaacacatgccaagcataaaaaatgtgcctagaaaaacaaataactttggaaggctcttttcccagtgccttcttacttcctttgtcttagtcctcctttctgtgatggtgcccaacctaagccctggatcctttgctgttgatttcagtagcatttctccctgacttgcaggaaactgcccaaggctttcaaaattaccttttccataaactcctgttccttcctcgaacaatctcaaccagcatctttgcaaaaagctgcctaattaatgacttcatgcacaagtgtgggtaagtgataacacctggatgtgttgcccttcccagaggacttgttttccaaatcttttcaaatagagacataatcagcctggataatgagtgctcaaaactaaagcttaacccttcatggcaggagtgtggtcagtgtgcgtgtgctcaggggaggtgatatgggtcattggaggctttctttgtgcccctcaaatcacatgatttgtactacccaaatgctgcccctgcttccactctgacgatgaaatgatttcatgaatatattgaccattataattatagccagtgacatttatagtatgcttcattattctcaacaagaaaagtttatttcatgtcatcctcaccaataagcctgtgaggtcaagaattccatcatgtccgtgctatacaccagaaatcaacaaactttctgtaaagggccagagagcaaatatttcaggctttgaggccatatggtctctgttgcaattactcaactctacggctgcagtgtgaaagcagccataggcagtgtataaacaaatgggcatagctatgttccaaaaaatttatttacaaaagcagtcagcagactagacttgccaaacccatggtctggatgaagaaagcacaacctggagaatttgaggccctacctcagaacatgcacaaatcagaagcaaaccacctcagaacccaaacccagttctttcttacttgaaattcggtgctctttcactgaaccacacggtttggggcatagtctttagcattcaggagagtcatgactttggatcaaatcaagaatactctccacccacccatctcccccgttttcatcacacacacctgtaaaggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcaacaaaatgaaggaggctttgcaagaacaaagcttttggaacctgtattcctgggtggtgctggagccattcattcctagccaggtgccatgagcactttctctgtgggcgctgttggctcccctttacctctcacccccaaacgcctttccagggaggtgtagtgctgagtgcactggtcagatgtggggacactgactgttcacagctggagtgaagagggacagagacttctcctcgtctccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttacatctcaggagacactcattgagaggaacatgtcattttggccaagaacagcatttagggactttctagcttctctggaaaattgtcctgtcaagtacaccccagtctaaccattcctgccgtaatatctggcatagagcctccatcttttaatatccttttccttaatataatttcctaaatccatctcctaacattgccccaccaccctggaaacaagcatagccctggctgcaatgcacatgttccaaccaatatagaagctgagatttcactttctcggggttctcgttggctgccttggcacctcgctccacaagaaacatctttgatccctccctaattacattgatttatctcacggtataccttgtatccagagctttagatgatagatagcaatttgttaatacttgtcactaagactcaatgactggaactgtggtcagaggcatgcagccatatcctccctcctcaattgatcatctttattcttgcaagatggtccaacctctctaaatgagggcaatcaatactgtgcattcagccataatcgtggcttaacttggtattctttgaaaacttaagctgtgtaatttgcctgtaattgggctttccaaaaagtcatatctcctgctcaaggaagcaattaagccggcacactccctgtctgctgcctgctccctccctcctggcatctgactgccatgggccaagtcttccctccgcagacctctctcctctccagatccctgtttggatctcgacaaccaaagccagcagttggcggcaaagcagatgaactagaatatctgagccccttggagaggcctttttcttccataatctcccacatcacttccatcaatcgcttttgggggtttctcgcttgatgagctgtgtccagctcatcaattcaaacactgagataacacaccgcattgcaaaggcaaaggcagaaaagctagagccccaacagtgaaccctcatgtaaaccatggaccgtgggtgatgacgatgtgtcagtgtcggttcagcacgcgtaacaaatgcacgctgtgctccagcagggatgttgataataatgggaaggcagtgcatgtgaggagacagaggatatgtggaactctctgtgccttcttctcaatttgctgtgaacctaaaactgctgaaagacacatagacgaaagaaagaaagaaagaaagaaagaaagaaagaaagaaagaaagaaagaaagaaagaaagaaagaaagaaagaggagagagaaaaaagaaagaaagaaagaaagaaagaaagaaagaaagaaagaaagaaaggagagagaaaaaagagaaagaaagaaagaaagaaagaaagagaaagaaagaaagaaagaaagaggagagagaaaaaagagaaagaaagaaagagagaaaagagaaagaaagaagaaagaaagaaagaaaggaaagaaagaaagaaagaaagaaagaaagaaagaaagaaagaaagaaagaaagaaaagaaaagaaagagagagagaaaagaaagaaagaaagtctaacaaaaagatgtggagacatgcccctcatgcagatggggacttgtgttgcatttaggacacacttaggaatggactccagctggcttctcttctcacatttgatttgctttgtcttcagttagctaagagcaagaagattaaagtccaggcatctgggcagctttggagtgagatgagcctagcttgaggtgttttggaacaagggaagtcactaccccactgcctttctacattacaaaaacattagcaaaattatagaagtaactgctggcatttcttgagttcacacagtgggccaggtgcttatatgcaccatcacttttgatcctcaccacaaccaaagtacacatgggagtggaggagcagcacagtacgctagagaagtacctagctagactgctggagtgtcgtgtcagtttgcgaaggctctcatatggggggccacagccagggtggcttaaagaacagaaatgtatggaggtaaaagtctcagatgaaggtgtcatcagggttggtttcatcagggccatgagggaaggacctgttccaggctctttccttggcctgtagatggccgtcttttccctgtgtcctcacaccattccctctgttggtaacagtgcctgaatatgatgacaccagttatattggatgagaccccaccctaatggctttaattaatgacctctttaaagacactatcttcaaatgcaacctcattctgaggtactgggggtaaggacttcaacatttgaacttagagggaagagagtccagcccacaacaggcatgacccgtggctctgcccttggctaaccataggaccgttaaccagccacttggtgtcttcatgccttcactcctaacctctcatgtggttgtcggggaaaataactgagataatgtacatgagtactcagggcactgcccagcgcaacagtcagccctcagtaagtgtcagccatcactagggtttatccttattttacaggtgagcaaactgagtcttaaatgggctccacagcttgctggagaccccacagccagagaacaacaggtatagcagggcctgtaactcatgtctgcctgtccccaagaccaagctctcatccacaatcctatgctgcctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctatcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccatccctagcaactctcagttccctgctctggtggttggcctgagcacagggcttttgccaccttcccaggtgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaatatatctttcaggacagcacaatccaacccatcatagtggtaaataaaataattctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttagacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgataaattagtctttgtccaagtgaaaacaagtttcctgattaaaacaaagcctagccattgccagaagctgcttgaactaactcagctcctaaattgcatttacatccaagagcttggggttctttctggctgtccaaaattgaaatgttgtcagtgcaaggacacaccatccatcaatttcttctcagaggttcctctctaccttctaggactttgctatggcatttgttggctctccatgctggcctcattgtttgtctgtttgttcttgtcttggggaagttttctttttcagcagattctcaaacgtgatagcactgtcaacaaattaaagactgggaagccatccagaaaaattatacatgctgttttcactctctctcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgagattgggagttcaagaccagactgaccaacatggagaagccctgtctctactaaaaatacaaaattagctgggtgtggtggcacatgcctgtaatcccagctactcaggagcctgaggaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccctaatctctacaaaaaaatacaaaataataataataatggtaaggtgagcatgtatatgagatgaacttgcttttgccaaagaaaaaaatacacctgatatacaaatgaaatttggattcatggaaacaaattccagaagacagaatgttcagattatattcaggtaatatgtcagcattgtcattccaggtaaagatggctttgcagcaggaaggatttgaccgaaaaaagcgaggttacagagacatcaatgagatcgacatcaacatgaacgatcctctttttacaaagcagtggtatctggtgagtgtctttatgtccttttggacatttcccatcttgagactctggataaaagatgaattcctgtatcctcattattcactaggatgttagccagtatccaacccagtgaccctctctgtccccttacatatgtattgattttctgtcaccacctgtgcatctagttctctaatctgctttcttctggaactgctaagtagcccttgtctcctagggtggaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcatctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaatttgtaaatgtgaatgaagctgtattttatttaagattaaaaagtgatgaacaagagagagaactaaattacagccttgtggacggctacattacaggaattcatcacaatttcccttctggggcttcagagcttgactctgacttatgctttttggcatggaagtccgaaaatccaatatgggtaattgaatgagtgtacttgtattagttaggataggctaggtttgttgcaataatgaacaaccctcggatcacagtagcttatcaaaagcaaggcttgtttctcacttttgctacacgactaatgcttcataattgctcagaaacgcaggctgaccaacctccatctgagctccattcccacactgctttcataagcccttcagcaaggaaaaggggcaaattgtagaatttttaaaagaaactcttaaagcttctgcctggatgtgaaaaaatggcacatgagatcacatgtcattggccaaaatcagtcatccgccattctaacttcagagtgggtggagaggtgtgtagtcttaacatgtctttagaagaaagagcacagtaaattttttaaagagccccaatgacaatcatacaatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggggccttaggatttatttttctgcattagaacatgcactaaaggtgagccagttttctttaattcagttcaacaaatacttttgaacaagacttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtattttgaagcctgtgcctcatttggaaataagcgtgcctttgcttgccttttgataaaagttgtattgttttggagatgctaaccagagatggaacagcaagatactgggcatgatggccacactgcactgtgcccagatcttcacctttcttccaatcagtggtcctcaaacttgaggttgcacttaacaaatattttttgaattaataaataataagctaaacaaatgaataaatgaaagctgcctatcactcaaccataatttcttactgcttacactttaccttaaaatgtcctctaaactctttatattcaccatcaatttctctagactcacactatccaatgtagtcaccactagccatatgtgcctatttaactttacattttaattaattaaagttaaataaaatgtaaaattttatttcaattcctcaatcacactagcctcaagttcttgatatccacatggggctagcagctgctgaaattcaattccattttcatcatcacagatagttacattagcgtgactctacatccataaaacagcttttcagtaacaggattggagcttggggaaatttgactttattgctgctttcagaatgaacccttgtaaagtagcctttgataactttttattacagacatcccttacatgttattcaacctgcgtgcctaccaaagacttagcagagcttcattttctatagtttgtgatatgaaaaccaatgggcttgatgaattggcatttttccaactacacacgtccttggccctgccaagattgtggagaattgccgcctgtggtcgtttcactggggatgtgttgttgccctccatcacccatctgggtctgccagcaaaaagctctactgtgcattattgacccaattatatacaaaggctacacagagatgaaacagttgagcctttcccatccgaagatcctcaaagaacagaacactatgttccttaaagtgaggctttgaagcagaaatgacagaggaaaccaagaggagccagcctgcttaaaacctgcgttgtcttgtgtgggctcattaaatatcaacataaaaacaatgcctcaatgttttttgatgtgtgagacatttttaagtggatgtaaaaccttcctccagaggccaagggctctcacaagaagaaaggagccctgcatgagagtgtgtgtgctcagatgtcaggagtttataaatgtttcttcttttctcacacttgttcttgaaaactgttccaaaggggttcaggccagctcacccaggaaaacaatgcatcaggatttggggaaaacctacctaggagatattgtcatgaccatttctaacagcatatcctactgggtatccccagccggggatcagagaagccaccctaaaagtggcactaaagtgccaacagatgtgcattgctctgctcttaggaaacctccaagagtactgtagatgcccatttcagaatactttaactgaaagctctttgactgactcctaaagtcattggctcctgactcatttccacatgcaaaggcaagccctttagaaagtctcagcagaatttctcatttgatgttctttcttcagctgattaatggcctttgggttcccacaaaagtaaactctgccccccaattacaattcctggtttcttcttcattttagtcaattactgctgcagaacaaagaatcccaacattgagtggtttaaaaaacaaccatattattatctctcacggttctgtgggttgctggagttcatctgggcagttctgcaagttccactggagtctatcatgcaggtggagtcagaaggaagttgaccctggagtcaactagaggctccaatgggaggctgaaaaggctcagcctccctccctttccatggagtctgaggacctctcctctcacatgaggcctccagcaaggtagatggatttcttataggtggctcaggactcccaagagtaggccttccaaaagagaagaagcagaagctgccagtcctcttaaaggctagacctggaatgggcaccggtaactctgccacttatgttggatgaatggtcccagggccaatccagattcaagtggaaaggaaataaactctgaatttgtggccatttttaatgcatcacatgctattccatatgataactgaagaaaagtatccaagttcactgttgaatagcaaaatgagcacatttgggacaagggcagctccccacatggtgaggacaaggacagatgctcttgccatgtaattggccatctctgtcctcacagctagaaccgggaaggctggcaacatcagtactgcattctctctcttaacgacctgcacgcatgaatggtatggtgccatgtcccagacattttcttggcaagatattccaaaataaggttaaagacagacacagatgccaaccctgatacctaagggcaaaactaatgtcatattctatcaacattgtctctccacatgttggcctgtgtggcaaatgttcaatcatctgcgtgcagaagtttaaatttgtggacagccagttttaatcactgccctcccatctctggttgcccaactccaaactcagccatcatcccctctgctggatccagtgactcaatggatgctcaataaatatctgctgccttcacgtaggtacaaagcaatgtcatttccacatgctacatatcactaggagaggacctccatggttagctgctgtctaaaggggcagaaattatttcttaagggtctactaggacatttcacctatgtagatattagcaaggaccccatttaatgatgacaacttccgcccttttactgtaatggaattgtttagagttgggaacttgacctggaaaatggaatgtgatcatgacaagatacagggatggacaagagtcatccagcccaagagtaattcagggcagatggctggttctcaagatcacacaagatcagagaaggcatgggtcaaggcccttagccattatcagatggagccaaggaagtgagatggaaggccagcgagctaaggtcagagggagcttcaagctgaagtaagaataaacaactaacagtaaaaacgacgaacatttattgagtaatcactatgtgctagacactgcttagcattttggaaatacaaccacagttattccctaaggttggtattattataatcgccattttacagatgaagaaactgaggtttagggaggcaagaaactgcccaaagtctcacaactaattctaaccaccattcttggtacttgaaacctaatcctttgctctgccttcctggtgagactttatgaatgggagcctcattcaaaatagcattaggagatatacctaatgttaaatgacgagttaatgggtgcagcacaccaacatggcacatgtatacacatgtaattaacctgcacgttgtgcacatgtaccctaaaacttaaagtataaaaaaaaaaaaatgacaccaccaggatgtggaaattctccaggacaaaagacagttttttcaataaattcaaataaataaataaataaaagattcaaacctgaggaccacatagtcacccacacccttctgagagatttagaactctgcatcacatagaaaacagtaggaaggtccagcagggtgactgctccagttacttttgctgcataacagataatcctgtattagtccatcttcacattgctgataaagacatacccagactgggtaatttataaagaaaaagaggtttaatagactcacagttccatgtggctggggaggcctcacgatcatggcgggagatgaaaccgtgtcttacatggcagcaggcaagagagagagtgagagccaggtgaaaggagtttccccttataaaaccatcagatcttgcgagacttattcactaccacgaaaacagtatgggggaacccacccccatgatttaattatcccccaccgggtccccccaacaagatgagatctgggggaggacacagccaaaccatatccaaccccaacacttagcagcttgaagttgctatttatctttaatcatgattttgtggcacaagaatctgggaagagcctggctgggcactgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgccttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggccccacttcaaaatactattgcaactagggattaagtttcaacatatattttagagggacacaaacactcaaatctcagcatttcaccctgcccgcaagcaccacccccccgaaaatttgtgtccttcacatacaaatacactttttctagcccagtagccccaaaagtcttgatttgttccagcaccaacatcaaagtctaaagcccagagtctcatctaaatatcatctaaatcagagatgggtgaaactcaaggtacgattcatcctgaggcaaattgctctccagctgtgaacttgtaaaatcaaacaagttacgtgtttccaaaatacaatggtgagacaggcataaaacatacattcccattcccaaagggagaaataggaaagaagaaaggagtaacaggtctcaagtaagtccaaaatccaaaaaggcaaacaaattctgaggcttgagagtaaccttttctgactctatgtcccaccttctggacacactggggtgggagctgggcctccaaggctcctaatgaccgctcccccatggcttcactgggcacagctcatgcagcagctctcatggggtggagtctcatgcctgccattctcccacactggaatcacatgttagtgggtctgtagttctggggtctcagggcagtcccacccccacagctccactgggctttgtcttagtgggggttttctatggtagccccaccccatggcagttctctgcctgggccccgaggctctagggttagggttagggttaaagaactggagctcagagccagggttctgacatgctacgcatctcaagtgaactattaacattctacctaggaatgtgcacatggaactccttcctagttcctcgaggtctccaggactgtcaccgcttcctgagaattgggactattgtggattagactttccaagaagcttcaaattgatgataggatactaatgatttatgaaccaaattataaccaagtctttgtcatttctgtgccacatttattatgattggctggtgatcagtcggtacccccataggctgtgagccatagatagttgtacagctcaggttctacgtctaaatcacctgcggttttccaggaccgacactgtgcctggcattcactgctgagaaataaacaaaagcatgaagtataagaatgaatatgagaatattgtaagaattaaacataagccgattaggaagatgtgttcagtacctcccaccttaaaagataatcaaatatacaaaaatataaaagtactatctagttaccaaattactattttccattcttcagtccattattactttttccgaatcatgtttgttgtccttcacagtcgtatcaatcattctctttctcagaccaaagtcggtatctgttctaacttaacacttagtattcctcttaacctaatttaagatcgtttattttaattaggctaaatttatcttgttttaattctaatttccttctggtctcaaattatcttcttgctccagtattttcccttgacagagaagacactactatttattggaacatttttctccttaacagcttccattctcagaacatgaagccatgtttcaaaaattgacttcctgttggaaaatatattctctgggtgtgtctttttttacacttatttagataagttcgtttgatctagctaagtgtgaaaaaagacacacacagagaatatattttaaaatataaatatttaaaatataaattatatttttgatcatttatatttaggtataaattatcaaaatttttcacccaatgagttcacaaaatttaagctatcttaacaaatagaagcaatttaatttcaacacaatatgctgaaaccaagtggatattttttaatgtttcttttcttctgcatatgcacactactccagagatgtggtagatgttaggactaatgatgataagaaatagaatgtattaagtgtttactataagctgaagactttcaatgaattgtctctaatcttgaaaaccgctttgcaaagtaaataatagtcccatttcaaatacatggaaaccaaagctcagacagattatgtcacttggctaaagccacacaagtgttagtgtctgagcccagagtggaactggatccactgatttcaaagcctatgctcatccccaacttcaccccacagcctaaactgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattatcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttggaacgactactgggcaacaagacaggccaccattcaggagaaagcagggctcctgctgagacattcaagcctcaggcttcctggaaagccacattctgaggagacaagcctcagctcccaaccagcaacacctcactggaaaccatttgccctttacctaatggcttttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctgtgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcacacacacacacacacaggagtacagctgctggaacatatgcacgcacacatggaggaacacacacaaacaggaacatacacacacatgcataagcacaaaagatgcacacgtactcataggcacacatgcatgcacacacagacagccacatgggcagccacactggaactgtccatcccattggagccacagctcaggccacaagcaaatggacaaggcatgtggcctggcagcaggcaaaggcagtggctttgagagaagaaagaaacctgacatctgaaagagcagagtgccaagaaagtaggtacagggagggggaagaagagagagacttggcaaggtttaaatcaactctacctgatgatattgaattgaagggtggaaatgagccatttgggttcttgttggacaaaaccaaaggcaaaaagccaaaaactgcagtgactcacattgcagccccagctttatgaaagtaagagcgttatcttttttgattatttgtgtcacttatgaccactccactgactttcccccataacattgagaattactatcccttgacaaacaagcaatgttagcagagaatcaccaaaagccctgctgggctagaaccacacactctaacttttgactcagcagttcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctacgttgcacaaagaaagggggaatattccatgtgtttcatgcactgggcaacaagaaacaaggcattcaagggatcttataaatctagaagagcataaattgagaggagcatcttttttaatattaggaaaaactattaaatgaatcattggcagaatccagccaatgtggccccagaaagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctctccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaggcattgatattctccacagttccctccatctccaggacccagtgcctcacagggcagccacgtggagttctgctcactttcccaaaccatacttggggaaacaatcatcttgtcacttggaggacttcaaggtggggtggtacccattgggctggagagctgagggcacatggcctgtctcctgtgcatagcataaccccacaaaggcctaagacatggagaccgacctctgcatccttcccttctccctgcctagcccaggcagttcctgtcaggctgctcccaactccagctgccagattcgaaaaagatagtcattcattgggggcaagaatcctctggggttccagtgagctgcaggtacaatgttagtggatggtgtgatccatctgccaaaaccttcatctgaaattggaatgtgaaacctccatattgagccgtgccagctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgttattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggtttttaatggcacagtgtctctctcaccctgtgtagagttcagagtggcaacttcggagctactaaccacactaatcttctttatttttaattaaaaattttacactatcattaacacaatgaggacagcaaatagagtagaccagcccaggagagcaatgaaaccagtagacagtgataggctcgaaaattgtttgagcagagaattagcaggcagcttcacacctcgttaagtgacctaatggcttggagggatgagccagcctggtgccccttgagagagaggtacttggtggagtctttgcttgggtttccctagaagcagactctgaagcaagggtttgagtacaagtaggttatttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtgtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacggccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctctagagaagtcggcaggtcagtaaagatgcaagcatgtgagacatgactgtcaggtgaggggtaggcagacagggaggttcgttgtctctttactctgagctcccaatccagtgaggattgcaggctgggttcacagtacgggcccaagctcaggggttctgttaggtctatggaacaaagggagacttcttcaagaacatgtggagtgtgacttaggtggcagctttcagggcatggaggtgggtggggtagaacgtctcctgctttgtagctttgctgaagctacaaaggtgaagaaaaggctggtgggtctgtagaatccaaggagagccttcttgctgtgtgctgggttttctcagaagcagaccctgagacaaggatttgaaagcaagtcattcatttgagaggagatcccaggaagcaccagctgggaaggaggaaattgatgccagaaagggagagtggcccagagagcaaattaccccctagggcaatgggagctcaatctccctggggaactctgggaaacagtgtggaccgagtgggcctcagagttacccacaaactcctgtcaaccactgggtgaaggccactacccaggagtagagatgaggtggggagatagaaggattcattctagacaagaaaaatagggccctgcagacagagtcttcagcagagttgcatgtgctgacagttggaaaacagccagcttgcaagggtagggttctgacagttggcagtagtggaaactgagtcaaagctgagatgactcctggctccctacctcatgatgcagccttagaggagcatatcaaacatctttgaaccttaattttttcatccgtgaaatgggcaaaatggatgtcttgtcaggtttgttgcaaggtatccttgagataatatgcgtatcaggcctggcacataatagatgctcaataagcattcatttccttctgtctcagaagagttgaggttacaacgttgcacaatttcgggttgtcctgatggagaagcaggggtgtgcctcaagaaaccagtgcagttgttcattggacctcccagtgagcttagggtcattaaaagaagaaagggcaactgatccaggctaagtataagattgtgagggttgcaaagttaagggcaaaaatcagaggataccaacataaatctcaaaggctttgaaaaacaacatccaagaaaagagaaggtaaaggcagggagaagacccattgctcgtggccagggatgtaatgaaggatgcccccgaggaagcggcatttctgacctgcatcttcttccctgtcacataccttagaactagatgaatattcaaggatagtcataagggagggttaatccctaaggtgggcaaagggattataaggtagcaactaccccaagtgaggttttctccgagccagggaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtgtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaaatcaccaaacctcagccaacccacagaaacaagcaagccagccaagctcagcagagctgcctagctgagcccagcccagagcacctagctgccagctgaactgtggactcgtaagctatctaaacacctgctgttatatgctgctgacatattatggccgtttttgtgtagtaactgttacagctgcccatgctagacccccttctccatcctcctacagtacttgaggtgtaccccagtctggagagaatattggcttctaggcctatcctagacctactgaatcaaaatctttagggacaagcctcatagtgtgtatttcttttagaatattggcttctaggcctatcctagacctactgaatcaaaatctttagggataagcctcatagtgtgtatttcttttgaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcctccatgataaaagggcgacagcaagaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatgcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggggggttcacatgtaagtatataattacattataatatgcttagtgctaacctggaaataaaacaccacccatataggaatgcaatagctagaaaaagcaagtcagccctaaaaaattagagaaagaaagatacttaaatgcatttaaagaatgcagctcaccacatgggggatgaacttgttttcttgggtcgatacagcatatgaattcatctagaagcttcatcaatacgatactagacaaatgggtaattggatttcatctggagatttgcttccacctagaagcctagacttaaaaagtagcccacatcatttccttaccccaaattccctaaagcccttcgacagattctcatctctttgactaaatttaactggcttaaagaccagggtaatgtcttccaactcttttactcatgagagaatgaaccagcggcctcattccccacagagatcattaagagagacttcataaataaaagactgaattatggatggatggacggatggatggatggatggatggatggatggatggatggatggatggatggatgaatggatggatggatgattggatggatggatggttagatggatggatagatggatggatagttggatggaacggatggatgaaaagatgggaggatgctaatgagactattgggattttattccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgcttctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtctgatccatcatccaattacagttttctgaagcagcaacaaagaccaagaaacaatgcccaggcctcaattaagaaggatcagactctgaagccatggagtcttctaaaatatgatagaagataaattttgtggttgtgtcaaagaatcatgagtactataactgtcattttggctagagccccattcttacctttaaaagctcttaatcatttttccttgaagacaaagacttgatggtaggcagaattgtaaaatgcccccctaagatttccaccctctgctgtaagcactctgtatagtccctctcttgagtatggcaggacctgtgaatatgatgagatatcactcttacaattaggttattagattgcattatatggcagagttagagatttttttcagatgtcatcaaggcgcctaatcagttgactttaagctaatcaaaggaaagactatcctgggtgggcctgaactaatcaggtgagccctttaaaaggtaatctacaagtcagagaaggaaggagtcagagagattctaagcagtggaggctttcacctgttggccttgaagatgccactgccataatgtgaacagggccacatggcaaggaatggcggactccctgggagctgaggcctcactcctacaaccacaaacaactgaatgaacttgaaagaggaccccaagccctagatgagacagctccagtgacaccttgatttcagccaggtgagaccttgagcaaaagccccagttaacccacgtccagaaactctgagataaatttgtgttgttttaagccactatgtttgtaataatttgctatacagcaataaaaaaactaatacaaccttcttgattatagtggatatttgagcacaaactgaatgacttgctgtctctctgaattaataaaaatagaccactcctcagtttttactttttcttaatatgtttgcttttatctcaaaaataagtatactctgcctattgccacatggggccctttcataaataataattctgctgcaatgagaggctcagagaaatttagtgaggaagttaagaagagctcttgggccagcctcgctgaattcaaatctcacgtccaactgcttcttaactatgtgccctaggcaagttaatctctctgtgtctcaatttcctcatctgtaaaatgggttaataataatactgatcttaccggtgattgtgataattcaattcagtagtgcacacaaggcccttagaactgcctctggctcataagacaccctcaataagcattcgatgttgttaagtcccctgcccaagattgcacagctagaattcagcagggaagaacacaagcctaaggtggtcagacctcaaagtctgttctcttagcctccccctcccttcctgccttaaggacacatatgaatttgcagaaagcattttttaaatgaaattaaaaggggcaattagtgcgttattctaagttttctttccactttcctgctaacaactagtgtgttattctaagttttctttccactttcttgcttccccagccctccctgtcctgcctcccagaatactttactggtttcccctgggagcacatccttaataaatcacttgcctacaagctttcatcacagggttggctcccaggaatcctgatcttacattagagcggtctggagctttaggcaaagcagaattttccatcctacatggccaaggcggagagaatctctgacatagaaataagattagcttctccaccatggtaaccctgctgctgactcccaacctacgggaaattatttttcacaaagaaagaatctttaattactaaccaataattaaaacctgaagccaagaacaggaagccagactttggctcttagcaatgttccttaacatcaccgggagtattatggtgaggtctgcactttccatgtggcatgcacacaacctctccacaatgagtgctctgctaggcagaagaataagatgtattacagtgtgtaggagatgttttcattaagctatggaaagagatggattatgttttataactcaagcattgccaattttttaaataaggagttcagtgtaagtctaagctattcaaagagcactagttcacagactcccattgaggtactgcaagccaaaaaaaaaatgcgttgtttgatctttatggccctcagtttccccatctataattgtcatccccaacaagattctcattgtctccagaatcaaaagagtataatgattattcatatggctgatatgaacactgggtctttgttgatcaatcaaaaaatagaaattaaatggaacttctgagaatgttcaaggcgttgaagctattctggtatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgatttgccttagctcacacagacagtgagtagcaaaatgtgaagttcaccatctgtcatgctgccttcatttaacctggccccctccagtctcccacatcttaccaaatggcatcgccatggtcacaatgactaaggtgctaaacgttaccatccttgactgctgctcccttctttttcccctcagccaccctatctgccagttctgctaggcaatacacctgcctctctgttcccaccactggcatcctggaccaagccagcatcacttccctcctggaccccacaaaagtttcctgcttccactcttaccctctgcaatgcattctccccaaaacaagcagaaaggtcgttacaaagaacaaagtagtggaagccatatcacttccatgcttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttgttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttctttagtaacttctggggagaaatactatatttcttcatagctacaaccaaaaaacagaaagcctctctatccaagactgccttgtccatcccaagaaaacagagaactacagaaagcagcaggaatgattcccttgatgcttttaattcattcatttgtgttatatgcaattaacaataggccaactgatttctcaaagcatgcaatttcaagctgaaaaattaacctaggttattttccactcagttaagtatcaaaaagattttgaaaaataaaaaaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccaggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatcaatcaacaatttgagtcttaaaaattaaaatatttttcataggctgaacacagcggcccatccctataatcccagcactttgggagactagggtgggagtattgcttgagccaggggtttgagaccagcctgagtaacatggcaacaccctgtcgctacaaaaaaattaaaaatttgctgggaatggtggtgcatctgtagtcccacctactcaggaggttgagacgggaggatctattgagcctaagtcgaagctacggtgagccacaatcacaccactgcactccagcctgggtgacagaacgcaaccctgactcaaaaaaataagaaaaagtatttctcttaaatgcaaaggcaaagaggacctttctttgtctcttctgtacctaacgtaagggttggctaactacacagattctggccacctgtttttgtaaataaagttttatcggaacgcagccatgctcacttttttacttgatatctatggttgcctgcatgctctaagggaagggtggagtagttgtgacaaagtccatatggcctgcaaagcctaaaatttttactatttgatcctttaagaataggtctgctgaaatcccctggtctaatcagttgtgtgtcaagatgtaggaaaatggttttgttagaaacttaagtccagagagcttcaaaacaggctccagtgacagctgtagcaccttctagcagtgtgacatctggaaaactgctgaatatcttgggggcatagcaccctcatttgagagctgagaaaattgaactcttgtctgttgtaactctaaaatcttatgaaactctcctcccttccaataaaatccctgattaagaaacaaaagctgaattagttttgttaaggaaatggaatcgtcaagtagtttgaatctagttaatttgcttttgagaatgacagacattaagtcaaagtgatgctccttttccatgcatgatgctgtatacactaatcactggggctgagtgatttcaaagagttttgcattcatttactgtcttagctgggattcctccaaaagctgactgtgagacatggatccacaaaccagcattttatttggaatttggtgccaggaagcacaggtaggggagcaggggagtgaaaaagtgaaggaagtcaatacagggtgtgcacaagtgtgtcctactgtgggcaacaggagctcagttctgctaagcacccctagaacatgagttagaacacatgaaggagaaagagtacaagtatgaacacaccaactcttatccatcattggttgatgattaatatcaggatggagagaggaacaatttcctatacttctaagctgccatatcattggtgaatttgactccagagataaagagataaaatgctgacagatggaagttgtgtcaatgtgcactgatatgctcaaagcaaggagttattatggatggggcatctaatagcatctaggacacttacaaaatcagaggtctccaatcacacatccctatttgtaaaacaattttaactaggctctcctaatacatgtatagctatttattcagacagtatatgtatgtactactatcaatgggctatgtacattataaagcatatccaagaaagaaaattttaaaggataaaatataaataaatattaaaagttaaaatgcacactcatgttcatggtaacattattcacaatagccaagaagtataagcaacccaaatatcaatcaatcaatcgatgaatggagaagcaaaatgtattacatacatataatggaatattattcagcctttttatcaccttaagatcctaaggtcctaagattatttattcagaatttcaggaaggaaattctgttacttgcagcaacagggatgaactttgaggacattacactaaatgaaataagctagtcataaaaagacaaatattctgatcccacttatatgaggtatctagagtaatcaaactcatagagacaaaaggtggaaaggtagttgccagggtctgggttgagggggaaaatagggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccctcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatcaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaagcagaaggaacagcttgtgcaaagaccctgaggcaggaacatgctcagccctttcaaggatctgaagaaggccagtgtgtgtgtgctgggggaaagaagtatatcagtacgggaaggaaaaatatggcatgagatgacattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaacgggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtcttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggacttactgcctggggtaaggaccagggctcatttatcttatctctctaatctggggagctgtgaggactagaatgggtaagggttcagtgcagggtttacagctgctgaaaggtccctgtagcatttcctttatggaaaatcctatggatatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtggaatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcatgcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcatggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcccttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagacaaatggaagggagcctcttctgcccaccaagcttcaacttaaatgctgagtcatgagctactagtggaggctggaaggccaagacctgggctagtgctgggaaaaggaagtagctcttattctcccaaatgtgtgctgggtgctcagaaacagagacagtgggaccccatctctacaaaaataaaaatttaaacattagctatgtatggtgacatatgggtgcctgtagtcccagctactcaggagactgaggtaagaggattagttgagtccaggagatcaaggctgcagtgagctatgattacaccactgcactccagcctgagtgacagagtgataccatgtgaaagaaagaaaaaaagaaagagagagagaaagagagagaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagaactcagcatcttgctgacaagtcaggaagaactcacaacctgcccagtggtcattttagtcaattttggggggaaacagttcttttgaataggtcccctaaaaaaggcttgaaagaagaattagtacattccaaagcagtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttatacaaatggaatcatacagtatacagcctttgagtctggctttttcaagcatttattctttatcaatgtggttgcatatatcaataacatgttcttttttattgttgcgtagcattcccttgtgtgatgtaccacaatgtgtttatctgttttccagtctgggaacatttggataactttcagtttggacgattataaataaaatcgttatatacatctacacacagatttttgtatagaatttagatgtcctctgtcttgggattgaggggctgtatggtaaaccaactgctctttaatgtctagaaaatgtgacagtcctcagagtcatggagcctagaaaacagtgcggttgtccctggagttcagaatgctttactctgtaaatatcattcttacttggatagccttggtctgtgagtaaatgtgctatgataggcgttgtgtagccgttcatcccagctctgtccccagaatcagataaggactcatgctgtgaactctgatgccttcagtccaatgagaccagaacatcacttgcccgtttttattttaggtctcgtgtcaagctaagctaagatacttcattcctttttcttttcccatcaaattttgtatcttaaaagtttcaaaaaaatttataagcaagtatatctcaagatttttaactgaatgaaataaatttaaataaaattctgagtatttttccatttgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgacaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatattgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattacttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtggcctcaacctcgccagccattcaaaggcaagcagaactctcacagaggaggcaagggcggagaagctttgagcatctctacaacatcagagaacacccagtcaaaagagagggaaacacaaattgacttgtacctcatcaccttgacaacacaaatttagactctggctgctacattatcttctggttccttttccggagctgctctccttgagctgatttacacggttgctattgtagacccttgactgtacacccagtctttgtggaactccaagaatcaggcttcaattgtactttgagccagctacactgggccccttcaaccctcagccttctctccaggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatggggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatacattgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacctttcaatctttactattagagattaacttgtttcaatgcccattctcttctgttaaagcagataatattgggaaaggcaatgtctgaatgtatttctgccaagatgtcgatggtttatcaaaatcaatttcttcctgtggaagagtttaggtgcaaggggaggagagaaagtgagagaagattataacagggaggctatggatgcagaaaggaaaagcggggaatcaaaggcaaacctgccacccatttcacaaataaaagaatcagtgtgggctggatgcagtgtctcatgcctgcaatcccaatactttaggaggccaaggtgggagggtcgcttgaggccaggaatttgagaccagcctgggcaacacagtgaaactctgtctttacaatttttttttaattagccaggcatgatggcacacgcctgtagtttcagctactctggagactgaggtgggaagatcacttgagcccaggagttggaggctgcagtgagggatgattgtgccactgcattctagcctgggttacagagtgagatcctgtctcaaaaaaaaaaaaaaaaaaaaaaatgcagattcagtcagtctgggctggggcctgagattctggatttctgacaagttctcaggtaatgtcagtgctgctagtacacagatcacattttaagccacaagaaggctaggatatgaggtatgaacaaaggtgttagctcagtggttctcaacctggactatacatcagaaccaccaaaagaggttctgttgggtttgttggaggtttgtttttttttttaagctcctgatgctcaagccccaccccagattaattaaatcagaatctaggaattgctcaagtatttgtatttctaaaagctctccaggtgattctcttgtgcagcttgagttaggaaccactgttagttgataactgaaggtgctattaaaaattccataatatatgagctcatgaaggctaatgagacaccccagctaagggcatcttcctctgcaacagcaatttgctattgtacaatgggggcaaacagttggtgctcaataaatttgttcaatgaaaaaaaataagtgattggctgaatgcatgaatgaatggaaatgtttgaagtcaacagtctatggaatgaaaaggattacagtcctattatcaaaatgacaagtggcaggatgggtattttaagacagatcatcttttccatcactctttcaaataccccatagaagtacttaaatcttggcccacttttaagcctgactttgttaataactggaggagtcaaagccacaaattttccacaccattactttattccagtgtttgccaaaccaaccaacagtcactatacacttttgctactggtgttattatttacctagtatgtttctttaaattgacttactttttaacataaacaaatgtattttaaagggaaactataaatcactatttcaaatagaaaagcaactaatattccatgacatcagtagaattgacagtcaaaataaatgcaacgtaagcaactgaagcagggtgtttctgcctgccaatgcttgcctctgtcagataagaagaaggattaacaagtatacggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccattgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtttcatacctcattctttgccagagctgcagagttttgcatcatatgggtgcaccagaatttctttaactcatccccagtgttggagatttaggttgtttctaatatttcactattacagtcactgccagaatgaatatatttaaatatacatctttcattcatatggaagaatatctttagggtagagtcttagaggtggaattgctgggtcaaacagtccattcatgtttattttgatagatattgccaaatttctcttcaaagagattgtgccaacttccataccaaccaaccacatacagaagcacctgtgtcccctcattctcaaaataatattttaaatacattaacaagatatacaaggtaatcaagttttttagtctgtttgagctgatataacaaaatatcttagactgagtaatttataagcaacagaaatctattggctacagttctggagaccagaattccaagaccaaggtgccagcagatgtggtgtctggtgaaggcctgttcctcatacacaaggacttcctgccacatcttcacatagtggaaatgttaaacaggctccctcaggcctcttttataagggcactaatcccgttcatgagggctccaccctcatgacctaattacctcccaaggaccccacctcttaatacaaacacacagggggttatatgtcaacatatgaattttggagggacaccaacattcagactatggcaccaaggaatgctattatatggaagcagttatcaaaagattgaaattacacatctgtgaaatgctaacatatgtcctttattaatgcatcaaataacaaaatctagtggcaggtaggggtgtgctgaaaagatactttttagcataccggcaacaaccctaatgtggaatgaagatacatgttgatgatatgctcacaggtactgctaataatactgttgtttgtacttcccattcgtaattgaaggaaatgcttgatttgaggtggtggctagtgcaaataacaatgtaaatttttccacccaagttttagagcctatcttggagccagctcttagagcctcattccaatgaatggcagcttatttttaatacatcaggtcagctccaggaatgtacgcttttagggaagctcttaaaattcatgtgtgggaatcagcctccatctagcctaatacatgcttcactggccttctaaaatagcaagccgagcaagaagacatagacaggcaaaggccactctaaagataccctccggaggtgtctgcctcggctgttacttagagcaactgtttgctccttcctgcaatacagctgcactcctccaccacagggttttggaaaatatcaattaaataatatattttaaacaactttgaaaaagataaaggcatctttttaatttggggcaccctattagccattaagaattaatgttattatctcctcatctgtttagtgtttagaacctctcccaagtctgctgataatggtggcaatgagggccaaaggatggagctgcttagctctggtaaatactggccaggcacagaggctcatgcctgtaatcccagcactttgggaggctgaggcaggcagatcacttgacgtctggagttcgagaccagcctggcctggccaacatggcaaaaccccgtctctactaaaaattagccaggcatggtggcacacctgtaatcccagctactcaggaggctgaggcaggagaatcacttgaaccctagggacagaggttgcagtgagctgagattatgcccccgcactcaagcctgggcaacagagcaagactctgtctcaaaaaaaaaaaaaaaaaggcatggtggctcatgcctgtaatcccagcactttgggaggccaaggcgggtggatcacgaggttaggagatcaagaccatcctggctaatatagtgaaccccgtctctactaaaagtacaaaaacaaaattagccaggcgtggtggtgggctcctgtagtcccagctactcgggaggctgaggcgggagaatggcatgaacctgggaggcggagcttgcagtgagccaagatcacgccactgcactccagcctgggcgacagagcgagactccgtctcaaaaaaaaaaagaaaagaaaagaagaaaagaaaacataaaatgtccagccacccaggacacaactgtgtggcctgaccgttcagttgtatcactcctcttatctggaaagtgctccagtgactacagaagttgctagaatttccaaaagcaagaagaaagtgatgggaaaatgtgtcaaatccacaatgggagaacactgtgtcactagaaaattatatgaccctggcaaccttaggagtatggaagaaagatttcaaacaagtttctgactatgtatctttttctaaatttttttgaatgctgaagaaatgttaaatttcattaagttttacagccagatttaatatagacataaatccctttaatgttcgtttcagtcaaaagtgagcggaacattatcgttaaaccagtgcatgtgggagaattacttgaggaaaatcaaaataggcacagttgggaacattaagccgtggccatattagacgcaagtaggcgcaatagcaaaattctttaggctctaatggactgggctattttgcttctcagtttccatacagatgagctttgttctggggcaatatggttgcagtttgagagtctatctgaaggagctcatttctctttcattagtccatgagcacagtgcaatttcagctaatactgttacacagctcctagctgggttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaattgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttggaccacagagtttgcccctcagtactctaaaaatatctgttcaatcacatcagtggatgtccatattaaatacattggtcttctttcttatggcaagtaactgccactctctgccaagggcagtgttctaaccttggaaacaaacaggacactcgtaggttgagaaacagaagaactagaggacggtgactcctaggggcttgaccagtggtgggcagtggagtggtggaaaccacggtggcacctcttcaccatcgcaatgtaatgctctcctcagcctccatcattacctggtgagctggggctcagtatctgcctgataacccaccttcagctagcatgagacacaggaggagcaagcttcaaactcccaacaaggtagtcagcctagttcataccagattcagtggctgtagcccaggagagaacgaggtatggggcacgtatgtctcagagcagagagatctgcctagaaagacaaagactgagtgagaagctatagtgtgggctatcagagggcagcctgggagcccaagaggcctcggacattggtcagggattggcaaactctttccgataaaaggccactttgtaaatactttaggctttgtggggttttgtcacaacgacttatctctgctgttagagtgcaaaagcagcgactggcaattcataaacaaatggatgtggctgtgttccgatacaactttacttacaaaaacaggccatgggctgatttagctggtgggccatattttgtgacctttgctgtcggtgatcaaagaaagaggacacaacaggagaagtcaggtgaggcattgcccatactgcgtggggcaacgtgcttgccagcttacattccttgtttcattttatcctcacagcaaccaactagtaacagttttaccacctacattttgaagatgaggaaactacagtttctaaaaaataggaaaatttccagggtcaaaaacagcctcatttcaaaaccaagtctgtttgacttgaatgtctctcttccttcccctacatcaagctggtacctgcagacgtatttgtctagggcagcccagccagggaagcccattgatcacagaggcattaaattccagatttgaaggtatggatggcagtgccagggccaggtgcaatctcaggagcctcagaagcttctctgtggatgtaaaagcaatgggcacagccaccattgactgcaggagctctcacctctctcatcaccagccattcagatagacaagccccaaatccgaaaggtgtcatctgtgggcctgcgtctttgatagccaggcaattacagcacctcatatataaaaagccagaggaatctgtgaatataataagtgactgtcctttcttagcgtggtgcaggccatctgtttgaaaagtacacactgcaaacaatgccaagttgtaattattaaactttctagctaagagcgagtctcatctttcttcctaattatgcattcaaatattcagaaattaagccttagaattattatataccagggatgggtttttttcccctgtgcattaaacttttagaagagaacatgagccatcatcagaagtttctcccagaaataactcccagagaagccctgaggtcagcttggaatcaacccaaccttctcactttcggtgtgatggtacaatgataattcaagttcttaatgatgactctgaatcatctcgatcctgaatcatcagagattaaattattttcaccaaacagctagtattttctaaagcaggaaaatcgattaaaggatttcagtaaaaagttagagaagtccaaacaaagcaagcatctggcaagcctcggtgaccagaacattaaattcaccaaacaccacctgctccaaatgtccatgttaatggcaattatagaagactccagtagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactctctagttttccctcactgacttcatttccctctgccagcctggtagaaacatggtctcagtccgctcaggttttgcccctgtcctccctgtctccagaagcgccctcaagcttcaaaagattcatacagccttccagagagggagacggggacctagtgctggttttcatcatctgtccactctggcttctgcagtaacaccattcccattggcctcggtggtcagttcacccagatcctgcctaaaccctggatgcttattgtcctgaccacccgaatgtcctaggccagctagttctcagcgtcacatcctcaccaacctccgctccctgctctccactggggatcaagggaatgcaggatggagctgccccaagcctgtagctcagatgcctcacaggggcatttctgatctgcaacactatgtccctgttgtgagctgagtcccaggcctctctgaggttggacatcccagcgtgcctcttcccactccaacagcacacctcagaaggaagaggcagcctcaggggcccgctgagtggccactcgtgctggatttccacccacctcaccttagggaattttaattttttctaaagagaaacaaaccagattgggcagatactcttccaaatctactgcttaagtttcaatctcagctttgaagcccagaaaaaaaagtattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcaacttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaactcaagtgtgtcacaaaacttgtgtgttatcttatgataaagcacagttcctaaatatgtctcaggacccataacatcaagaaatgccaaagctggaatgtgcctctaacccagtgtttcctggcccagtgtatactgtgaaccaagaagccatctggggtcttcatttcagacccccaaaacaaaggagaggagaatgagatgaggaaaaaggaacttgagagagagcagcttctccaagcaagcagagaagggaatggggaaggaatgggttattcactaaacaatggtggatcatctcccattacagaccagaataaaaggcaaaccaactaaagacctaaatgttaaagaaaaaaaaaacccacaaaattgcttagacagttttagtggctacataattattttatgtggggaaagattctcagtgggaaaaaggaaggtgctggatgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccagcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacatcttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacattctctaaagtgaaatttttaatattacaatcttcctctagaataatcttttgactgttttgttctgctaacttgaaattatttgctactttaatccattaaagagaaaagaaaatagaaataagaagttctttctcaacccattacaaggtgatttaaaacatgctgattttgctttatgtgttgaaactgtcgtagagaagtattttgccccatgggtctatgtgtttttgaaaagcattctgtacgctttctgctataaccccataacagctcatggagtccctttcaacaaaacagtaagtgtgattggcagaggtttgaagtattgcttgggacaaagatcctatgatgtcaaactacccaaacagtccatccaagagaataattttccttcagcttgttttgccactaaacatggaaatgtggtctcttttttcttcaagtaaacatttttcttaaatggttaattacatataagagatatgaagaaataaagatgtgcggtttgctcaatgaaagaatactgtaatttttaaacctagtgtttccctgttattgacgtccttgggtgaagttcataaaaacatatgaacttcaattagttgtataaaaatatatgatgtgcagagcactttatccatttttttttttatttctcatggcactctaagtagcacataaaacaaatgttgtcatttttagtttagtgataaggaaacaggctcagaagggttgaagggcttccttggtcaaacagttaaaattcaagtcaaagccaagattagccccatgcttcaaattatttccaaatccacatttgtactattctttgctgagtatcatttctattatttgatacaggcagcatgatgaccagaatatgttcaagggtagagcctcagtggacaggaagcttagattctgtctctaaagttagcaagttgacctgagacccctcagtctcatcaagggttgacacagggtacacaggttctgagtacaaatgcagaaaataagaaaaaagaaaatgaaatttaattttgtaatattttgtaaagatcattgctgatgtcggatagcacaattcattctctatccacatcacctgcaacctgaaaatgacatacaatgcttggaggtgtgtgtttagaggatgagaatgtataaaaaaggtctgaaaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtctttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttccctttcctagccaaaggaagccgtgacagactgtacctggaaaaatgggacacttctgcccaaatactgtgcttttcccatggtcttagcaaacagcagaccaggagattctctcccatgtctgggttggcaggtcccacgcccatggagctttgctcactgctagtgcagcagtctgagattgatctgcaaggcagcagcctgatggagggaggctgagacttgagtaggtaaaaaaaagtggccaggaagctcagactgggcagagcccaccacagctcagcaaggtctactgcctctatagactccacctctgtgggcagggcatagctggaaaaaaggagcagaagcttctgcagacttaaacgcccctgtctgacagatctgaagagggcagtggttctcccagcatggcatttgagctctgagaatggacagactgcctcctcaagtgggtcccttacccccatgtagcctaactaggagacacctcccagtaggggccaacagacagctcacaaaggtgggtgcccctctaggacaaagcttcaagaggaaagatcaggcagcaatatttgctgttctgcaatatttgctgttctgcagcctctgctggtgatacccaggcaaacagggtctggagtgggcctccaacagcctgcagctgagggacctgactgttagaaggaaaactaacaaacagaaaggaatagcatcaacatcaacaaaaaggacatccacacgaaaaccccatttgtagatcaccaacatcaaagaccaaaggtagataaaaccacaaatatggggagaaaccagagcagaaaagctgaaaattctaaaaaacgagtgcctcttctcctccaaaggaccgcagctcctcgacagcaacagaacaaagctggatggaaaatgactttgatgagttgacagaagtaggcttcagaagctcagtaataacaaacttgtccaagctaaaggagcatattctaacccattgcaaggaagctaaaaaccttgaaaaaaggttagatgaatggctaaccagaataaacagtgtagagaagactttaaatgacctgatggagctgaaaaccatggcacgagaacttcgtgacgcatgcaaaagcttcaatagccgatttgatcaagtggaagaaagggtaacagtgattgaagatcaaattaatgaaataaagtgagaagacaaggttagagaaaaaagagtaaaaagaaatgaaaaaaccctccaagaaatatgggactatgtgaaaagatcaaatctacgtttgattagtgtacttgaaactgacagggagaatggaaccaagttggaaaacactcttcaggatattatccaggagaacttccccaacctagcaaggcaggccaacattcagattcaggaaatacagagaacaccacaaagatactcctcaagaagaggaactccaagacacatacttgtcagattcaccaaagttgaaatgaaggaaaaaatgttaagggtagccagagagaaaggtcgggttacccacaaagggaagcccatcagactaacagcagatctctcagcagaaaccctacaagccagaggagagtggggaccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacaccccaaattgcaaagaccatcaatgctaggaagaaactgcatcaactaacgggcaaaataaccagctaacatcataatgacagaatcaaattcacacataacaatattaaccttaaatgtaaatgggctaaatgccccaattaaaagacacagacaggcaaattggataaagagtcaagacccatcagtgtgctgtattcaggagacccatctcacgtgcggagacacatataggctcaaaattaagggatggaggaagatctaccaagcaaatggaaaacaaaaaaaacacaagggttgcaattctagtctctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtccttagagacctacaaagagacttagagtcccacacaataataaggggagactttaacaccccactgtcaatattagacagatcaacgagacagaaggttaacaaggatatccaggcttgaactcagctctggaccaagtggacctaatagacatctacagaattctccaccccaaatcaacagaatatacattcttctcagcatcacatcgcacttattccaaaattgaccgcataattggaagtaaagcactcctcagcaaatgtaaaagaaaagaaatcacaacaaactgtctctcagaccacagtgcaatcaaattagaactcaggattaagaaactcactcaaaaccacacaactacatggaaactgaacaacctgctcctgaatgactactgggtacataacgaaatgaaggcagaaataaagacattctttgaaaccaatgagaacaaagacaaaacataccagaatctctgggacacatttaaagcaatgtgtagagggaaatttatagcactaaatgcccacaagagaaagcaggaaagatctaaaatcgacaccctaacatcacaattaaaagaactagagaagcgacagtgaacaaattcaaaagctagcagaaggcaagaaataactaagatcagagcagaactgaaggagctagagacacaaaaaacccttcaaaaaaaatcgatgaatccaggagctggttttttgaaaagatcaacaaaagtgatagatcactagcaagactaataaagatgaaaagagagaaaaatcaaatagacgcattcaaaaatgataaaggggatatcaccaccgatcccacagaaatacaaactaccatcagagaatactataaacacctctacacaaataaactagaaaatctagaagaaatggataaattcctgaacacaaacaccctcccaagactaaaccaggaagaagttgaatctctgaatagaccaataacaggctctgaaattgaggcaataattaatagcctaccaaccaaaaaaagtccaggaccagacggattcacagccaaattctaccagaggtacaaagaggagcggttaccgttccttgtgaaactattccagtcaacagaaaaagagggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccaaatccagcagcacatcaaaaagcttatccgccacgatcaagtcagcttcatccctggaatgcaaggctggttcaacatatgcaaatcagtaaacgtaatccatcacataaacagaaccaatgacaaaaaccacatgattatctcaacagatgcagaaaaggcctttgacaaaattcaacagcccttcatgctaaaaactctcaataaactagatattgatgaaatgtatctcaaaataataagagctatttatgacaaaaccacagccaatatcatactgaatgggcaaaaactggaagcattccctttgaaaaccagcacaagacgaggatgccctctgtcaccactcctattcaacatagtgttggaagttctggccagggcaatcaggcaagagaaagaaataacggtattcaaataggaaaaaaggaagtcaaattgtccctgtttgcagatgacatgattgtatatctagaaaaccccatcgtctcagcccaaaatctccttaagctgagaagcaacttcagcaaagtctcaggatacaaaaatcaatgtgcaaaaatcacaagcatttctatacaccaataacagacaaacagaaagtcaaatcataagtgaactcccattcacaattgctacaaagagaataaaatacctaggaatccaacttacaagggatgtgaaggacctcttcaaggagaacaataaactgctgctcaacaaaagaggacacaaacaaatggaagaacattccatgctcatggataggaagaatgaatatcatggaaatggccatactgcccaaggtaatttgtagattcaatgccatccccatcaagctaccaatgactttcttcacagaattggaaaaaaactactttaaagttcatattgaaccaaaaaagagcccgcattgccaaaacaatcctatgccaaaagaacaaagctggaggcatcacgctacctgacttcaaaccataatacaaggctacagtaaccaaaacagcatggcactggtaccaaaacagatatatagaacagaacagaggcctcagaaataacaccacacatctacaactgcctgatctttgacaaacctgacaaacacaataaatggggaaaggattccctatttaataaatggtgctggcaaaactggctagccacatgtagaaagctgaaactcgatcccttccttataccttatacaaaaattaattcaagatggattaaagacttaaatgttagacctaaaaccatcaaaaccctagaagaaaacctaggcaataccactcaggacataggcatggacaaggacttcatgactaaaacaccaaaagcaatggcaacaaaagccaaaatagacaaatgggatctaattaaacttaagagcttctgcacggcagaagaaactaccatcagagtgaacaggcagcctgcagaatgggagaaaatttttgcaatctacccatctgacaaagggctaatatccagaatctacaaagaacttaaacaaatttacaagaaaaagacaaccccatcaaaaagtgggtgaaggatatgaacagacacttctcaaaagaagacatttatgcagccaacagacacatgaaaaaatgctcatcatcattggtcatcagagaaatgcaaatcaaaaccacaatgagataccatctcacaccagttagaatggtgatcattaaaaagtcaggaaacaacaaatgctggagaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactgtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggaggggtagcattaggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccaattacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctgaagatgattcctgcttgagtgaaggagaatttgaataaagcgtcccttccatgagtgtacgatatgtttatttcaaaacccctctgggatgaaatgatattatgcctgatgttttcttcagtattacttatggcttgtggcaggagggaagagaatgactgaagtatagaggcaataaaattggttatgggttaatcattgttaaagctctgtgatgagtacatgggattttactctatttttgtatgtttttgatttttttctaataacaagaagtaaatttaactagcatacggcataaaaagaggtaataacaaaactaggacttcagtttggtatcatgaaactgttttggtgtgcaagcttccaaggagcttgcaatgtcaaatgattgggcaacagatgcccaagttactacaatgcaaaaatgtagcccagactaaaataacacaaggacagctaatgcaagttgaacagttactgtatttaaggcactgttctgtgttttgcatgtattcattcaactaattctcgtagtaaccctctgaaataggtattatgattttccccttttggaaactgaggcacagagaggttaagttacttgtgcaaggttacagggctaataagaagtggaggcaggatttgatgccagtgggtcattggtctaggattttatctaaggcaataggtagagttgggagtagggaacgaatgtatcccagggcaaggatataatctggacaaagataggctggcggggaggtgcaggatatgttcaggaggtggtctggataactgctgtgggatttggaggctggtgcaggaggcagcattctaagaaggatccgcaagtgaggtggagcataaaagggttgaaaaagttgctaggagaaagaaataaattctgtggttgggtcagaaactgggccaggggcatagatgaggctcattctctcattacactcaagataatgctgctactctcagaagccccaatagcctggagcctggcacttgttgttggctggcataggacccagcatgagcctcccaccagctgtgcagacaccaaggcatcccacaggttcttcaggtgttttctgggcataggcaccaaatccgatgccccatctctgttcagcagagttggggctcttgagaaaggctggtgtcagcatgccctgaaactccagtatagggctgacatgctgagcagcgataggcttgttgctattaactattccagccacactgactgccacaaaggctagttacaatgcaggagcaattgcttcacaggaaaaggcagcggctgtccagcacgagattctcactgctgtgaaaatagaaaataaaatgcactataggggacactcaaagaagtaaaatgttccccttggttgggagactgagttcaatagcaacacatctctcctaggttttcctgacactttaaaccatcatctcataccctctgcatttactcattgttttcctttattaaactccacgccaagggtgctttaggaaaacaaacttcatacatatgcagaactgcttttagggaatgtgtatattagaatagcttgccttgtgctcgatttgcttttgttggattattcctgtttaagcagagcaagcgtatttattctactgtgaaccatttaataattacatgcagtatctgagctccagggatgtacttgaaatacagttaagacattttcaaaaagagtataattttctcttagcttgcaatgagcaaaatacatttgaccaaacaaaataataataatagtaactcaaattgtaaaaaggtagaaaatacacatttaatcagcatcagtaatgtgcaaaacagatataactgatttgctgagagctatcaggatttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaatctctcttgcatagcatttctttgacaggtgttcactactgaaatgtcatccctgccattgacgatatttatgaagcattggggacgcagcatactctatctattaaaccctaaacagtgagagattctaggttagatgcaattcttggctgcagaaagtttactataaattcaggaagagagaagacatttattactcaagcaaacaaaatggagggaaggaagatggataaatggaggctgaagaacatttatctctttgtgagccaatgtgattgatagcattagttaaaccttcaaataagaaaggttttctgggattaacttttattttcttattaaaagtcatacttcattctgaagaaccccaagcaacaggccacaaaaaagtgtgagaaaaaaggccctctctggttggctattttcacactgatgtaagctgataccttaccctggtgatacttaatggtttgggagtagatgaacatctttcccttatgtctttatgaactaattctgaaacacctcctggataataaaatgcaaactgttttcaaagacatagtctttttcatgtgagctttaagactacctcatcagtcgatattagctcaaaggttactgcttgtaaccaaccctttctacatccaaaccagagcacagtgaaatccaacagcatttaatttttaaatttctagtcccctacctggattagaaaagtatttattatttaaatttttccttcagctaaaaggagtagatgtaatatagatttaggggttatggagaaaattataaagatggtaaaagaaagacctatatttgggtataattagttctactttgtaagctaatgtgtacatgccatatagagattttatggtactcagacggcaatcaataactcttttcttaagagagagaaatacagcacattatgtagacaaatgtaatattatgttaattgcttggtatggaatgagtgatccctgaatcagttcccttatctataaacagggactaaagctcccaccttgaaggcttgtactgcggattcaagacaggtatagagtgcttggtacagagcatggcacatggtaagcactccctaaccgacaaccaatagagttgtgaaattcagcaaagagatttctacaggagctaagtcaaagattattcaacgacaaagaaaagtaggagaatttatgctacaggagtaaatgtagcattcacccacctttctcagacatctgctctctcatttaagcttttgacagaaactggataacagtcagctcaaggttaaactctctgtcaagattctagtgcctgtgtttctgcattgctgattgaaaaaggagttatagccaaagataccttgtatgcatgaaacaaagttgatctattaggaaatttgaaatgtctagcatctggcctcagaaagatgaggagtctgctcacttctccagaaagcaatgggtgcttgccagcagactcagggacttccccagaggcagctttgctcattctcacctgtcacctattctaacctattctgcctgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatctgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacatacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagctgatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagaggaagagaatgaagataaagaagaagaagatgaggttgaagttcagcaacaacagaacaacagcaagatgggaagctttgccgaccggataccaaaacattacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttatgatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgaattattacctaaagacctggaatcaatagaaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatgatcaatgttgaaaaggattgagcaacaggattgctcacaccttgaaggaggtagtacatagccatataacctgttttaaatcctacaagaagacctcagagaaactattccttatgggtacatggaaataataaacaagaatgtttcttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttggcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctatatgagagtcatcatactattcactgaaattgtctatatttttttaaatatttcataatttcacatatttaaataataagcctgagccaaaatggaaaccccaaagtgtcagacaggcccattcaccattaaaagacccacttctacacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcatgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacatacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagatctgatggttttataagcatctggcatttcccctgctggcactcatttactccttcctgccaccctgtgaagaggtgccttccaccatgattttaagtttcctaaggcctcccaagcaatgctgaactgtaagtcaattaaccctctttcctttataaattacccagtctctggtatttcttcatagcagtgtgaaaacagactaatatgggtattagcaaatgactgaactaagaaaccagcaaaagcagatttaattacttagttactttttgttttagtcatggttctccagagaacagaaccagtaggatgtgtatacatataaaaagaggttcattataaggaattggctcacctaagtctggagactggcaagtccaaaatctgcagggtgagccagcaggctggagaccctgagagccaatggtccagcttgagtctgaaggtagcctgctatagaaccaggaagatccaacgttacaggtgaagtccaaagacagtcttccagagaattctctcttctcagagaaggccagatcttttgtctatttaaaccttcaagtgattggatgaggcccacgcacattatggaggacaagctgctctagtcaatgtccacaaattgaaatgtgagtctcatccaaaatacccttgcagcaacacctagaataatgtctgactgaatgtctggatacctcgtggcccagccatattgacaaatgaaattaaccgttacaattttaatctgcatgtttctaataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaatacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtgtattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccgaggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactttaacacaagggctgacctcttcagtgacacagggtttacttgtatatgatacgcagatttcatttttgttccaaagagaattttgagcccatgagagatctagccaaattcgtttcactgcatatctaatgtgtctttatatttttccaaagccacgggacccgatgtgcaggagaagtttctgctgccgccaacaacaatatctgtggagttggagtagcatacaactccaaggttgcaggtaagccatccctgccaaacagaggcccccactaggtatcacactgatctcaaggctgactgtggcccagcaaaaaatcccactggtgcagaaaagctaggatccacagatttggcacaagtgaaaaaaatttttttcttttaacctgcataacaatatcaatagttttaaatttttaatttaagcataatataaattcaaaaaagttaacaaatcataaataagctaatgacttttcccaaactggccatacccatacagtgatcaggaaacaaaatgtaaccagcaccccaaacatgtccccttccagttactactctgacacccaagaataatcatgatcttgttttttaacagcaaaaaaaaaatggttattgccagtttttgaaatttatataaatagaattgtcagtcactactcttctgtgtcagtgtcaataacattttaatgagtctcaaatatagactatagaatacaaggtggtgtgtataaattatttgtaaacatactcagagctcttcaaaatgttttgcacaatggaactcatctttaaaaagagaaattctgcctagaacctttttcttacatttcattgggtaggatatttaagaatttcctattgatggagcctttagaaataagagtggcaagtcactggaaatttagaacccaatatccctcccctctcagaaaaaaaaagagagagagacacagacagagacagagactgagagattcataagctttcaacgagatgtctgagaatggagtggcaccagtctttttccaagttttgcatcaaattgattcttaatttattcaggctgagtcacccaaccttgtttttcttttttcttttcttttttgtttacaactgtcctgatattttcttttcctggcaatttaatggaaccataaacctactttctgctgacactccatttccatggaactaaataaagcaaaggtaacctatacaaacccactattaacctcttttcaacactgtttgctaagaggcttgcctgaactgggtgctgaatgtcacaaaagaatacatctggaggtttctaaaatgtaaatagaggaggcttagcccctgggtttcagctctctttactttgtgcacatccaaaatgctggcattaaaatgtcaggagccattatgagctcaggggaaagaatatcactcggttaatattttataagccaggctcagacctgggatggaatctaagggaggcgggttctctactcacaggacagaactggaagcaactgaaaaattcaaacctgaatttcttgttcacacacccaaggtaactggtttttggaacaaagtaaaatgaccacctgcaaaagttaaaagagttagggggagctcacagctttctggaggttcctgggagcttctttttccatctccttcttttccttttttcctcttctcttattatttgcactctgaaaacacctgagcattgagtgctcatcaaatgtatctaattctcctgctgtcttagtttgctctgcctaaaagcaaaacctgagacaaggattccgggcaagcagttaatgtgggaggtggtccccggaagccagagtgagggagttggggaagaagacaggaaaggaatggaggccaacgaagtgagtctcatggacaacaggggccccgtcctgcaggtaattctctgaggaagtgtggagaacacccctcagaattgaccccgctaatgtgaggaggctgcggcattaatctgccagttcccatctttcattgttcgggggtgccgtcgggcctgtccagcctgcccagctcgcttgaactgagtggagctccttgagcagaggacacccccaggcaaaaagccagggagcaggccagaggacccggtgggtgcagcagcctctgcctcgcctgctgaatgcagcctgacacctcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattacaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaagttaaaatgtggttgaatcttaacccagggattcaaaaaagaagagtggagattgtaaattgagtcctctgaacagaagagagcattgagcatctctgcatctacctgagttcctcttctgttcataaatttttctcatttttccatcaaggctcctgtctttttcttgttgatttgtaggcattcttggtgtgtcccaaaggttagcccctaacccattttaatcaatgcaaagatcttctccttcatttctcttcgcgtccgtcttcatttcaaactccgtgacatgtagacccgcacatacgggatgtcccaaaagtcatcctgcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccaaatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggctctacagttcctcactgttctggatttctgcagagactctcagagcagccctaagagggggccaggccaggtgggtttggtcctattcaccttcctttttaaaccaaagcacacagatttacacaccgggcttcgggatgagatcacctttgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgagcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcattgttagggatgtgaagacacagactcctagctcctttgatttctctctctctctctctctctctctctccccccacttccttccctcctcctcctcccccccttcctccctctctccctctctctcttcctcccctcctcctcccccccccttcctacttctctccctttcctctctctttccctctcctctccctctctctctaccttctctctcctacactctccctctctccctctcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatcttggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaagaatgctaactgataactgggtgtttgttgtcaaaaatggtgattacacttatgggttaatagtagaagatggataagcagagcctgttattcattcttctggacctgttatttgtgttggggagaaaatcaactaaataaggtaataatgccagatatttattcaccaaatatttgtcaagcttaaaataaataccaagcatcatgttgatcctcaaggacatggaagtgaacaaaatagacacatgccctatactcaaagaccatgccatctggtggtatatgaaacacgcaaataagtagttgcgatagaaggttaaaggtacacaagaagagggctatgagcactgaagaggaaagtgagatcctcgagtctcctgaggactgaaagtagtagtccctcaggaaagaaagcaatttcatgtccatttcagctgcctggcaaggacctgggtggcttttaattcgattgacgtgctcgccatgttagagagtgaggcttgtgaaatagtgtccttcaggcacaacatcctttggccaccggggacaaggaaggagttttggggcccagattttgactgtgcatggcccaaccccttcattccataatcgcagtgggtggaaagactcaggtcagcttcactagcactctaagctccatgccacagaattgtgaacccactgacccatccagatgacaaagcctggagagaggcatgtgaccccgtcagcgaagttttgagggtagtgatggagagacagcacacccaacccaatggcggctactgagatccccctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccgggggggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgcctgtaaaacggtgataatgaggggtcactatgatgtataaatgagataaagatgcaactgctcggcactgagaagtgcctgcaaagagtcagaatttgtcccagtctcgactgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctgcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgataccatgcccagctaactttttgtagacatgtttcaccatgttgcccaggctagtttcaaactccgggactcaagagatcctcccaccttggcctcccgaggtgggattacaagcatgcaccactgcacccggcctcttccaccccatttttctccatctcttcaccactcacagcctccaaaatcatcccttagcttctgtccctgtgtccgtgtttgtattcctagtgagtctaagcctctgaatgctaggcaatgtaaaatttgtaaaagaattgatgaaatgagctcagtctgattagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacattctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctgagtcagtgcttctcaaagtgtggccacagcccacctgggagagtgaaaaatgcaaaacctcagcgcctcctcccctcccacagatgccgcattttaacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggagggccttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccgggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaataaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttggttgttactttggtcctttggttgtggtccttctgtagcagccctggcaaactaatgcaccttccagtcttagaatggatcatcaaaaaggaggtttggcagtgcgggaatgacctgctcactgttcaaggtcaccttgatgtcacctggccctctgctttacagccaagatggtcaatagttgatccaattacgacttttttcttctagttcaggaccttgagaagtctccctccctcccttctctgatgtagcttcctcgaaggaatgagcgtgtgaaaatgctcacgatgcagtcctaggagagaaacatgtttccaagttagggagagtgctgtgctgaaatgctcccaataacgtcacactgggagcttgaaattcaacatggaaattgacgaacactaaaaataaagcccttttacgcccccttcagggagctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttgtttccccaaaatgacaagtttcccaaccagagtcctaagttaccccaagactgtggaggacaacttttctaagtcaaggaaagatctcacactttaaggaattcaccacttttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcatttaggatgaaatttttgatgcacagacagcctgtttccttattgcattattcattgtgtgactggagagaaattgttacacatccaagccccagaccaggtgacagcaggtgcccaggggaacagttggcagattccccctttcctcagcagacatggattttcactgagaggcactttttttgacacctgaggccaaaagagagtcgggaaggtaggagatgtgtgccctctgtccagactgacagtgcagatggtggcagcgctccacatccctgggtgcccctgtcattttccacggacttctgcacttctccactgcctctcgaagcaggatatttctctctcctccatctgtagcctccctggctgcaggtgaaaaggccctttcaagtgtgattgtcctgcaaagcatgccgagcccgctgaagcttaagagaaaaattgttatgactgatcttcagatgacagcaagtacatcttttagaaagtggagtgagtatgatgaaaaatacattatttcacatttgacttttccccaagaaatgggaataaatttccccaagcaatgggaataaatttccccaagcagtgggaataaatctttccttgtttcaaggtgacattttttggacaacattgtagcattttggaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgatggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagtttattgggaaggtgaagagaataccagtgatgaatgggaggtgtggcaggaaagagacagggccagttaagggtatgttatcctgccagtcatcgctgtcagcaactggagcttaatgccactgggaaacttcagaaaaccacaccaaaacttgagaacacaccccaaaggtatcccaccctgtgggaaaggagctggaataaaacccattgatgaggtttgttcccaaaaccttgtaaatgccccagtgctttcagcctgaggacagatgcacagagcagcctttcagcctcttgggaggaagcccttagacaaaaagatgcatatgctgacatttggaaactcccaggcacagggaattctaaagcccaagggatatgggctcacacacaactcccaaagtgcagcttaagcaaaacctaacctgagacttcgagtcatcactctctggataaataaagcactggcaaggtgatgtgtttactgttcaggaaaaggatgtagcccttgcaaagagggagctacaaaaaccagccattatgggacacagcatcttattttgctctgacaaccagaaggggaattcgggtgacgctagaaggtcttgaaagtgacaactgattcatgaacgtctttccacaacttgaggaaatgcagccacccagggcaaccctggcacaccttttgctggctctgatgactacatcccaacttcttcttaatcactcttcagagttgctgctggagggaatattttaggaatatttaaagacaaggctacaaaaattctctaaggtacagatgagacagcgcattgattgtttactccctaaggggctgcaaagggcaaagcacagaactcaggtcttcttccagctggaatgtatggacagggaccacttacaagaaaaccaccatccaggaaagcaggggacagagagctgcctggggagacagtgattaatcaggcatgggcgaggggaggccacagtgcctcctgctgaaatttaatcagagccacgggtcgtacaccatggcggcgagtgccagggcctctggcagacgatgaatgcctcctgccaaggagctctcacgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggcgctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagtgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatttttcatgaactacgagtgcagaaaggcaatattcataaatcaatacattgtttcatgtgcaatttaaaatgtgtttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtcattaaccctggtggctacccattggttagggtggagggactgactcactttagccacaagtttctcagagtgggatttccacctcctcaaatgtaggcaatgcgctggggacacagcaagccactgcaccagtctctagctggaatgtcaccttagctgacggtaagcaatttgtaacattctttttatattatgagcaaaataaaaaaattgcttgaatgtttcagaaattttgggcttgtgagaggctacttaaggccatgcccagcaagttccaactcactgctctcactgagcagggtttctcagcctgggcatatggacattctgggcaaaatactgttttgtcggtggtgaggaggttgtcctttgcatagaagtttagtagtctccctggcctttatggactagatgctagtaaaacacacatggttgtgatcaccaaaaatgtctccatcactgcatcctggagaaaaagtccacactagttgagaaccagggtggttaagtacactccatagtacctaggttaaaagtttccatttggtaaaaacttttgagaaacactgtaatcccactaaactccaaaagactggcagaattcaaagtggagttgcaccactcacttaatttcacctaaatgcacttgcctttttttttttttttttttcctttcacccaggctggagtgcagtggtgtgattatagctcactgcagactccagctcctcaaactcctgggctcctcccgagtagctaagactataggtgtgcctcaccacgccaagctaattttttcttttgtacagatgggggtgagtgggcctctcgctactttgcccaggctggtctcaaactcttggcctcaagtgctcctcctgcctcaaggctccacttcccagagcactgggattacaggcatgagccatcaggctggcctacttgcctcaggcagctgacagccattccactcactgagcatgagctgcaggattagggtggagaccccgccccccagcagacagccccacccacagtgctggctcttgggtcatggcctccctttgtccttcagctccagggccaccctctaatccatgggtgaattcccatttcccttttgggttttaggctttcctttaacacctattccctggataaaattccctctgttgacctgccaagtgtggcaatatttgcctggctgaatttcaattgatatattgtatatttattgggataatgttacatatatataaatatacatatatatatgtatgtatgtatatatatatatgtatatttgagactgagttttactcttgttgcccaggctggagtgcaatagcgcgatctcagctcaccgcaacctccgcctcctgggttcaagcaattctgactcagcctcccgagtagctgggactacaggcatgcaccaccacgctcagctaattttgtatttttaatagagacgaggtttctccatgttggtcaggctggtctcagactcccgacctcaggggatccacctgcctcagcctcccaaagtgctgggattacaggcgtgagccactgcacctggcacatttatatattaacatagggaaaattgacatctctgtgatcctgtctttctattcgagaatatggccaatatctttccatgggatcaaatcttcatcttcgtccctccttccatagagttcagagaggttcaaagccttatttagcacttccttagcttttttttttttaagtttgttgaatttcttcccttttttttttttttttttttttttttttttgtgacggagtctcactgtcgcctaggctggagtgcagtggcgcgatctcggctcactgcgggctccgccccctggggttcacgccattctcttgcctcagcctcccgagtagctgggactacaggcgcccgccacctcgcccggctaattttttgtatttttagtagagacggggtttcactgtgttagccaggatggtctcgatctcctgacctcgtgatccgcccacctcggcctcccaaagtgctgggattacaggcatgagacaccgcgcccggctcttcctaagtattttatcctttatgtggccagtgtaaatggggctgcctgtagggtggctgtgaagactgaataggataatatgtgaagtacttaacaagtccctggcatgtagtaagtgctatggaaatgcttgctgtgatagtcaacctttgttttctgcacttcttcctctaacgggttatggtttagatgtgagccatagttgttctgtctcgatttctgcctagctcctgttcaggtgaagctgagaggcagaaatggatcaagccttaagcagatgcccaagatcaaggcactggcaggttcagtgtcttgcaaaggctcactctctgcttctaagatggtgccttgttgctgtatctcatagaggggacaaacactgggtcttcccatggtggaagggccaaaaggggcctagctatttccctggagcccttttataagggcagtaatcccattcatgaggaccaaactctcatgacttaattacctcctaaaggtcccacctcttaagactatcatgttgtgtctcaggttctaatatatgaatttgggggggacatataagttcaaaccaaagtagggtggcatgccagcaacagccccatcccataaccagctctcagtcctcttatggaggtcccttccccactcatttctgcccccagaactagagaattttcctcactggcccatcttccccagaagccagagactttttggtgctaaaacccaatcaccagaagcaaggacacaattattattgcttcatgtgtcctatctagcttaagaaaacaaagtttaatattcctagaaaacgaagcattcttgtgggcaagtctcatggtttaaaacaaaattaacgtttgctgtttactgttcacggttcagaaacaggctgacaattgctctctgtgtaacagtgagctggctgcataacaaactgccccaaaactcagtagcttaaaataacaatcatttaattttgctcttgggtctacaggtcagctgcgttgttctgctgatctgcaccaggctaggctaatctcaggagagtgagttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaaggcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagtgattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccacaggtgaacactaagcagccccaggccccattgccttggggtaagaaagtgggaagcaagaaactaatggtccaatcctgggttgtttaggtagagaggaaaatactcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcattttcactaaaaaatgtctgatacataaagagatgtaagaatgagataataattacctctagagagttgttttttattttcctttccatacagttagacttttcattgtgagcatgtaccacctttctagcttttttaaaaagcagtttatttgtaaattttaagacagttcttccaattttcttacctcattatccccagcttaaattgtaaattcagttgacttttttagattgaattcttcctggaaaaaaaaagtttcccacaatgccctgccagaaggatatggtgtccaacccagtttaaaaagtgcacccagtctttaggttcaactgctgaagaagcccaacccctgggctggagacctcccctgccccctcgcagcccaggctgtgggtagcggcagcgtctcccctgctctccccagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggtgagcacgtccccttctgtccttgtttccttagggccactgcacctctgtgtcagggtgggatgctgggacactggcttgctcccctcctgtcccctccctcagagcctgaactaaggctctgaagggaagaccccttttctctatgcccagtcctgctttctaacaaagcacagacctcccatctgcgagctagtagcatgatcggtgaggactcctttctggatcgttttccatagattttcttgtttattgtttctggcttacaagtaatgatgaagtctggtttaccaatcagttgccccattccatcacttacaagaataactaactcattgtaagaaccaaggcatcacactgtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcatctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggacgcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcctgtgagtactataattttgctcaatagatgcccttaaacctccctggtaatttcttcctcaaaataataagctctcttgaggatcctacagacagaggaagaattcccgtcgtttatacatgattttaatgaacaccctggctctcacaaacattgaaaatgaggtttttcactttgtgaaagtcctttaaaaatctgtttaccagtctcccctctaaataagagttgtggaggtgatacccacatattgggttgtcttgactcaacacatctcagaatctctccgtggattttagatgtagagaaacatgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaatgaataaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgagaggccatgaatagtcagggccaatgaactctgctgtgcatttctaagtggcccatgtgcccaccagcacacgtgcgtgtgcatacacacacacacgcacacaccataaaaccacattcctgggagcacacaacacccagcagcacgtattagcaacttactcagatacccagtgaaggcacagagatatttctttcttcatcaaatttacccctctatcctctgtgtatccctgggctcttctactccagtgatattcacaatcagctacttgaagacaaatcaaattgccaggctggtgtttcagaacatgtggcaaacaaagtggtcccactcaagatttgttaatttgtgaagtggattcactttttaacactgaaacaagataggcaaagtcacgcagtgtagaccaagatatgggctttcctgggagaccttccaagctgaaggtaagaggagaccatctcctatgtcctcaccatcctatggagaggccacatattgctactgctggacacaccttggatttgagtagcagtggaggtacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaataaaaaaagaaagaaagaaaagaaagaaggaaaccagctgagtcagccatgttgaaggggttttccaaggagccccacccagtggcttctgcttatttctcattggctagaactgtcacatgaccaccgccacacttcaagggaggctgggaaatgtaattttatagctgaatgcattgctgttctgaataaaactgaagttttcttaataaggaaggagaaaagatagatatggagggaaatacaactgctaatgtcttctggcatctaagtggacaatcactcatctctggatctctattgtcttatcaacaaaaggtagcaagttagatcatcaataaggttccaatgacttcctggaatattttagctctgcttctgaaatattgtttttttagggaagttaatattttaattggatgtctggtgatttttaaggttgaatatgccttaaagctgaaaaacgttcatttacatacttttaaatattgaggtcaatacttaggaaatagtaatctaatttactttaacttctgatatatgtgatatatgttatcattaataataataaagtctttttattcagtgtccagcactgtgctaggtactttacatacataatttacatttacatcctgcaacaaacctataaggccttatgcccattttaaagatgtaaaggctagagctcgaattgttaaagtaacttatccgagttcacacagttggctttaagcattaggatgcctgttccactgggctctcggtggaacatagaaaaggccctgccactgtcttgcctgtggggctcaccactcatcctgccatggcaatgggttgcagtgaatgagttagctcttcctcaaacatgatgcacaaaatcaggtttcactttctttgagatgagattttccacaccacaactacaccagggagtcatgaaaactgaatttcctctcacgtccttataggacgtgagcaaacaaaggctatggagaaaataccagcttgactcacaaatgcattatttttctcagactggaaataatccaacctttgaaattattttttaatcctatcaaaatttagaggatagactcagaattttaaaaatgaaagaaaatgaatggatcttttacgactccaaacatctcttatgatgaagagaacgagacccagagaagtgaaacaacttgctccaggtcacacagtttacattgtcagataaagatcagatccaacaagtaaagggattaaaattctcctgttgacttctagaatttaccagatgttaggagaagtgattcctccaaccttaagactacagcatcatctttaaaacatttccattttcaatttctctaaagatgcatgtgctgactttaaattacttttgctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaagtcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgaacctggacatcatttttttaaccatccccaggtgattccaatgtgcagacaaggttgagaaccactgtcccagactaccaatgttctcaaacatcactgtacagaagaatcatttggattaaatgcaaattctcaggcccacaatctccaagatgctgattcaggacaggtggaaattcacatatgtcactaatggtcctgacacagggggattgaggatcacagtgagaactcctgactaggataacacagaggctccactgatgcctccctcagcatcctgagctcccccatcatgacagccctcacattttcaatactgagttgtccctctgtccccctaggctatcagctggtggggacagggacatccgtctgacatgcccagagttagcacgatgcctgaatgtggtagacactcaacagacatccatacaatcacttcattgcgcagtaccttctcatatatctgcatcttattttcccgactcatataaaacatttgagaacagggaagaacatgtcacatttcttgtcctacagtctccaaaacagtgacctgtatatcgcagatactccataaatttattttttaattatttaataactatcacctgtaattcttgggctgctatggtacaattaaagcaggttgatgaaataaatacctactttacagaatattgtagtctgtcaattcctaaatcattcagaagggatactagaaggaacctggttttactcttcagacatatgcaaatagcaggtcaaacagtgtcatagactcagttacactggagagtgaactatgctgtggtttatctcaaaagtgaaaagttccttgttctgaaacattatttctctctctctcatgctctctctctttctaaaatgcaccccatgagaataaatctgcagagaaacatttaagggagcccttctccaggcatcagaagtacagcccattttcatggcaaagatgagaaatgagaaacctgctagccagccctctggtcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcactcccagagattctgatttacttggtctgggatgaggccctaggcatgagatcttcaatgcccctaggagaaaattttcatgggcagtcccaacaacctgtgcgataacctggcccaaaaacaaatcatgatttgcaatttgaaaaacatagacaatgtgtagtaatagacactaatttccaaaaacaataacatttacaagaagactagtttattcactgaacaatgtgccaaggaccatcctggacactaaggatataaatatgctaaatataatttctctacccttgaagaactggtaccctccttttcaaaaatggaacacacccacatgccagttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctatcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagtaagtgggggtagtggtccctctgctgcatgtggaaagtgcccctgagatggctccatggcattggcataatatcacattccctcttcatgtttgggtcaactgtattttttgtttgtttgtttgtttttttgagacagggcctcactttgtcacccaggctggagtgcagtggcgtgatcacagctcactgcagccttgaacttctggtctcaataatcctcctgcctcagacttccaagtagctagggccacaggcatgcgccaccacaccctgctaattttttttattttttgtagagacaaagcctcactatgttgtccaagctggtctcaaactcctgggttcaagtgatccttctgccctggcctcccaaagtactgggattacaggtgtgagccacaatcctcggcctggatttgactcagggacaaccagtttccaagcagagctgcaggtttgcataaatccaggaggcaccatttacatagaacacagaacccctgcttttggttgtgagccttaactgtttcagtgatgtatgccattatttctaagggcacaaatcaaccactataaacatcacccagctcaataaggagaacatgactaacacccccaaaggccccctgccgtgaccactgccattaacatccccatgccagcgtagccatattcttacttctaactccatagcttaacttgcctgttccatacttactagaatcatacactatgtcctgttttacaactagattatttcgcttggagttatgtttgtgagatccagtcatgtttaatgtgtacttacagcttttctcattgctgaagagtgttccagtgtatgactataacacaattcgtttattcattctacctgtgggacaatctaaggacttgattttccgctgagtgaggtggattttgccacttggagggatttgtgtatggggttccctacacagaaaccacagcgttagtcaactgcacccacttcccttccaactgccccaccttggcaagtggattggtcagtaaggatacttcttaatttctctctgtcctccttgatgcattagtaaaatggagatagtaatttttattattatcactgaggtattatttacatgtcatcaaatacacagaacttaagtgtatcatttgagtgttgataaatgtatacaccctggtaactaccactgaatcaagagatgaggcattccatcaacccaggaagattcgtcatacctgcttccagctcgtccacacgctccacaggcaccctttgtttttgcttctctctctgtagattcgtttcaccagttttcagactggactgtgtccagtttctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttgtcagcacattaagtaaaaagctctagtggcaagtctaatggccacaataatttcagagcagcagtgatgactaattgctgctgcaggatccatgcagtggctgtggtgggacacgaaaatctgccagctctttgatgacaaagtccgaggaggagctaatgccactctgctttgtggcctgcattcataatcgaaagagaagaaaagtttctgttataatctagtgaaaattaaaatgtggaattttttccattgaaattattagaccccctgaattctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatatcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccataggccagcatcattccacaggccagcatcctgccgtagacaggcagcctaccataggtcagcatcctccacgggccagcgtcctgttgtagacaggcagcctaccataggccagcatcctccacgggccagcgtcctgttgtagacaggcagcctaccataggtcagcatcctcccacgggccagcgtcctgctgtagacaggcagcctaccataggtcagcatcctcccacgggccagcgtcctgctgtaggcgggcagcctaccataggtcagcatcctcccacaggccagcgtcctgctgtagacgggcagcctaccataggtcagctcctccacgggccagtgtcctcccgtagaagggtagcccactataggtgagcatcctcccatgggccagtgtcctcctgtagacgggcagcccaccataggtcagcaccctccatgggccagtgtcctgctgtagacaggcagcccaccataggtcagcatcctcccacagaccagcatcctgctatagacgggcagcccaccataggtcagcatcctcccaagggccagcatcctcccatggacaagcatcttcccatgagtgagcatcctcattgtttactcactgaacccctagaaagtggcaccaagtggattactgccaagctgagtattttttttccatgaaacagtccatgatttaagaaggcctcactctaatcagcaccacatggaaaaaataaagcttcagcccaagccctataataatctaaaaacacagagctgcccaagtcccaagtgatgttacaaatgtcctataataaaaatagctactctgcacagttcctcaccattttccaaagcttctgtgtccacacatcatttctgttcactcccgtatccctcctcttggcaggacagacttctctgagctctaaacaagttgattgacacagtcaagcccacagaggctgtaaatgtgagactggaagtcacttttattgagtgccaactgcatgctatgtgctttcatacacgtaagcttcacagccaccctattgttgagggtgtgccttatactcgcacagtcgaggtgggagcaggggtgaatattttgcagccttaacaacaaactggtcccatgctgggtgtcagggagaaacaccaactaggtgtggtatatgctaggcccatttacattactgtatttaatccttgtaagcccaggaggtgtgtcctatcattattactttttatacacaaggaagctgagatccagaaaggataaaaaaaaaaaaatgtgctcagagtcacaaagggcagagcaggacttgaagcaaagcccatctaaacccaaaccccaggctcttttcactacatgaccttgaccttaatcagctcccgtgcatacaggtcctacattaggccgtatgtgagagcagccctactgtgagctcacagtgccattactgatgacaggaggttgggaaaggtcaagggcatgctaaatgtcatccagctactaagcagccaaactgggatctgagcccagtcactttgacccctcacggtgggctctcaggtatctcagtgactccccctggagaaggtgaggcttgggtaggggagggagtttcagtaaacattcccctggggattctgaaacacccacctagtgggtgctcccatctcccaaaccccatcactggcattccagaggcccttttcactggtctacaatgccaaggtctgccgtgtcttttgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcagccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaactttatgcaagatcaatgcagtgttttcaatgaagagaaatgggaaagcactatatttcagcactaactcagttggggcctcccaatggactgggccctcgtctgtcatattcatggtgtaaccctagtgcctacaatagtgctgggcatatagtagacaggtgataaatattttttaaatgaatgagggaatgaaaatattcagccagcagcagccggacacaagggaaatgtctgactgctggcaataggaccggcgggccagcaaggcaaatgtgggaaggaggctctgccttggttggaagggctctgcctcctctcagtgccctccggtccctcgtccacccccacaccagaacttgttctcagatgcagatgagttaggtctagggcaaatacacttgttgaagaatgcagaggctccacagggagatttggagagcagccccagggctggctgtgccgcttgacagaggaggcccttgtgaccacgaagcacactcgaggagcggtggggtacaggaatcaacagccgtggcaatcgccactctccataatgtgcagggctgcacagaaacagcttccaaggtggagtgagtggtgattgtcaggtttgtgggtttccttggcattaatcttcccggagatggagtcaatttgaaaagcaattttctaaagaggctttatcaagagagtcagtgaaggatgctcagctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatgcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccgtggtgctaaaaaagccagactcctcagccaacgtgaaaagagttgttctagtgctgggatgatctcttatgatggaaggagagaaatacagattggaccaaacctgagatgaccttcaggcacaccatggctaagggggtttcagtagatggtgacagtgcctcttgttcaggtccccttcactgggctatgcaccaccccagctactgtgggcattggctgctaactgtggtcttctgcctgtgtctctgaagaatcaccctcaggggctatggaaacctggctgaaataagaatacataaaacccatgctcctgcctccaagcaggacaactgtgtggtggcgttgatgctccaaagccagcatggcctgtgacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcggtggcctgtgttctagtttccccttctcagcctcgctgtcattttccctcccttagtcttagtcgctaaggccttccccatgagcgtggggctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgaggtgactgagcccacagatggaatgaggcccatattctgtatcaccaacgatgacataaatatagtcaatagtcctcagacactgtgcagagggatgtggtaatcagtttccaattgctcttctccagagacagataacacctgttttaggttgggttgctcggaagcagagcctgagattgggtttgagtacatgtgctttattgagggagggcttttcagggagaactgtaggagagtgagggatttgggaggggcagaagtagccaagaaaggatgtggaaccaggtatgtgcatgtggcctgacccaccgggggctttggagcatcaacgccaccacacagttgtcccgcttgggggcaggagcattggttttatgtattcttatttcagccaggtttccatagctcctgagggtgattcttcagagacacaagcagaagaccacagttagcagccaatgtccacagtagctggggtggtgcacagcccagggaaggggatctgaatgaggcactatcactatctaccaaaacacccttagctgtggtatgcctgaaggtcatctcaggtttagtctaatccatatttctctccttccatcataagaagtcatctcagcactagaacaactcttttcacgtagcgaaggaccttatagttaattcacagaaacttcatgtatggtgggctgtggtcttatttctagcaaaagtggctgtctcatctctgattcttagccaattgaagaaatattttcagttttccacaaggcaagcaatgccatttttctgccagagtttctacaaattgacttgtaaagggtctgtcactatgactccagtccacaagggtcctgggtgcaaattgggacagaaaacaaattttcttagaattcagctggtgttctgaattcttaagataatagtgaccactgcacttgacaaatgattagtgatgttttataatatctataatgattgccactcagttacagtctttggttgttggcttgtgaatttccttcttgaaacttttcaagaagccctagactacaggaaagaaaagagagctcaaattcaacacagaactcagagccagggtctctcttcctgttatcattctctgcttcctgcaactgtgcttctcaaagactcccaaagcccctctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcctgtgagccgggaaaaaactgaatgcccttgaaacagaaggccaagagactctctgcctgttgttgttgttcttatcagattcaaattcaacatacataaacaatttagacccgcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctggtctagacatttgtaaatatactatgtatatgagtatacatgtatatacacatatagacacgttatatatatgtgcatatataatgtatatgtaggataatttatcttgccagcaactgttcagggcaggaattaatagctcagatcatgcaaatacttgcccacaactggactcgtactctgagactctttgtgctaccctacacagctgtccactgctgggctagagcccaatctttagttattcatcaccttacctgttttgtttctgatcttgttctgaataaatagcaccatctttgagaaatccaggttatggccctcattaccccgacccgcaaagttggcttaatgcctgctttccaccaaatggatggtttccccagatcctgggaacagaaagaccaaccccaccatcactggatccccatagctgatggacactccatacatgattcagcatcagtatccgggggtgggagaggggaatacagcagtactccatgaaaccgtttaagtctatatttgtaaagttcctccagagagtattaatgaactgcactgtatgtttcagcaagccctcccaggttcatggccttggttcctagggcaatgcagaaccaaggcttgactccaactgggcacatgaccactgtctttttgtaaatgtgctttacaagatgtgtgtttaaaaatattttacttatactccaaaataaaagccatattgaggaaggatatttgcataggcaatgggccagtacatgtgccaagcattgtgcctggtattttattttattttattttatttatttatttatttatttttcagcacaggaagataatatttattatattttaactagaaacagaacagatagcaagttcacgaggtatgaatatttttttcttaaatcaggcttaaacaacaataataaaaaacaagtctgcatatatatgttggtcactattataatcttcaagggcacaaaagccagcagcataaagaaacatgaataatgactgagaagttttgatgtgccaaaaacaaagatcactgcgttgaactcctttattttgttaatattattattaaacatttaacaggtattaattattgttatttggcaaaatatccaacatgcacatggtattcctacaagaatcttgccttaatattgttaatattaacactaagtttattcctctccaaaattcaatgagttatgattccactctctgtaagtgttagtgttagtggtaatatgcaaaactgattttgtgtgcagggttaagtagcagattgacttcgcatttggtggccagctgtgtaccctaatttttatctattttcttaataaatttaattacatttcataagccctgagataacctgctaatgattgtatacttttaatctatactttattccactcaatttgaaccccacataataagtcttcaaaattatttacagatggttgtaattaaagcaatgacaaaatttactacttgtatagataagactgataataaggcctttaactaagagttgcatattttacatgcacttttaacttgctaggagcaactcttaaaattacatctatcattctgtcagaaagcagttaagtgcttttcattttgcttacttctatatgtgtaaccagactcacttttttcctcccgtgtaaaacaactgttttttttccttccccaaatattaatacttgtcttccaactgaacaattgctaaaaggaacttagcatttacacagcacattgataactatagtgctcagcagagacatatgcccataataggcatctgataaatgtttgttccacatggaatgaattgtaaggcagctgtttgagtcatatactgttcatcatatactgcaactaattttgtttaactaggaaattcagtttaccagatttaattcaccctcaagtataaatccaaaaactttaaattaaaaaaaatcgatttactaatcctcagaaaaagtaaacaagttaatcatagttgttactatgctattagttgatagaaaatttttaaaaattactttccactaaatattgtgtacaactaagtgaggggaagaaagttttaaaaaatgaaaagatattagctaattctcatcattttctccacatttatccttgcagcttatttgttcatatatttattcctgttaacttctctagctgaaagagaattttattatctgaatggagttccccatcaccttacgtacaaaatattagtgaaaagctagtgtaaatgtaagattgtattttcatgtcatgccatatttctgcatttattttttgctagcattaaatttttcgtatttaaatgatgctgtatagaatatgagataatctgccaattgctatgatattgcttgcttacaatattcagtttttgttgatagctttaaagtatattgcacacttgtcatctagcacactaataaataactatttttgaaaggatacactgacaaattcttaagttaatggctttaacccaacatttttagtcagttaaagaacagcaatggcaaaaacattgacaatacagttcatggtccagttctcccatcttacggtacaggttccatcagatgtggtatcccaaaaacaggagctgctgtgcgaaagccatatgcgctcttctggaccactgcacatttcacaatacatttataagcttttcccagcttaggcagatgtgttaacgataattccactatgcttgcggtccactggttgatgttgttgtaattataatcttcaccacctaaaaccccgtctgcacattctttgacaatattgtgggcttcctcagcattgaggccaacctcgtcgcagtggcgatggtactcctccatggtagcgcctgttctccctgggggcggagctacgcctgtgcctggtatttcatacatggtcttatttaaccacacaagaatcatacggccgggcgcggtggctcacgcctgtaatctcagcactttgggaggccgaggcaggcggatcacaaggtcaggagatcgagaccatcatggctaacacggtgaaactccgtctttactaaaaatataaataattacccgggcacagtggagggcgcctgtagtcccagctactcgagaggctgaggcaggaatggcgtgaacccgggaggcggagcttgcagtgagccgagatggcgccactgcactccagcctgggcgacagagcaagactccgtctcaaaaaaaaaaaaaaaaaaaaaaaaagaactatccacaatgacagtgaaacttcgagtgcttaaataacctgcccaagctctcatgagcagtaaacatagaagcagaattctaatccaaatgggtttattctcaaagtctggagtcttgatgttacaccacgcaatcctcaaatgcggtttccttttttccttctttctactgcaagaacctttgagcttctcccactccaagaaggccatctccagaaaggagattgcctgtaaggacagcctagagagtacttgggcttaacctcgctccaactctcgccaaagactcccccaaagtctcctgatcattcattggactgcctttcactggaattaatttacccattttcagcttttctttttttttttttttttttttttgaggcagagtctcgctctgtcacccaggctggagtgcagtggcgcgatctcggctcactgcaagctccgcctcccgggttcaagccattttcccgcctcagcctcccaagtagctgggactacaggcgcccaccaccaagcccggctaatttttcgtatttttagtagagacagggtttcgccatgttagccatgatggtctcgatctcctgacctcatgatccgcccgcctcggcctcccaaagtgctgggattacaggcgtgagccactgcgcccggcccagcttttcttaatggtagtaatggcagtcatattagcaacagcttctatttatcaaagcacttagcactttgaaagaaagacattatgagttcctgcctcagtctgggttgtcccagaagtccaacctgagacaagacttgggtgctgacagttttttgagaaatgatcccaggtaacacaagtgaggaattggagatgtaaaataaggaaggggagaaaagccaatgaagagtgcattaatgagcgagttgccaccgtgggcagctgagctcagtcccactagggacactgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaa

SEQ ID NO: 168 - DNA, 6159 bp, Homo sapiens
ctcgcttttcttgcaatattttataccttttcaattcatagaattactcaagaaaactacctcagttggttgctactttttgttgattccttttaccagacatgactaagtttctttttcatcagtagatttctgggctcctatattcactagagattgcaactcctggatttctcttacactagaatcctatttcgagccatatgggagattctgaattccagaacaaaagaattttgtaatttaaaattcgtgattgctcaatggaatcattttaattgttacttcatttctgtcgttatttaaaacttaagtggagagttttctcagggataagaaaaccacaatcaaggtcatacaaaacttttagaggcagtcagtctgctaagaaggctccagcaagagaaacgggatcttctgtttcaacaatcattacttaagaaaaaattaagaaaatgaaataagttttgcagaataactgtgaaatttttattcatgaaatatgtacttacactttgggccacgtgatgtcactctttgccgcgatgttctctctgaatccagacaaatacagcccttttcccatgggaaagaggctcaattctttttcactctctctgtgctgaacgatggcgaacacagcagaatgggactgacgaaatcagatgatttcttctaatttggaggcaattttcactaattagaagaagactgagtatttgaaatgttatactcaagtcgaggagatccagagggtcagcctctactgctctcgcttctgatcctcgcaatgtgggtggtggggagcggccagctccactactccgtcccggaggaagccgaacacggcaccttcgtgggccgcatcgcgcaggacctggggctggagctggcggagctggtgccgcgcctgttccagttggattccaaaggccgcggggaccttctggaggtaaatctgcagaatggcattttgtttgtgaattctcggatcgaccgcgaggagctgtgcgggcggagcgcggagtgcagcatccacctggaggtgatcgtagacaggccgctgcaggttttccatgtggacgtggaggtgaaggacattaacgacaaccctccagtgttcccagcgacacaaaagaatctgttcatcgcggaatccaggccgcttgactctcggtttccactagagggcgcgtccgatgcagatatcggggagaacgccctgctcacttacagactgagccccaatgagtatttcttcctggacgtgccaaccagcaaccagcaggtaaaacctcttggacttgtattacggaaacttttagacagagaagaaactccggagcttcatttattgctcacggccaccgatggaggcaaacccgagctgactggcaccgttcaattactcatcacggtactggacaacaatgacaatgccccagtgttcgacagaaccctgtatacggtgaaattaccagaaaacgtttctatcggaacgctggtgattcaccccaatgcctcagatttagacgaaggcttgaatggggatattatttactccttctccagtgatgtttctccagatataaaatccaagttccacatggaccccttaagtggggcaatcacagtgataggacatatggattttgaagaaagtagagcacacaagatcccagtcgaggctgtcgataaaggcttcccacccctggctggtcattgtacacttcttgtggaagttgtggatgtaaatgacaatgctccacagttgactatcaaaacgctctcggttcctgtaaaagaggacgcacaactggggacagttattgccctgattagtgtgatcgacctagacgcagatgccaacgggcaggttacctgctccctgacgccccacgtccccttcaagctggtgtccacctacaagaattactactcgttggtgctggacagagctctggaccgcgagagtgtgtccgcctacgagctggtggttaccgcgcgggacgggggctcgccttcactgtgggccacggccagggtgtctgtggaggtggccgacgtgaacgacaacgcaccagcgttcgcgcagtccgagtacacggtgttcgtgaaggagaacaacccgccgggctgccacatcttcacggtgtctgcgcgggacgctgacgcgcaggagaacgccctggtgtcctactcgctggtggagcggcggttgggcgagcgctcgctgtcgagctacgtgtcagtgcacgcggagagcggcaaggtgtacgcgctgcagccgttggaccacgaggagctggagctgctacagttccaggtgagcgcgcgcgacgcgggcgtgccgcctctgggcagcaacgtgacgctgcaggtgttcgtgctggacgagaacgacaatgcgccggcgctgctgacacctcggatgaggggcactgacggcgcagtgagcgagatggtgctgcggtcggtgggcgccggcgtagtggtggggaaggtgcgcgcagtggacgccgactcgggctacaacgcgtggctttcatacgagctgcagccagaaacggccagcgcgagcatcccgttccgcgtggggctgtacacgggcgagatcagcacaacgcgtgccctggacgaaacggacgcaccgcgccagcgcctactggtgctggtgaaagaccacggggagccagcgctgacggccacggccactgtgctggtgtcgctggtggagagcggccaggcgccaaagtcatcgtcgcgggcgtcagtgggtgccacgggccccgaggtgacgctggtggatgtcaacgtgtacctgatcatcgccatctgcgcggtgtctagcctgttggttctcacgctgctgctgtacactgtgctgcggtgctcggcgatgcccaccgagggcgagtgcgcgcctggcaagccgacgctggtgtgttctagcgcggtggggagttggtcgtactcgcagcagaggaggcagagggtgtgctctggcgagggtaagcagaagaccgacctcatggccttcagcccgggcctttctccttgtgctggatctacagagcgaacgggagaaccctctgcttcctcagattcaactgggaaggtgggtttttctagcattttatttatttatataattttttttcttgaaagatattatcgattactcccaggggccgttcaaatagttttattcatttttctagaaatccagcagattttttttctgataaagtaaaccccttaacattggagccgactttgtcttgacttctagtgagaattataaactgtatattaaatagatattttttgggtgctgaatcaattttatttaaatttgtgattaaagtgacattgaatttctgatgctatgctgccataacacttgaaaaccaatttagttgttagtcattcattaaacattaacatcactatcatttatttattgctaaatgatgcatagtattttagtctacttgtattgtttataagaaacccaagcaaaaatatatagcaattgttaccttgttaagtttgtagttctctacatttctctggatggagactgtgaacatctgattgttcagcaaccttcagtatctattattttaataagaaagaaacttcccctaaactttagaaaacagttgctccactttaggaatcaaattatgtcaataaatgttataaacacagccttcatttcaacttatataaaatatgttttaaaatgcctgacaatgtagataattcaagaaatgttgactgaaattttgtctacacttagaacattttttgaaattcagtttacagaaattggagaaaatgctttttaaacaagtgtttcctttcttcaagaagatattctccttttaattgaaattttctccattcagtgataaaatgatcagccatgtgaagattcgaaacttcgagttcttttgaaattcagagtctgtaacttaaaacattacccttatgaatttagatgagaattcacttgttctgtcagtaatccataagacagaaatctgtttttttaaaaatatctttttctcctctcagctcatacataacacaaggcagaaatctggatatgagatttgcctctttaatgtcactacatgttatgtttcctgaattgtagtatgtgactttcaaaatggtggttttccacactctacctttagtgcaagctatttgtttgttttctaatttatagttttaaaaacttcgcttattgagtttttgttatgtggtttatatttttctttctctttcagctattttatttaatattgtgtcagatattttacaaggtatgacctaattaaaaactcagtagagaaagatcagaatggccttgagaatagagccacaaaaataactatgaaaatgccagtaacgtttatttaaaacaaaatattttaatttttaaattttcccttaaaacacacttttggaatatgctacaatattacatgttttttgtctttttatttttctgagacggagtcgttttctgccacccaggctggagtacagtggcatgatcttggctcactgcaacgtctgcctcctgggttcaagcaattctcctgcctcagcctcctgagtagctgggattataggcacatgccaccgcgcccagctaatttttgtatttttagtagagatggggtttcatcatgttggccaggttggtctcgaactcctgaccttgtgatgctcccacctcggcctcccaaagtgctgggattaaagctgtgagccactgtgccaaggcttttttattttttttttttgtcattttctttcaaaacttgagtggtctctgagctcctgtcattaaacctatctatatctgtctatcagcacaactcaccttgaatatagtcttatactttcaagtatctttgtctttgcacgtttttcaagtttcatgtgccatttaaacttggacccaggtatctgattatttgatgtgaatagagggatgctacagatgtcatttgtctcccgccctaagtcctccagtctccttagagctagtacttactaagcatttactatgtcatcaataatcataaaacgtatttttttttttgagtcagagtctcgctctgttgcccaggctggagtgcagtggtgccatcttggctcactccaagctccccctcccgtgttcacgccattctcctgcctcagcctcccgagtagctgggactacaggcgcctgccaccatgcccgcctaatttttttgtatttttagtagagatggggtttcaccgtgttagtcaggatggtctcgatctcctgacctcatgatcctcccgcctcagcctcccaaaatgctgggattacaggcgtgagccaccgcgcctggcctaaaatgtgttctttattattgacggctgtattgatgggattggtaatttagtccttcatattaatctctattctctctcagagtacaagctctcatcatatgcaaattctcagaagggctgtgaacaccttagtaataaatttatcttttgaggtcattagcaaacatgaactcacagggatccagagatggtaaaattcaaaacagcctgtcaagttcaaaacagagaggtgaaagcagaagagacactttcctattttgcctaataggtctccttatatgcatctgtagttaacattcctcaattcaagttagaatcatgaaacaataatgaagctcctcctatgtctcttttcaagttgtaattactatataggaaaaactaagttgtcacccaatatcttagacactttgagagcaaagggggtgctgtaaataagtatacaagatcacagacctaaattgagcctgttccagacaaattggggcctatggtcaacctatccttagacctgctaacgcattagcattagcagcacctaagtcctcattgaatgttctggttcaaggctccacctcagaaattctgaaatgggtagtaagagcaaattttcattttaaagcacacctgagatgattctcatacaaccgaaattttagatccatagccctatttgatacttgacagtgcaagtttctgtaatttaaaaagatgtggtggcctgacacctgcaatcccaacattttggga

SEQ ID NO: 169 - DNA, 333178 bp, Homo sapiens
agtgtgctctgcctccgaggaaaagctgccaaaattttctcctgctgcaattcaagttggctgggggccggtagtgagatctagggctacttcaacaaaactttgctgcccttcctgctcctcttgtcttcttttctcctgataccttttgatgctctgcacatgttatttgcatagcaaaggcactaagctttccaggaagagagggcaccacttccacccccaataagtcttttttcccgtcttttctttcttttcctttccttttttggggggtggggagggagagaaagggggtttgcaaaggcagcatctcagagtgatagcctagatgtattgaaggcatctcttattctgccaaatcggaaagtcagttctctaaagcccgggttagccagaccatagggttttattctggctgcagaataactggctggtgtggctttgcaaaggggggcaaaaaataaaaaaataaaaaaaattaaaaaaagttagagaggagagggagtacgtgagtcgtccagtgcaatctctattgtctgaaacttactttttatcagaatttgaagatgaaaacggtaaggaagacttaacaatattcaatggagctttttttttttaaaccaacaacttgtgctttgcttgtcttccgaataacgcttagaaaactttttttctgtgtgtgtgtttttttttttttttttaatggcaatgagtgagcttgactgaactcattttacaaatagatatctttttaactccagacttgtcgggggttgtagaattctgggacttgcagttattttatgatgcaaaaaaaatacgtttattttatgaatatacaatacatgttttgtgaagtggacttgattatgattattgtaatcttttaactgatcaccaaatagtaatccggaaggtaataatgatgtgtgtgttttaaattgatttccagttttcttacagaaaagtcttatgcattttgtagtttcatgtcagtgtcgttaagtcttcagacaagtgcatattttatgcctgggctcagagggtagcattaatgtgctagctgtagccccgatgctctaggacatgttaagctcttaataggctaatcaaagagatggaaacgtgtgtttttgatttacttttggccacttgggacgtgctagactcataaccctccggagccttgtttatcggggtaggtctgtatatatggtgtatgggaccaaagttcagggattgaggagggagagtgagagtgcaggaatggggtattgggaagcctctttctgataatatgtgctacaattcctgtctttgatgctttctttccctgtactagaggaaaagtgagcgagagattgagaaagcgcactgagagggaacaagagagtgagtttcttactcttgtttttatttgagctgccggtgcaacgcgtttgggccagatgccaactgtctgggtcacacgcgttttatccaaatagatttagcgctgctgtctggaaatgggctgctgaatgttaactttaggatcaactcaaccagggcagctcagactgttaccctctgtctgggcgaagtggaatggtgggggcggggggaggtgagggtgtgcagagcagagagaaaaagggaaactgaaccattgcttggaactttaaaagagacacttgagtgtgattttcaacatgttctttttatgttcaagtgtcgtggactaattttctgttcttttttctttctttttagtttctgttgattagactgaaatgtttagatgtggggatgacagttttcagaattcatgacaggaaaagaaacgtaacacaaaattggtgtagttgaaagaaattaagaaaattaattttggagataattgttttcttgtgttgcagcaaagtggtaactgcagtctggtttatgttaattctgtgcttaaatgtgatcgttagtgttttgaatttttgaagaatagcatttagaggcaaatacgttgatttcaaacaaatcaaattcattcatttgccacagctgcaaatgaagtctgtgtagtggtcttaatatttttgtgattcccaagaagaaaaacttctagcctgaagactgaaaatactgtaatactccttatgtctggtcccaatacctgtaagattaattcctactcttgtctactcttagcacttcctctttctttccttagtaatcactagtagtagtaactaggatgggtctttatgccaaattttatcaagtttgtgactttagtgagtgaatgaagggagttaccatattaagagatagttaacagcatatttggaatatgtgttgggggtagtggggagaaaaagaggggaagaggtggatagctctcttgcttctgccaaaaaacatggttgattatcaagctaagctcaagagaaaaaatttataatacagaaaatgtgtatttacttgctatctggaaaaaagtgtgagactacatgtaatttagggcttgagttttataaatcatggtttgtatttttgcttttagctcatttgcttgatagatatgttttgggtaatttatgtgtttagtttcacctttccttggaaaccaatctcacaaattttataaatgatctagaaacctttatacttagagcctaattgtgtccttagcatacagtaggtgataataaatgtgagagaataaatggaaatgaaagaagttaattttcatatgtaaaaattaaacacctgaaaggagcatggtattgttgtttcttccatggagaccaaatcagccttaaataaataaccagagttaagatggatgaaagaagttgagaagaacattatacacattctttagcttcataataatagttcacaagaggaaattattaccttggctactccccgatcacttgagtgggaagtaaagatgatagaggaaaaaagacaagtaataccctccaatcagggcagactactgaggaaatcactatagtgcaagttgtctcatcatttttcttcttaggtagtgtagctttgatccatggaagcaggtaaatgatcccttaactttactgcctggtgcatttgtgttagggagaaaagcatatgtgaaatcaaagtgaaatggacgttttggttctgttttcaaatttaaagtagttataagtatcattatcatgaccaaagttcttaactccttgctgtaaaagacaatataactagttgattgactccatcatcatatctattatttcacatttttgagggaaagaggaacatgaaactatttttgaaggaagggctttgaaaagtgatgttagataatgaaggaaggagggctaatattatttagcttaaagtacagagacactttacgtcatatgtaatctaatctcttaacaagtctttgtgagatagacatcaatatcatggttttatagattagaaagcagatgcagagaggttaagtaactgggggtcaggccaggactcaaagcctttgtgctttccacaacataatgatgtttctgctatacaatttaaaaggtcaatgcattgtgatttttggacaactgtttggtatttcaatgttagtctgaactttggaaactatatctgaaaagtcacagcctctacatatttatggtgtccagattaacctccccaccaggtgtcagaaagtgggttaactcattcacttttattgtgtaggtgactaagagcagttagatttgttagttgtgttgattttagttaaattccttttttgtttgtttggttttttttttgagacggagcctcgctctgtcacccaggctgcagtgcagtggcgtgatcttggctcactgcagcctccacctcccatgatcaggtgattctcttgcctcagccccctgagtagctgggattacaggtgcgcaccaccacgcctggctaattttgtatttttagtagagacaagattttgaaatgttggccaggctggtctcaaactcctgacctcaggtgatctgcccatctcagcctctcaaagtgctgggattacaggtatgagccaccatgcctggccagttttagttgaattctatctagactcatttacttaatgttaagtttcttcactgagcactggaggccaaaaaaaaaaaaaatgtggggagggagcaagggagtgataaaggagaaagaaactcatgtgccagctattataactagtgttggaactaagactataactggtttgtttaacttcaaagctcctgctttttcaactatgcaccaatgccttttttactgcaaatccttaaatcatatagtagtctacttctggccaaataggtattacttttttttctcaatgctactggcttagttaacttgagcatttacaggagagtaggtaagagtgaaggttatgaaactgtaacaatttacaaaaagagcaggacatttctcaagagggaaaaatagttgctccctaaatccagtcaactatattgtaagtttctcagtagtttcaaaacctagaaaaataggagaaaaagggatgaatgattcaatcaaatctatctccattgctagaaaattaactcaaatgtgttaagtatatgttttttaaaggaagattataatctaaagtatatgagggactaatttaatgtcagatgttattactcaaaacactccagtgatctaaaaaaattaaaacaatgaaaatgaatgttgttcaaaaggtgacaattatactttaatattacatgggaaggtttagagtatggaatctgtatataagtaggttggaaaccaagataatggaattcttcttattgccgttattgaataatggtataacttaatctctctataaatttttacctgagaaaggatgcctgctatcttgcctaaattagtgtagaagtaatttcaagaagaaacaatgactgtatgtgaagttgttaaaaactattcacattaactaaccaataccacttataaatatatcgactgggcgcagtggctcacgcctggaatcccagcactttgggaggctgaggctggcggatcaggatgtcaggagatcgagaccatcctggctaacacggtgaaaccccatctctactaaaaaaaaatacagaaaaatcagctgggcatggtggcacgcatctgtaatcccagctactcaggaggctgaggcaggagaatcacttgaacccgggaggtggaggttgcagtgagctgagatcgtgccactgcactccagcatgggcgacaagagcaagactcagtctcaaaaaaaaaaaaatcttctttgacattggttgttattaactactgttgactgtttaaatttgagtgccttaaactggaagtgtgatataatacaaagaatttagactttagaaccagacagccttgtgtgaatctgggctctattgttttatacctatctgaccagtgagttcagcttctttatttgtgaattggtggctgtattagttatcaattgctgtgtaacaaattaccacaaacttagtgagttaaaacaatacacatttattatcacacagtttctctgggtcaggaatctaggggttatgtcctcagctttagggtatctcatgagccacaaagtgttggcaaggactagggtctttacagaaggcttgactggggaaaaacctgtttctaagctcacctattactgaacaggatttagtttcttgcatgctgttggactgagggccttagttccttgttagttatatcagaggctgctctcagtttcttcaatgtgggcctcaacaaatgacagcttgcttgcttcatctaaaccaattagggaaagatgtggctagcagatggaagtcagaatcttttgtatgtaataacgaaagtgacatcccctcagtgttgaggtattctattggttagaatcaaattaagaggaggggagcaagggaatggatatgaggaagccagattattgggctcatcagagtctacactgccacaggggcagagtatatttacttcacaagatggttttggagattaaaagaagcaatatgtattaaagttttttatttttggtctgatcttaaactacctttctggttattacctgttagtttttttgcacaggaacaaaatttgctattgctattattactaatattgtttactatttcccatttttttctggttatctagactttgtggaatgcatttcttctatttgtaatgattacctccagcaatttgacttgtaaaattgtattcgtcttccgggatctatctgaaatgctttttccataaacattccttgattcattcttctctgacccagaagtcatctccctcatctgatctcctgcaacaactttgcacgaccttattacggcatttgtcagtctgccttacatttttccttgttacttagattatgagctctccaagggcaaggattgaatcttaatcttttctgtttcccttaatccttttctgtattctgatgttgttataacatcatcttttaaacatagtaggacaatatttgttgattaatgaattagcttttccaaggcttagcagtttaataacttgtagagacaaatgtaagggatttaaatggctgttgttgttttatatgttgtatataccaatatttctatcaccgtagggaatgaagtgtttcacataagttaattttacagttaactacaaatactttttatatgcctaaagtgattttattttaaccactattcatttattcattcttttactcatccatttttttcaaccaacaaatatatagtaagaatttattatgtgaaaatttcatatattagggatttggaatgaaaatctttctaatctcttttgtgtactttcctaacttactaacagtaacttaccttattaaacgcatttatcttcttattttggactcaggcatagtgttatgagtatcagatattgaactatataacacagttatacatacaataggaactgttaaactatgtaagacccatttgcctctaccccaaactatattactttggggttctaaaactacattttcgttttttatccttttttttttttttttttttggtcacagtttggctgtttgtggctagtttttagctcttagttattttcttcttctgatctgctgtatgcggggaaaccaggcagccaaatatactattctgtatcaagtgtgaatggagactctgagtgaggttgttagttgcatgtaaagtacatgagctaggacttgaaatctgttgtaatacttgaaatgaagttttaaaattttcttttaagttacatttcagagagttgaaattgactcacgagttgccttataagtcacataagacttccgagtaaagtcaagggttatagtacatacagttcaactttttagaagtttagcttctgatactgtcttagtattcacagatggctgctaaatgtcactatttgtagatctactttgtcagaaaaaaaaatgataggtgccttataaagcaacacaacaatatctggatatgagtgtgtttaaaaggcatgttatggaatgggattacatattgtttgtcacatataatgaactgaagtagtgaagtcagccgattttattttatcaaaaggaagttaactcattgcccatcattgttatcttcaaagtttttaaaaaagaattatgatttctctttagattccttatttgattattaagtaactctggcattatgctgataaccattttggtctctaattctgtgtctaatcttgtgaatgtttatttagactataaagactaacaatggtctaatttaactatattattttgtagttatgtcttttggcaaggattcagtactatataggacttggatttttccattctggatatttttcagttaacttaaatttttttttttctaggttaaaaaatggccatactttagtaactaatcagcctaatgctttgcttatgaaaacttttaccatcattatttttttcattttggattgagaaaatgaatccagatatagaagaaagtgcaggatgttggataaaagtggctcttaaacagtggaacatccaataactaatttgcaagaagttttaaagaaataaaattgttatgcttcgattttggtatggtattgactctttagcacataggtagccctcaaaaaaatcatccagttttctaaattatggaaattttgtggaagacgttgacctggattttgagcctcatcatggcttcatcggaatttcatagtgaccacaggctttcatacagttctcaaggtaggattcttgcttttgaaactgacaaaaaatattgctattaattggacaagaaaagattctgcatatttagtttgggtggatagttttttttgggatatgtagtgataggaatagaggcctactgtgtcaattcggtattagtttcataaatgttaagggctatgcgtcgtttaacttgtcctactagtatttaacatcccgtggattttagagttgactggtctttcttggaaaatgatagaccccaggccttgttcttctgaaacttaaactttaataagcttgttcattactagagtttatgggcaaggacatgttcaaagagaatccaaacatttatgctgtggaagaagaaaccagataaattatgatacaggacccttttaatatggaccctttgtgaaaaaatacttttgcaaacctgagagttctgatctaaagactagaatctgagtgtaagaatgagaactgtaagaagtgcaacttttcacattctaatctttataattttaatctatagaattgagctttatatcgtagaaatgatcttaacaaagcaggcccaggagtaaatgtcattttgttttccatggaccagtccagtccttatagaattattgagaggcataccttttggatttccctcccatgaatacatagtaatagataattttttggtgccgatgaaccagattttcaagactattacagattgatgtatgtatctagaaatccatgttaaaaagtgtggctgtcaaagtaaatcaatgaagccatgacatttagtatgaactctaattatttataagaagtgaaataaacactgtctttgaatttatttacatttggttatggttttataggagtttatattagtgtgtaaactccatgtatagacactgaggcaaataagcagacatttggtttaccttagtggtaaatctagctgaaagaaggtacagctaagaaggtagatggaaaatgtttagtacatctaaatgaggaaaatatgttcctcatttagttctctgaaattttagtcaagctgtttttaaaatagctttattgagatattactacacataccatagaattcacccatttaaggtataaaattcagtggtttttagtattttcggcattgtacaaccatcacaataacctattttattttatttcatcttattttttggcactagtgtcatcgccaacataatcaattttagaacattttcatcactccaaaaagaagcctatacttcttagtggtcacttccaaattccctccaaaccagccttcacctccagctgtaggcaactaaaccttctgtctgtagagatttccctattctggatatttcatataaatgcaatgatatgtggcatattgtgacttgctcttttacttaatgttttaaatgttagataatgaactttgattatgaagacagttgttctgaaggttcattcatgtcatagcatgtatcactactgcattccttgttattgtaaaataatattgcattgtgtggatatactacattttgtttgtctattcatcaattgatggaaatttggtttaattcccctttttgagtatgatgaatattgctgagcattcacatctaaatttttatgtgaatgtgtgttttcatttctattgtgtatatacctgagagtaggattgctggatcatatggttaactccatgtttaaaattttgaggaattgtcagactgtttctcaaagtggttacagcattttacattcccattgacgtgtttttgtttttgtttttcgttttgtttttttttttgagacggagtcttgctctgtcgcccaggctggagtgcagtggcgcaatctcggctcactgcaaccaccacctcccaggttcaagtgattctcctgcctcagcatccagagtagctgagactacaggcgtgtgccgcaacgcccggataatttttttgtatttttagtagaggcggggtttcaccgtgtgatgatttcttaaaaaataataatttctacaaggctatagagattcttttttggataactttcaaaaacagattctgagctaaactcttttcttttacatatgtgtgcttctcattattttttatttcaaagtaaaattttaatatttcttgtagaatttagctcttaggatccatgttttaaaaattaaaaaagtaaaatagtccttcacaagtaatattaaaatgatggcaacttaatcttcagattttaaacttttattctttcatttttgtttaatataactttttttgtacatacctcacatataatgattcatagttttaattgacatagttgttgtttatattgctgcttctttgttccgttaaattttcttttcttccatgtgttttttttctggattctctgccttgtgattacaaagaggaattcctgacttatcttgaacactaccagctaactattccaataagggttgatcaaaatggagcatttctcagctttactgtgaaaaatgataaacactcaaggagaagacggagtatggaccctattgatccacagcaggcagtatctaagttattttttaaactttcagcctatggcaagcactttcatctaaacttgactctcaacacagattttgtgtccaaacattttacagtagaatattgggggaaagatggaccccagtggaaacatgattttttagacaactgtcattacacaggatatttgcaagatcaacgtagtacaactaaagtggctttaagcaactgtgttgggttggtaagtagatgctataattttaaacttctgatgggaaaataagaattttgcaatgtaaatgtctttcctcagattaaaaaaaaaatatatatatatataggtagtttaagtaggaaggtaatagtttaaaattttttgctatttctgctgcctttgattttgattttctttttaataatgtattgacttttcaaagggcagcttttaaaactctattattagaagaggaatgaacaaaacttcagatttccctttagacttatgtttttctgttcaaataagatatcttttatgcataaacaaaactcagtcatttttgaagaattttagggtatgtttgtatgtatatgtgtattatggcaggaagccacaacactgacattctttttataatatctttctttggtaggtaacatatcttaaaatttcttatgacctacttacagttataagttctcgaagtaaaatcttttatacagtgtctatgagataattttttatacatttatatgaagattgatataaatcttattttagttagaaaatgggttctaggctgggtgaggtggctcatgtctgtaatcccagtgttttaggaggccgtgatgggaggattacctgaggctaggagatcaagaccagcctgggcagcatggcgaggcacccatttctaaaaatatatttttaagaaagaatggaaaaaagaaaatgggttcaagactacagggtttatcctgggcatttgaatccattctagtctaatggtaaatacacagttcaaagttgcacatagtaataattgcaaaacaaagcaaatttccatgctttctcttctgtgtttaccctgttcaggctaatgtagctgttccattaaagctgtatctgtgaaaagggtaaaaacattttgatgctcaaggaacattttcagaaactttttcttttttattataacatacccatattcttatttctgtttcaatataaaataactataattcgagttgggtttaaataagttttaaatttgaaaggactatcaagaactacacaatggaggaaaacatttcactgtagatgtatataggaatgtgctccaattgtctactttctatcactgttaagtaaaatgaaccaaaatatttacttagcttgtaagatttaggcttaatttctacaaatagacaaattgagtatactcattactagtttctctataagcagtgttaggactttctctataaaacagatttatttttttaaataaaattatccaaaatgtgttctaaaacttttcatatgttaaaatggcacactattcattatcatagaaaaatactattcctagttattgactaggttatttatgtttggcattaacattaattatgccattgctagttttaacagggtgatgaaatgagcacattcaagaacaaaactaattccattgtgggatttgagagaagagtgattgtagatatgaagataatttagaacatgtaggagacaataagggcctattcgaagactatggcattgagaataaagaagacagaatgaatttgaaccacatttagggacaaaatttaaaatatttgcatcctattaattttttctttcctgacatgtaataagacagagaatacatagtaggtagttaataatattttaaaaaattgaaatagaattgaacttgtgagatacaggagagaaagcaattgaagatggctgagatatctcttttggatgaaagtatatatgaatgttatgagttgagaacgaatgtcagaggagagctggattggagaggaatttgaagagcatgcctttgatatagcaaatgtgaggaatctgaataaataaaggttaaagatatctaatggtatttgagaaatgtagctctgaagtttagaaaagaattcaattctggaaacgagtaacttcagagccattaatgtaggtgactttatgaaattgtgcaacatgctgtttgatgactcaaaagtgagaataaagttgaaaatggaaccttttctacaatgaaggagatgacaaaatgtcacctattcatccttattgagactttctgtctcttgttctctttccctctgttaacacctattttacttcgtctcttattgacactgtatggtccgtgttaactaagtttgattatttgattaaggtgtgatctgccaggtttgtccactgaagttactattttttcccttggcagttcgtaaggaatttgtgagcagatgtttcacacttttacacaccagttttagtaaactttatcttcattcttattttgtatgttactttttttttttttttttttgagacagggtcttactcttgcccaggctggagtgcagtggcgtgatcttggctcactgcaacctccacctcctatggatgttacatttttaatcaaatggaatatgtaaacaagtgttttttaaaaaattctacttttcaaaggccaccacttttaataaattctatgtttttaatcattctatataaaatagttgttaatgcagagatcattagtgttttctaatcgtatctcctcacccatagttttagtgctgggactcttgcaccattcaaaatacaaaattcctaacattatagtctgtcagcttcatataatgtcatattttaatttgctgtgtatttggaccatggtttcttactcaggttttgttttttctggagtttctgtttacttttactttttctcagtgcgaaaaaaaatatcgtttctttatcaagtgatttaatattttccacttccttagtccttttatctattgcttgaaatacattccattcttctttggaggcatttttcatggagccatttaattaatttattgggctaatttcttgatgttagtttctgtaacatctctcattttgggacttctttcctaaattagttccacatctttctctttctgagtttacattcctggttttgttggagaatatcttcaaaaattacctcagaacagcgactggaaagtaaagtttctgagtctgtgtctatttgaaagggaccttatgcagccctcatgtttgattaataatttagctgaatgtgaaattctgggttcaaaaaatcatcttccttaagaatgatggatggtggtactgggaaagggaatatatagggcataaaatttatttatatggttttatagctttaaaaaagaaaaatacttaaaggtcttaaaagttagcattgattcacaggtataagtctgctgctagtctgattcttgtccttttattctttaaaaattttttttagttaaaaaaaatttccctcagtgaaagcatgttccttttatccttcctgtttcaggaacttataacatggctaactatgggttttctttcctaatttctgcttggtatttgatgggtgcttttaataaagaccctccttcagcttagagaaattaaaaaaattatttccttaataattttatcttcttaattttttcttcctccctgcactctctttctggaattggttctctgcttcgcttatctttttctctttttccattgttttcttttttgttctaatttctatgagatttccccgatttcgtcttcttttccttcagttgattaaaaaattacagcagtcatatttctaattttcaaaagttctttctctttttcttggattttcttacattctgtcctttttttttttttgagacggagtctgctctgtcgcccaggctgggtgcagtggcgcaatcttggctcactgcaagctccgcctcccgggtccacgccattctcctgcgtcagcctcccgagtagctgggactacaggctcccgccactacgcccggctaattttttgtgtttttagtagagacggggtttcactgtgttagccaggatggtctcgatctcctgacctcgtgatccgcccacctcggcctcccaaagtgctgggattacaggcgtgagccaccgcgcccggcctattctgttcttatttcatgaagactgattatcttcagtccctctgaatattataaagaccatatagctagttagaaaagctcaatgatcccattagactttctgttcatttagtcatgtccatagttgtcattctccccttttcattattcattcatttcactaatacttataagtaccttccatataatgggcactgttgtaggtgctaggattacagtagtgaaaaataaaaatctctgttatcatatagcttgtattctagtagggtatacacacaaaaagataaataaataaaaactataatacgttgggtagtgataaatggcaaggaggaaaaagtattgagcaaagaccctaagggaaaggaggaaggaaatgctggcatctgagggataagatttccaggtagaaattttaaagtacaaagatatgatcttagagtgtttgaggaacagcatggaggtcacgtggctgtagccaagagaaagggagggagaataatggaagttgaggtcagaaaggaaactgggagccagatgtaaaggctttaggggacacaaaatagaatcaatgataactacaagttcgaggcctgagcaactaacataatctagcagccatcaactaagatgagaaagactctggaattaactgagatgaaaaagctgttcgaggagtaggtagggggatgtatatcatgagttcagttggaggtgttaaacgtgagatgttgtataggatattggatatgtcagtctggagttcagaagagagatatgaattagaaagttataaatttgggagtcatcaatatatagatgccatttaaagccaagagattatatgaaattgctttgaagggagcataggtagaatagagaagaggtctaaggactgagcccttgggcattccaagaggtcagggaggtcagagagatgtagcagaaacaacatagaacagagtaataaagctgaaggaatatctggaaaatgttctggaagccagaaggaaatatttcaagaggaaagtgctgctgatgagtccaaataagagtagcactgcaaattgcattgaatttatcattgaggaagttattggtgaccctgacaaaagcagtttcagtgaagaagagtttgaagaagaggcaatgacatgattggagtaggtttaaaatggagtgggaggagagaaaaagagtatgtagacagttatttcaaggatttctggaaaagcaaaaaaattttcagtagcaggcagaagtgtggtcgcaggaggttttgttttgtttgaagtgggaatgattaggtagagtgaggggtgctggaatgaagttcttgataggtgagaaaggatagaattttccacacaaatagaataattacctttagctaggggaatagatagttcatccataataatagggaaaaatagattatatggacataagatgcaggtaggtgggtatttgtgattgtaggaatttgtaggaggttttgcaatgtctatcggaggggaatatgaaggttttagaggattaagtagagatgagaaaacatgaaatagttatccaggagaatgggatactgaatgaacttgataaatatataatttctgtgaagcattacagttacagttaaaattattaatgaatctaaagtgagaccagtcagcattttgttgtatttttctctggctaaatgcagctgcaaaggtgcaggcccagcaaagttgaatcttatcaaggttgtggtttagccagctggattccatgaagtgagaaagaggtaagggaattgaaggtggaattgaagctgggttgtgagggaagtgaggacatgaggtgggtgaaggacagtgaaaaggtgataggatcaatggattatgggacctcatggggataaaaggactatcccttggagttggcatattagagggacagttttagaaagatagaagaatgggatacttgaaatcaagattatagaaggctccaaatattgataatgctcaaagtctagggattgactgtgggcatggtgtaaaaggtaaggtgagggacaagatatttgaaggagaggaggtcaaggaattgagagggcagggaatgaagagaccatctatgtcattagtttttaaactaggtccatggatgggattcagggggattgtgaactgaagtgggcaaatatcacatctttatttttactaattcttaatggaaatttaacatttctctcaattttaaatataggtaacaaaccaatatgttgatagcagtacctgtgactttgcctccaatagaaaccacagatattttcatatcattacggtttttgcattcttttaaaaatatttttattcatcactaattgtgaaattgtggtagttattagagccactgaatatcttatttaaggtgttacacaagttatatgtattatattttaaaaatattttgataactgtattttactaaattggttttatttataatcctatatattttttctgcatttaaaatattctgaggaggagtccttaggtttcacccttagacttccaaagggattcagggtatgtgcacatgcacatacacgtattttaagaacctgtgatgtaagaagatattgaaatcaacaactatttcaggaatgatgttgcagagaatgacggtgatctagaatctcttatttttaaggaatgagggaactgacttgggatcaatagataaatgcaactgggaaaggagggagaagatcatggcatgaggttcaatgctggtgtttgtttgttgaggaaggagaaagaattgtttggaaatgacagtgagttgcaagaacatctgaccctaccttcaggtccaataggaggcatgtagaagacaaagcagccaccgttccagaggactacaggaaaggagtgtcatttagggagcttcaggtttttgttagagcaagatgaagtgaatattcagagatgaagctggtggtagaggagattttgttgatgattgaccttgagtttgagagaacacagtagaagtgtttcaaataatagggagaggtaggagatgggatcagaaaacaagatgtacataatcatatgagaattagaattcagggggtgaggtttgggcttctcaaaggaatttatacctcaaggaaagaggaggcatggtgaaattagccctaatagtcctgaggcagatagtgtaaaggtgaatggggatactgaggtaagtgagagcaaggcttttgccaggcatgcatagatttctggtactcccactaaattcaggccctccatcatctggttttcagaccctttctaatctcataatcactctccccttccctcccttcagtcactgtagctcctgattgtttctgaaatactgtaagtatgctcctacctcattgcctttgcatttgttgttcccagtatctggtctgccctttcccaagatatatatttggcttgctccctcatttttttcaggtttctgctcaaataccaccttattagagaggatggttgcaactatccaatagtttgtataattctctcacttctaattattctctgtcctttttgattgcttttatctcccctcttaatgtttatcagtacctgcttcatcatttatttgtataatcaattagcttttttttttttttttagacggagtcttgctctgttgcccaggctgagtgcagtggcacgatctcagctcactgcaacctccgcctcccaggttcgagtgattctccttcctcagcctcccgagtagctgggattacaggcgtgtgccaccatgcctggctaatttttgtatttttagtaggggtggggtttcaccatgttggtcaggctagtctcaaactcctgacctcgtgattgacctgccttagcctcccaaagtgctgggattacaggtatgacccaccacgccaacctaattagctttttctagctcctcccaccaaaatgtaagcaacgtgatacagctggaactttggttcactgttgtatccctaccacatagcatagtatctgccttgtgataggcacttgagaaagcatattttgtgaaaaaataaataaatacagaaacagcccttagaggataagagaattatggtgtagtggttaagagttcaggctccaaagtcaatcacgagttcattgtttaacgttgctccatctcagtttctcatctacaaagtggaacagttagtggtacgtcaaagagctattaagaagagataatgttataaacattttacaaagtacctaacatataaaatctctggattgttcttctagagtcttttcattcttgaaattagagattgtgtttacttaccaggcttctgacttcatttttccccagcaaatcaagtctcttgtctggtaactttcaattttcttgtgcccacagaccagcatgactttagtctctagcctatctggactgtagcctagaccttgcttcctacatatccctcttatcaaaacttatactttcccccttattctgcaggaactgtgttcagttttttagcacattgttgatctacctggtaaagtacttcatactgaggtattagaatatgttaatggcatattatgttatttctgccagtatttgcatttaatatagggactattttccttaaattaaagcaaacaatggtgaaaattatatgaagtgactcagggctgctttttttgtttgcattcctcagctcatttcatgtaggtgactgccaatttaatctataaattagagcaactctgattatgtcttatcattccttccaagcatgaggtacttaacatgaatttccctaagcagaatcatagaggtttagaattcaaagggaccttagagattatctggactagaggttttcagctttctttttaaagcagcaaaacccctttttcaaatgaaatgttatgtggaaacttaatatatagattaataaatagcacagctgattcctaaacccaggaatccaagccatgtaggtctccctttgttgtctggggcaatcccctgagggcacttccatggaacccttagggctccccagagtgctgttttaaaaccactaatttagaccaactctttcatttttccagctgaggaaatacacccagagagtttttattttatctggtgttacagggtaaattagttggattaagagcagtcctcacatgtgccatacttaggaaaacactattagacaaaggtggaaattcttatttcagatgtagataacttttaccatctcatttttcatcaacaaagttctatttatacctattacatgtgggacactttctatggttttaactgatacgaagaaatatgagatataaccctttgccttaaaaagcaaattatctaattgggaagctaaaatatgagttgaaaacttataccaactttaaataagacttcacgacttgagatgtaacaaagcagtgtgggattaattgaaaataagtgatactgagaattagctctattggagctcagtggagggtgaagctactccatttggactagagaaggtttttaaagaggagagataactgagtagcacttggctaagtaaatagggataaggtgatataatactgtaagtaagggcagaactttgaattccagtaccctcacttacctctatgtaatattgggcaagtcctctgagcctgttacttcatctgcagaatgggggatgtatgggatgtgtgttaattaagaacatattaattgatgtaacataaacctcaaaatgtcaatgatttgtcacaatagaagcttatttcttctgtatgtctgtgtctacatcagacatctttctaagaggtcacacagggacccaggttccttcttttttggtttctacctaccctaggtatttggagttctcttcgttcagtggggaaagagagtagaagattccactgcagaggtattcagaggttgggctgaaagtgttacataaccctctgcccatatttttattgtgcaaaactcaatcacaaagctatatctaaacacagaggacatagttatgtgcataatgtggaactgaaataagttttagtgttcacataaaatctgttacctcacagagtcgttgtgagattggaggaaatcacgtatgtgacatgcttagtacagtgcatagcatatggaggtatttaaatgtcctttttaaagaataggaacatttatataatgttttaattgagtacagataattcgctaatttttttattaacgtgttttaaccctgtaaatggagaagtgtccatttacttttagctcttggtaataatgataactaatatttaaaatgattctctttggtaagttctttgtttatttttcttttagcatggtgttattgctacagaagatgaagagtattttatcgaacctttaaagaataccacagaggattccaagcattttagttatgaaaatggccaccctcatgttatttacaaaaagtctgcccttcaacaacgacatctgtatgatcactctcattgtggggtttcgggtgagtgagtgtgcagcttttacaaagcgtattgtactggattgctgctttttctttcttctggcaagtatagtaaggttagcaataaaaggaagtaggagtttgactacaattataatgtccagagcccttttaatagatgtcacctaccagtagttttaaatcaatttgggagctctttgagaagtttttaagctgtaagtttgtataaaattcattttctttttttggttgaagggaaaaaaataaccattttattttacttaggtaatagctatagcttttttgcacagttatactgtagtactctgtggtgttcgtttagcctgatatttttatgctagtagcaggaatctagacacttgaataagacttgaagagtcttaagatagtattcaaaagtagtgttagcactgagcgaggatactatagaaatatgtagtacgggcaacaaacttagacttcagtggtcaaggaaagcttcatggaagaagtgacttctaagctgagggctgggggaaaagtgaaggtagctgtgtagaagtggagaaagcagtggctattagtgtttcacatagaggaaatagtgtttatgaagctcctaaaccaaaagggagaatgtcttataattgttttataagacatgttttataaattgacagacagttcatgtaactggatattagaatgtgggctggagggataaaggtgaggttcatagtggttgggggaagtggttgtgagagatgaaactggaaagattagcagaggccacatcatgaagagcttataaaccatgttaaggggtttgtttatcctacgtgcactagaaacccactgaaaggatttaaacaggaagaataacataatcagatttgtgttttagaaagactactcttgcagcaatatggagatggaattagagaagagcaagactagagctaaggagttaggaggatgttagtctaaaggtgagaaaatgtagagaaacaggccgggcgcggtggctcacacctgtaatcccagctctcagggaggcaagaggcgggaggatagcttgagcccaggagttcgagacctgcctgggcaatatagcgagaccccgttctccagaaaaaggaaaaaaaagaaagaaaaaaaaaagacgaaaatgaagagaaacagtggatataacatagcacagcaaaaagaacatgcgctttgatatagcataggacgaattacccaacctctctgagtgctcatcttagcacatactagttacccaatcaaattgtagctatcattaagatgactgtttctagtacactaaagtgttattatattaacaaaaatttttaaagatttgttctatgtagttccagtagctagaaccaggggcagaatgtttcagagagatttcagcttaatgcaaaggtaaagtcaccaacaaatagatttagtgaaaaatagaaagggttggccgggtgcagtggctcacgcctgtaatcccagcactttgggaggccgaggcaggcagatcacaaggtcaggagttcaagatcagcctggccaatatggtgaaaccctgtctctactaaaaatacaaaaataagccgggtgtgttggtgcttgcctgtagtcacagccacttgggaggctgaggcagaagaatcgcttaaacccgggaggtggaggttgcagtgagcacagattgtgccactgcactccagccagggtgacagagtgagactccatctcaaaaacaaaaaaaagaaaggattgccttgtgaattagtgtatgatatgtattatccttttgtttcttctccatattcttcataggcttgttttcttcctaagtgttaagtcttcttttcttaatctacttttcccattctgcacactttcttcttgagtaatctctgaggctgttaattaggtccttgttggtcaagaatagttggtaccagaaaaagacaacttacagtgaatctacttaaaacatgaaattaaattccatagttaataattaaaacaaaaggtttgttgggtctttatattgagtaatgaaatgaaccattatggaaataagtttatcttatatttaacaacatttagactgtaagtataactatatgtaaattctttaaaaactaggattcaggccgggcacggtggctcaggcctataatcccagcactttgggaagctgaggcaggcggatcacgaggtcaggagatcgagaccatcctggccaacatggtgaaaccccgtctctactaaaaatacaaaaattagccaggcgtcgtggcacgcgcctgtagtcccagctactcgggaggctgaggcaggagaattgcttgaaccctgaatgcagcggttgcagtgagcgaagatcacaccgagagcgaaactccttctcaaaaaaaaaaaaaaaaaaaagaaagaaagaaaaaaactaggattcaaatattcagttgtttattataatgtaattattctatcatttttccataatatgccagccttcactctatgattgtaaagaagatcaccttttgcaaaaatatttaaagattttatcatattctgaaaagcttatctcttaatcctttcatatttaaattattcttttttgaagtatgtatcacattattttaactcaggcagatccttattttttaatggtttacgcattagtcaagcacttctccaatccattcttatggctatcataaaattctgcacttttggggaaagatattctcttaccatctcttatttggattactgtgagaatttcctaaagtgttccatttcaatgtttttaattcacttgccatttctactaccccaaactctagtctatttattttagaccctcattatctcttgccgagaccactatactgactttctaattatgctttttgtctccaggtttgtgttcttattttcagtaaaatctgtcccctatatctggctgtatcacacaccttgaaaaacttcactggcttcccattactgggaatataatagtatttccctatgttctgggcaagtgttactggggaaaaaaaacgttttgtgtttactagtaaatttgagaaatgtctggctaacatcttaattgtgatactgtttcaacagcataggtcaagtgagagatgtgaatttataggcatacactaccagttagcctattacctggaattcaagtttatgtcaaaatataagatatgaaaacccccttgacacaggacatatttatcttatattcagatattatttttttctattctaattagattcaaactacgaatttttaaacattttatagaagtaataaatgttccttttagaaaatttagaaaatacaggacaaaaaggaaaagaagaaactgaaaattacttattccaatacccagagataactaagtattcttctagtccattgaaatagatattattatgtctctatatcttcattatctacttatgtattcattaaataaatattcatttagtacccgtatgcaaggctattctaggtgctggggatgcagcaataaataaagcagaaaaagtccctgctctcatggagtttatattctagtgaggaaagacagttaactaaataaacaaacaaacaaataaatatatggccaactgtccagaagtagtaagtactatgaacaaaaataaagcaggtcaatgaaataatggtgaatggctgtatatattcaaacactttgatattgatcaaaaagttaaaatcttatttcagatggcaatgaaatccatatattgattttgggaaaaagttattgtgttgtatgtgtttatgagcaatgtttcctaacatgctataatctaatcaaaattaaattgagcaaagcatgtgtaacaggtatcatttgaagaactactaatctttattttgaaacaaaacaagtcaatcttgttttctattttagactaagaaagatagtagttacagatcattaagcttaacattaagaagtcaattggcaattatagaatgtatagttttataatgagctaattatgctggattaacttaatttttaaaatgaaactgaagatgttctctctcttgattttattcagtatatgtgtatatgtataaaatattgaatatataattatatatgatatatataaaatgcctttgatggatattcataaataaaaatatatagttttaacattcaaataatttgtagtttgttagagtgatagccaagcaaactaaaatttttaaaaactaaaatgttgaaaattttgacaataacaaagatgatgataacagcaactaccttacactgaatacatttttgttttttttattattattatttttgagatggagttttgctcttgttgcccagactggagtgcagtggtgccatctcagctcactgcaacctccgcctcccaggttcaagcaattgtcctgcctcagccttcctagtagctgggactacagatgtgtgccaccacacagctaatttttgtatttttttttttagtagaaacattaatttaggatttgaaatattttactggacaaaatatttgaaatattttaccaacctgttctcttttttaattttttagtttttgagatggagtttcgccctgttgcccaggctagagtgcagtggtgtgatcttggctcactgcaacctctgtctctcaggttcaagtgattctcctgcctcagcctactgagcagctgggattacaggcgcctgccaccacatctggctaatttttgtattttaagtagagacaaggtttcaccatgttgaccaggctggcctcaagctctgacctcaggtgatccacccgcctcaggctcccaaagtgttgggattacgggcgtgagccatcacactcgacctgaatacattttaaatgaggactaccattgctatgtgtttattgcacaataatgtctaattattttcacaatattttaaataaaaaggagaaattgaatgggtcggagaaggggaaatgatcaaaagaatgaaaataaaatcctatatttggacatttaagctgtttagccagagtaagagactaggcatgacttgaatacatgagtggttttatgatcacagaggattgagcaggagaaattggagttatattgatgtggaaaagctttcagctgttttgtaacaatattagccaataaaacctagtggcttactcagtatacttttagtatttcacagtttctgttggtcaggagtctgtgcatggatgggtcatctgcttaacctcaaccagggctgaattctcatctggaatcttgactggggaagaatccacttctctacccccatagttgtggcagcattcagttctttgtggttatgggtagctttagtttttggatgattgtcttcagatgccagcgtcagttcaccagcatgattgattgctttctctaagtcagcaagggagagactctagacaaatgctacaatattatgtaacataatcatgtactaatatactcaaaatcacatgcatctcatcatctttgctgtattctgttagttagaaacaagtcacaggtcctacccatattcaaaaggaggaaatcacaaaaggatgtgaacattaggagacagaggtcatggaggccatctggagagtctgtctgccaaaattggatatagagaaacactatctggaggatattctatcgaaataagaagtggtgtttatgtctttgcttctcttcacctttagggatgaagacactcatttaacttagaagtttcaggagtatttaactgatgggtctcatgatcatttccacctcatttctcaaaatttatccatcctactgacttagcacatttcttgctgctgtaacagaatacctgagactggataatttaagaacaatgaaagtttacttagcatatggttctggatgctgggaagtccaagagcatggcaccagcatctggtgagggtcgtctcatggaggaaggcaagaggaggaagtgagtgcacacaacagagagaggaagttgggcctgaactcattatttttatcaggaacccactcccacaataaccaacccattcctacaacaatggttttcattccttcatgagggtggagacttcaagttttaatcacctcttaaaggccccagctgttaatactgtttcaatggcaattaagtttcaacatgagttttggaggagatattcaaaccatagcacctaccaatgcaatttgtaaaacagaaaggctaaagaagttagaaaaatgagaatagttacactttctgtcaagtgtatcatatattaatctaattattcctcactaaattttttaataagtgggggtgagaaagatttcctgttcaatataaggatgtggaagtgagatatacagagaacctctacatgctcaagtttatttaatgaagatgataatcagtgaggcaggtgtttacaaatgccatagtgctaaaaggctgcttctatactgaagaaccaaatgtctagaaaacaaaggatacattgcaatccatgctaaatatggttcaaagcaaattatgctggaatcgtgatctttcaactataattgaatgtctcttacctctaggctttggaaaagaaatattttgagtactctgtcagaataaagagttgtagactgccaacctaagtgaaaaaagtaattcgttgccttttagaattgagatttctagagcagtagaattgattctaattaaaatagcttgatgaaagcatcttattttaaaatgaataatcaaaagtatctttggaatagatttttgcaaaatcagggctatcagagctgtcttagactgattgaaaagttcatactctagatgctttttaaataactttaaatggctctttaaagtatatatcctaaatttaaatgtattaagatgtaattactggaataatatgaaatgactatttgaaaattatttttattaattaattcatttcttagatttgttttgttttcatgagcagttgaatgtttaattttttcagataacgtgattattttcaaaaatttacagacttttttctcactactgcattttctcattctcttctctttgaaaaatcttaatatattagagaatttgtgagaagcatgtctacatgaaagatctataaataaatatttttaattagtgaacctatctgaattggctgcttttattgtagatttcacaagaagtggcaaaccttggtggctgaatgacacatccactgtttcttattcactaccaattaacaacacacatatccaccacagacagaagagatcagtgagcattgaacggtttgtggagacattggtagtggcagacaaaatgatggtgggctaccatggccgcaaagacattgaacattacattttgagtgtgatgaatattgtaagtttgatccctctatataatattttacttcatatttgttgtgtttttgactaaggtcataaatttttgctgtgaagtaaataatgataagaatttacctgtctaaaatggtaaaaaattggtctagtaatgtttcagttccataaaaatacatttaaagatgaccttatcattcatttttagataatatgacagttttagtggattgttaaatcttgtttaagggtttttttttttttttaacttgaaacatcagctcaccctctaatttccatgctgtagttcatgtctaggaggaaatatttattgaggtagacttgtataaaaaccttttaccaaggcaccttgaaggtagagttctaagtgatatggggtaatgtatacaatggctaaatttataaaaaattgttttagcacttaaaaaaccaaactatcaccctataatttttgtctgactttgtgtcttttcttattttctggaggtcaggttgccaaactttaccgtgattccagcctaggaaacgttgtgaatattatagtggcccgcttaattgttctcacagaagatcaggtaagaatgagttagtttatatatctaagattgttaacagaaggctatagagctatagaattacttattattaaataatatgttttattattgcttctattaggaaattctagttggatatgatttttagctctacacatttaatatcttaagcaaattttaaatacattacaagaatataccttttatgttaaagctatatagattagctatgtttcagtataagggtgaacatttgcatggcatatcttataataatgattttcattagtttttgtgttgataatctcacatatgttcacattatcattaaagctggaactggaaaaaaataccagttcaataatataccaaatgagctctaggtcagatattacagagataaaaattggcaagagattattcctagaaacactgcttctaattatagtcccacttcagtcttcaaaagttttaacaactgaccttagtaatttgtttggaacatttctggtatgcatgttgtattgcagccaaacttggagataaaccaccatgcagacaagtccctcgatagcttctgtaaatggcagaaatccattctctcccaccaaagtgatggaaacaccattccagaaaatgggattgcccaccacgataatgcagttcttattactaggtatggtttgttgcaagtatttttccattgattgttgtgtttattcactattgtaataaatttggttctatgtaaagcctcattcagataatgagtatagagaaagcaaaatggtaatttatttttcactactgagaaagaatgtattacactattattgtgtttgcatcaaatgaaccaaataagaaaaaagaaaatattaagatttgacttagaaatttaataaataactttcctcctactgataagttctattcataatatttaatcaaaagcatgtagatgatttgttaaccgaacaaaatacatactaaaacaagattaaaacatatgagaaaatacatatcttaaaaataaagtgaccattatcagttataaaatatattaactatttttacctttcagttgtgttaaagtttattaaaagggaggcggagactggcagttatacaacttacttgaatgtttatttaatttgaaatactttaagatatataaacataaaaaagcagattgattacactatgtgttgaacagcttgtctctcaagcaaaattattatttggtgataacccattgaattcttatattgctttccagttttacaaaactgttttgagatccattttattctttactctccagcaacaattctgtagatagtgttattatgttactcatgttaggaatgagggaactgataggtaagtttctcaagattacttagctaataagtgaaagaatagggctcagattctggtgatcctgtctttgattatacgatgctatctgttatagtttttaatactcttacttataattggttagaaacattatacttaaattattttaagataagtgtgccttttgacttcttatcaatattttaaaataaaaagtaacaataaacaataagcaaaatggaagcattattctctcttggctaggtgaaatagtctttggtatgatggttatttcaatttgcaaggcagtatttaacatacgtttcatctgtggtatgttcattgactctacattaggttctagggagggaatacaaagtatatgagttagaatcttgagatccagtaagataatgtaaactttagaaaaagttcccgggtaactgagtcatacagtgaaatttctgaatttttttaatagttatacttactttaattgactttatctacctggcatcattggtgagaaaatttggtttatgacatgcttgctgaataaaatcgtatggttctatattaatatatgttgacattttagtctgataaaatgtgcaacaccttagagtcttgtggtctggaatattcttaaatatacttaaggaattaaaaatatactaggaattgtgcgaatgtggaaacctttctgttaaaaaatatggacattgattagtgtcaatgaaattactagaagaagatatctgttatatatagctaacaaaacgatcataaatatttacatggcttttgtatttatatttgtaaagccctgtcttcccaaatatgacgcacagtgggctcccaatacttcacatttgcattattatatctccattggatttttaccttttgcctcaaatgacagaagttacaccaagcacatatataggtattcaagtagtagagtacatctgggcaattagcccacctttctttgcactggctacaacattcagctgtccaactttttattctgaattcgccttgatattttcccgattctctgcagggctcttctttgcttttgtaagctacttcgagtgcctttttgatgtttgagatttaaacataaatttttattttttatttttattttatttatttatttatttttgagatggagtcctgctctgtcgcccaggctggagtgcagtggcgtgatctcggctcactgcaacctccacctcctaggttaggttcaagtgattctcctgcctcagcctcatgagtagctgggattacaggtgcgtgccaccatgcccagctgattttttgtatttttagtagagacgaggtttcaccatgttagccaggatggtctccatctcctgacctcgtgatccgcccacctcggcctcccaaagtgctggggattacaggcgtgagccaccgcgcctggcccaaaattttctttttaaacttgtctgctaatgatcagactagtactagaaatgataacaggatttaataagattagtagttcgaagagttcatatcatattattttagattggctaatgtaacagaggttagaaaaatgctttttgcagcagtgtagaattcttttttgaactcttattaaagtttcaaagtaacttctagcctatttaaaagtctataattatgtttgaattactagggccatagagtgacttaacaaaatgggaggagtatcatctttaatatttaaaaattgttattttttgaggatcagaggagaggtaccagtgttggactctctcttatatattttttattttgaaatccaacgtgtgtttaaatcatactgctaatttttgtaaaaatatttttgagaattccacagatgattttgtattaatattgaaaattggttgatctaactcacttattaacatgttcggggtgtgacctgactgtttatgggtaagatcatgatgcatgtttgcttgaaatgtcaccttactagggagaatgtataatgtgtttatcaagaatgccagggccgggcgcggtggctcacacctgtaattccagcactttgggaggctgaggagggcggatcatgaggtcaggagatcaagaccatctggctaacacggtgaaaccctgtctctactaaaaatacaaaaaaaactagccaggcgtggttgcgggcgcctgtagtcccagctactcaggaggctgaggcaggagaatggcatgaacccgggaggtggagcttgcagtgagcctagatcgcacaactgcactccagcctgggtgacagagagagcaaaaaaaaaaaagaatgccagaggaaaaatgatggatatgtttatttccactaggccaaattttgtcccagggactcaaaggtttatgcagaaaaccgtttgagattgtagttacttaagtaacaatagttacttttaaaaactcaaaatgttatcccgtcttttacaaattatatcttattgttttattttgttgatttacatttaaaacgaactgtgatccgcaaagctatcagatcactctgactagacaggaagaaaataaaggaattttgaatgttgttttatctgatatcaataatattgaatgaacaccaaagagcatatttaaattatttatatatattatacatgtgtattttatatgtacatatatgtgtatactatgttctatataattattcataataagtaatatataatataatgaataactgttatcactacctagatttatcaaatcttaactttatgctataccaaagagcagctttaggccattttctaaaatgatgattacctctctatgttgtattaactatctgacatcttagctctgaataccaaagttagtgctataatgtataaatttgtggaaatatggcaatatttctatagtttattatatttcatatattataaatatacattaatagtagaataataaaactgatctttcatttttgtgatctataattttagttaaaatatcagtattagtaactggtattgattgctttcatagactaagatatgttagaattatttgatgattattaatattcacctaaattagtgaatgaaattcacaatgtatcagtggtgaaatatgacattatatacctatgtcaagaaatgattaatattctttacttgacactctagaagcagaatttttgaaggcaaaatacaactgtacatatatagttaaaaagttaacttgctataaaacttgcaaattgtctttattaagcttttgtattttgttgttttaaaattattaaattgacaaaaattgtgtgtctttatggtatacaaatgatgtttagatatatctcaacattgtaaaatggctaaatctagcattggcttgatatgtgttgcctcccatactttattaaggtttgtattgataaaccaaattaatagctacttaggaataaaaacctgcaagttgacagattatttaatttaattaaattttcagatgaagtcaggaaatatccaccacaagtttaaagtcaagccaatatctaaatctgttttgtggtaaaatactcaagaaatctatttgttgtctgaaattcaataggaattcaaagacatggagtatatttgcatcaatgtttagcaattagcacgaacagactaatgcatatatttcttggctttctctcctataaagtattggaatcaggtttttccatttttaagataataatacgtaacagtttatatttagggtagaaattatagcccaagttctttttatggtaacagctttattgagatataattcacaaaccatacaatttacccatttaaagtatacaattcactggttttgagtatattcacagagttgtgcaatcatcattatcatcaatttttagaacattccatcactcccaaaggaagtcatcctccattccctacattcccctcagtccccactcctaccctagtcgtaagcaactgctaatctactttctgtctatatagatttacctactctagaccatacatacaaatgaaataatacaatatgtggtcttttgtgacttgcctcttttacttagcacagtgttttcaaggttcatccataatgtggcatgtatcagtacttcattcctcttattggcctaaattcttcagaattcaagacaccttttaagactgcctctataggctatttgtcaattattatacttgtacagtttttcattaatgaaaagcacaggatttataaatacatctcaaaatacagatgcaaaaattgcacaccaagtcaaataatttagtctttaattaaaatgggcattttatcctcttaaggggtcatgactgtttgctttggtgctgctggattataaaggaattagaatttccaaagtcacctaatgttttcagttgggaatacaaaaatagctataaaaatggtttattgttaaaatttggcttgcagtgtgtgcatttaaacaagttttcttattttttaaataatgtgtttatcaggattatatattggtttcatggtaatgtattaggacagatagagaaaagggaagttaaatgtgatatattaacatttatttggtattcatttatggatttttaaaaatctttaaagaaatgccagttacctcttttatgaccagttaaatattttatttcactagcttttaaagaatatatttggtttatacgaagtgtgaattcagattgtgggtgaattaattttggtatgtggacattttgaagcatttatttttctcttaccacgctgctttttctgaattgtttgagatgatcatatagttcatctttctaaaagtgtattaacacagtgaattgcaatgattggtttagaatattaaaccaacctttctttctttttttcttgagacagggtctctcactctgttgcccactattatctacccacccccattgcccatattcctcctcttcagtttcctttccttttatccgtgccttgttggtttcttactcagaagtgtttatcttgaatcagttaccatttcaatgtagactgacaaactggagtaactctaatttcttgtgtacactgggacacttttaagagtgaaagaggggggctctgtgtgatgggtcatgcctgtaatgccagcactttgggaggctgaggtgggaggaatacttgaggtcgggagttcaagaccagcctagccagcatagtgaaaccccatctctactaaaaatacacaaaaacattagtcgggcgtggtggcacgcgcttgtaatcccagatactcaggatgctgaggtaggagaatcgcttgaacccgagaggcggagattgcagtgaactgagattgcaccactgcactccagcctgggcaatagagtgagactccatcttaaaaaacaaaaaacaaaccacaaaaaaactgaaagagcatgccattgacagttatgtctgaaaaacaggcacatattaggacctggtgaaacaggattatggttatctcaggcattacctatgtttgtttgttgaagttcaaataaaaatggaaacaagaagatgctatttcctcagtgcccaaatttaatcaattatctttatacacaccttgaataaatagtgtaccttatttgtagtaggcgtcattaaacagttaaagaaggatgtattgtactaaactctaaggaatagtaacttaagtatttatattggttttatggatgtattgatgtatgtatataaccaagtaccagatacttaagtgctttacagacactcaatcatttaaaaccttaaataactgcatgagataaggactgctgtttttctccatattggagaagagagagctgaagcacaggaaagtaaattgattggcaaggtcacacagtaattagtagaactaggatttgtaccatgcagtcttgctacaaagtccttttagaagagttataaggatatgcaacaaaaaaaaaatgtggtatcctttaataacgttggcacctgtggtaggcagacttctaggatggccctcagtgatctctgtctcctgatattcatgactttatgtaatcttctcctctggactgtggtctagcgaactgacatcttaacaatatggagtcttccaactcatgaacaaagtctatctctccatttatttaggttttcattactttctctcagcagtgttttgtggttttcagtgtttttatacctttggtcatattttttgatgttattgtccatgatactgtttttaaaatttcattttcaatattaatagtttttcactggtatataaaaatgcaatagatatttatatggattttgtatcctgtaaccttgctaagttcatttattggttttaatagctttttgtgtgtgtgtcagagtctctctcttgtctcccaagctggagagcaatggcacgatctcagctttgtgattctcctgcctccgcctcccaaatagctgggattacaggtgcctgccaccatacccagctaatttttgtatttttagtagagatggggtttcaccatgttagccaggctggtcttgaactcctgacctcaggtgttctgcctgcctcggcctcccaaagtgctgggattacaggcatgagccactgagcctggactggttttaatagctttttaatagattccatatataaagatgatcatgttgtctgagatgaaagacattatgcttcttccttttaataatgaatgacttttatttgtttatttatttattttttgccttattggaatgtctagaacttctaatacaatgtataataaaggtggtgagagcagagatccttgttttgttcctgacctcagcaaggaaagaattccgtctttcaccattaagtatgatgttagctataggtttctttgttgatgcgctttgtctggttgagaaaatttccttgtgttcatagtttgctgagagttttttttttttttaaatcaggaatgggtgttggaatattaccaaatgccttttctgaattgtttgagataatcatatagtttatcttttttaaagtggattaatacagtgaattgcaatgattggtttagaataccaactttttttttttttttttttttttttttgagacagggtctcactctgttgcctaggctggagtgcagtgttgtgatcttaagctcattgcaacccctgcctcccaggctcaagcagtcctcccacctcagcctcccaagtagctggtactacaggcgtgcaccacaatgcccagctaattttttgtatattttgtagagatggagtttcactatattgcttaagctggtctcaaactcttgggctcaagtgatcctcccaccttggtctcccaaagtgctgggattacaggcatgagccacactgtgcctggccaaaacaacctttcattcttaagatgaactcaatttggtcatcaatgtattattcttttaatgtagttagatatctaatttacattcccaccaacagtgtaaaactgtttctatttcaagcattgtggaagacggtgtggcctgggtatatacccaaaggaatataaaccattctattataaagatacatgcacatgtatgttcattgcagcactattcacaatagcagagacatagaatcaacccaaatgctcatcaatgatagactggataaagaaaatgtggtacctatacaccatggaatactatgcagccataaaaaggaacgagattatgtcttttgcagggacatggatgaaattggaagccatcatcctcagcagactaacacaggaacagaaaaccagacactgcatgttctcactcaaaagtgggagttgaacaatgagaacacatggacacagggaggggaacaacacacactggggcctgttgagggtaggggaaggggagggagagcatttgggaaaagagctgatgcatgctgggcttaatacctagctgatgggttgataggtgcaacaaaccaccatggcacatgtctacctatgtaacaaacctgcacatcctgcacatgtaccctggaaatcaataaaaatatatatatagttagatgtcattttccaaaattgtattttttttttagatttatatttatgagggatgttgttctgtagttttttcttagactgtatttgcctgattttggtattagggtaatgttgccctcacagaatgagttatgagatagttccttcttttcaattttctggaagagtttgtatagaattgatattatttcctcctcagatgttttgtagaattgacaagaagccatctgcactaggagttttctttgtggagtgatttttttaaactaccagttaaaattgtttaataatatagggctaattaggttatcttattcagtgagctttggtagtttgagtatttcaaggaatatgtttattttttccaagtggtgaagtgtattggcataattgtttataatatcttattatccttttaatatctgtagaatgtatagtaaaatcacctctatggtattggtagtttttgtcttttgtcttttatgtctttttcttgtcttttgtctttttctaatcactgtggctagacattttaataatcttctcaaatttggtttcgttttttttttttcatttttctgttttctgtttcattgatttgtttccgtctgtctacttggttcaggcttattttgtttgtggttccttatggcggaagttgtgtcattaatttgagacctttctgcttttctaatataagtgtttagtgttagaaaattccccctacatatagctttatcgcatctcacaaatttggatatgttgagtttcagttccattcagttcaaaatactttctaatgttcctttagagtatttctttttttttttttttgacccatggcttacttagaattgtgttatttagttccaaattcccccccactgcagaaattcttttgttgttaatttctaatttagttccactgtggtcagataatatagtttgcatgacttgaatgctttttagtttattgagacttgctttatggcccagaatattgtctttcttggtaaatgttccaggtgggtgcgcttgaaaagaatgtgcattctgctattgttggatcgaattttctatatatatcaattagattaatttgggtggtcatggtgtttaattattctttacccttactgagttgaacaatttgattatgatatgttttggagtagttttcatcatgtttggggtcagtgagcttcttagatctaatttaatcagattttcaccattttagccaatattttctcaatatattttttggttttgcccttcttgccttgctttggtgactttaattgcagatatatttggttgcttgaaggcaactcacgtatggtctgcttatgattttaaagtctctcttctctgtgtattcaattttgggtagtttctattgctatgtcttcaaggtgacttttttctacaatgagtaatccatcagtctggtctaatatgtattttcatcttatgtagtataatttttttcatctctagtggtttaatttgggtcttttaaaaaatctttcagatctctaggctttagaaaatacaaaaactattttaaacattttgtctactaactttattatatgtgtcagttttggattggtttcaattgacaatttctttattatgtactgtattttattgcttctttgcatacttcgtgatctttgattgggtgcctgacattgtgttattttaccttgttgggtgtcagatatttttgtgtttctgtaattattcttgagcttttccttggggtgcagttaagttccttggaaactgattctttcttttaaaatttgttttgtagtaccaattcagtgttcagtttagggctaattattccccagtactgaggcaagtcccttctgggtactctacccaattgccctgtgaatcttgtggttttccagttggtctgggtggatctaggccctatatttaatgttgtgtaagtgctaggcattattacctctaatccttttgggtgataatttgcctggccttaagtgcttctcttacgtcatatgagccagattcacactcaactgaatagttaaggggaatcctttgcaaatctccacaattatctctttgtgtagctgcctctgctgctgtacttagtcctgtaaattttaactgtctttgtctcctgtattttctgttctgtctcttcaactcagagagtccactgggctctactttgttttccccactctgtttcatggcattgaatttctcaaggtagtaagctgggggcaatcttagggctcactttgtttactttcccatttctcagggatcactgtcctttgcttcctgatgtctagtgtattgcaaattgatatttcatataatttgttcattttaaacattgtatgagaaagcaggataaatttgatccctattaattcattttgtctggaagcagaagtcccaggcaaacattttaatatttctgtcttacttttgagagtaattgtagacatcattcttctttacccctaaatacttcagtttgtgctttctaagaacaaaaacattctcagctgggtatggtggctcacgcctgtaatcccagcactttgggacgccgaggcatgtggatcacttgaggtcaggagttcaagaccacactgggtaacatggcaaaaccccatctctactactaaaaatagaaaacttagctgggtatggtggcgcatgcctgtagtcccagctacttgggagactgaagcacaagaattgcttgaacacgggaggtggaggttgcagtgaaccgaaatcatgcccactacactgcagcctgggtgacaaagtgagactctttcaaaaaaacaaaaaaatggacaaagacattctcttatataaccccagtacagttgtcaaaatcaagatatgtagtgttgatacagtactattatttaatcttcagttcatactcaaattttatcagttgtcttaataatattctttatagctattttccccctcaggccactaactaacctaggatcacacgttctatttacttgtcttgttcaagagtctcttttgatttggaacagttcctcagcctttctttcgcttgactttgacattttaaaagagtatatagcaattttttattttatgagacatatcttcatttgggttttctgatgtttcctcaggattaaattaggattatacattatgtccttttaaatacttcgtatcataagacatttgatactgggttttccaaatattggaaaagtttattttgatcccttggttcatctaatgtccaccatgtttctcctttgtaatttttcccattttaattaataagtaatttttggcaagttacctcgagactgtaaagatctactttcttatgaaaattttaccctccaattttggcatccagtgatgatattctaactctcgttattctttcgatattaggtagttggcattctactttttttttctttctttctttaaatatggactcacacttctaaaaaaatacagatttggaggtttcctttctagggctccctactttttgggattttccgtcactttccagcagccctcccatttctgtagcattctgtcctttgattcctcaaatcagaagactgccatcttctgctttatattttaccaccctgccagtaaatagcttcaataaactgaggatagggaagagaggagggagctaaatgaaatagattgtctcctcttaatctttcttgtacagaaattctagagttcgcaccttgtgttttcgtttgtttgatagtttatttctgccaaatctttatgacctttggtctaataaatggttataaaatcttttcaaatatatttttatgttctgaataaaaaatgtattaaatgaagggaagtagctaatgtaaaggcaaattaagtgaaccccaaagtacatactatatctgcagcactgtccaagggagaagatggccaacagcaaaaacaagtatttcaagatataatagcagatattttcttgtgtgggagatggattcaactatagttttctgacactgcctgttaaaatatataggtacgatgtaggaatctgtttcttatttttttatgtatgtatgtatgtataagatggaatctcactctgttacccaggctggagtgcagtggcgtgatcttggctcactgcaccctccgcctcctggttcaagcgattctcatgcctcagcctcccaagtagctgggattacaggcacccgacaccacggctggctaattttttgtgtttttagtagagatgggtttagctatgttggccaggctggtctcaaactcctgacctcaggtgatccacctgccttggcctcccaaagtgctgggattacaggcatgagccaccacgcctggccagaatcttttttttatactgagcattggtgaagcctctggtaaaatattatattccattttgaaaatcagtttgaggtgaatagcaaaatgaataaaaccttgggaaataggttttgtgttgagaggctaatccatctaggcttatgtacctttggaggtgacaaaaccaatttagttctgaatagtcttcaaattgtcaaggaactatttttgaaaattgagtaaatattcttgccctttaataacatcactctatcaaaggggtaacatttaaattatagtaagaaagcattcacttgaatattaaaaatacttttttgaataagaggtttgaaatacagttggccctttagattcacaagttccatgtttgcagattcaaccaatcgtggatcgaaaatattccatggaaaaacccgcaataaaaaataacaatacaacaataaaaatataacaattattttcataacatttacactatactaggtattataggtaatttagagatgatttagtgtatacaagaagatgcacaaatactacactatttgatcacatgcaaatactatactcttttatatcagactggaacatctttggattttagtatgtgcaggagtcctggaaccaatcttgagagtataccaaaggatgactataccttgtgatatggtttggctgtgtccccacccaaacctcatcttgaattgtaactcctacaattcccacctgttgtgggaggggcctggtgggaagtaattgaatcatgggggtgagtctttcccttgctattcttgtaatagtgaataagtctcatgagatctgatggttttaaaaatgggagtttccggggccgagtgtggtggctcacacctgtaatcccagcactttgggaggctgaggtaggtggatcacgaggtcaggatatcgagaccatcctagctaacgtggtgagaccctgtctctactaaaaatgcaaaaaattatctgggcgtggtggtgggtgcctgtagtcccagctactcgggaggctgaggcagaagaatggcttgaacctgggaggtggagcttgcagtgagccgagatcgcaccactgcactccagcctggacaacagagcgagactctgtctcaaaaaaaaaaaaaatgggagtttccctgcacaagctctctcttctcttgtctgctgccatgtgagacatgtctttcaccttttgctatgattgtaaggcctccccggccatgtggaactgtaagttgattaaacctctttcttttgtaaattgcccagtctcaggcatgtctgtatcagcagcgtgaaaattgactaatacacctcgttaataaagatagtggtatttccattttgaaagtttttttttttttttgagacagagtcttactctgtaatcgaggctggagtgcagtggcactgtgttggcccactgcaatctccgtctcctgggttcaagcaattctcctgcctcagcctcctgagtagatgggattacaagtgcccaccaccaaacctggctagttgttttttgttttttggttttttttaaatatttttagtagagacaggtttcaccatgttggccaggctggcctcgaactcctgacctcaggtgatccacccacctcggcctcccaaagtattgggattacaggcatgagccactgcgcccggccaagattttttttaaaataaaggaatgcagcttgcagctgtttttcttaaatgatttgaatgaagcctggctttgaggtgggagcagtgactaattttcaaggttcttttaattttatgattccacgctaaggtaaaataaagcatgtcttgaaataatgtcacaatttgttgaagaagaagcaaatttgataagaaataaatcggtggccttcaatcctttaattgggcttttttgttgttttgagacaaggtcttactctgtcacccaggcaggagtgcagtcgcgccactatggctggctttgtgagtgtgtgcatgcgtgtgtgtgtgtgtagagatgggggtctatgttgtttaggttatgttgcttaggttatgttgcttaggttggtctcgagctcttcagctcaagcaattcttcggcctctcccaaagtgctgggattataggtgtgagctgcagtgcccagccccctaattaagctttagaaaaagtttgcaaaaatgttttaaataataatggtttttaggaataatagacaatacggactaccatcaccatttatttgacctctaaagtgcattttattttaaaaaatattcattgtttttatttaaaaaattttaaggccgggtgcagtggctcacacctgtaatcccagcactttggaaggccgaggcgggtggatcacttgaggtctggagttcaagaccagcctggccaatatggtgaaatcccatctctgctaaaaatacaaaaattagtgtacggtgatggcacgtgcctgtaatcgcagctactcgggaggctgaggcagaagaatcgctcgaacccaggaggcggaggttgcagtgagccgatatcgcgccactgtactccagcctgaataatggagcaagactctgtctcaaaaaaaaaaattaaaatataatttttaactaattttagaattacaaaaaaaaaggtgcagagttcttttatgatcctcatcttgcctttcctaatattaacatcttatgtaacaataatgcagttatcaggaacagtaaattaacattcttatagtattattaagtaacttaagacattccaaactgaaagaaaatacagagaaaatataagaaacccatgtagatttagcagatgtaaacatttttatcatatttgcttttaattatttgaaaaaataaaaaattactcataaagttgaaagctttcctgcacccaacattttccccctaattccttgctttgaggtaaccactatcctgaatttgtatgtatcctccctatccacgtttgtattcttttgctccattagcacatatacccaaagattaaggaataacaatacatagaatatgtttttattttgtgttttatttttaaaattaactttgtgtttaattttgtcttttaattatactatctaaaaaactgcagttatcctttctaatttgattttttaaattcatctttactttcaagatttatctatctgatggacataggtctatttagttgctgtataatatggatatatattcagacttttacctatgagcatttagattatttatcatttttccattattataaacaattttaaacgatgctgcaatctgcatctttgtatctgtctccttaggagttctctagggcaaatacctagaagtagagctaatgggtcataagggataatcattttatgtctgctaagcactgactaagtgctctacaatgtgattttaccaattcacatgccccaaagcagtgtagaagagttccagtttgtcccagcttgctttgaaatgcttaataccttgtaaatagtcaataagtagcaattagtttttttattattattggacccaagttgatgttattttactatcttaaaaattttactagtaaacaataagggaagacttagagaagtaatttgtgtatttatctgttatgaacttagtttgtcattgtcttctagctttactgtcttattgtaatgtacttttccctcctcatgtcgtagatgaataaaatcaagggtagttccagttatatttcttttttctataacagctttatacaccatacaatttacacaccatacaattcacccatttagcctgagtgaattgtataattcacagtttttagtttattcaacggtttttagttgaatataatccaacggttttttagtttattcatagacttgcgcaaccatcaccacaattaattttagaacatcttcctcaccccaaaatgaaactttatactcattagttgtcaccctccatttccccagttctaggaaaccacaaacctattttctgtctgtatagatttgcctgaaattctggacatttcatataaatggaatcataaaatatgagatcttttgtaactggcttctttttacttgttgttttcaaagttcatccatgttgtagcatgtgtcagtactccattactttttatggtcaaataatattctattatgtggatatacattttatttgttcattcatcagttgatggactgggttgtttctccttttcagctattgtggaaaatgctatggtggacattcatgtgggagtttttgtgtggatgtgtgttttcatttctcttgagtatatacctaggggtagaattgctggcccatagataaccctgtgttaacctttgagaaactgccaggctgttttccaaagtggctgcactattttacattaccaccagaaatttctccacatcatggccaccagcaatctctctgtgtcatggccaacatgttttattgtatgtcttgttagttataatctttctagtaggagtaatgtgatacctaactgtggttttgacttgcagctcactgatagctagttatattgagcattttaaaatttattcattgtctatttgtatatcatttttcaagaaatatgtaaggtacttttacttgattagattgtatttcttgtattacatttatataaaaagttatataaaatgaacacaactttatgaaaaaccaagtagtcactcggactatattaattattcaagtatttattcaatagatatgctgcataatggaaaataagtggattttgtagtcacgcaaaccttgcatcctgctcttgccgtctgtttgttggtatttggggctgaacaccaaagctctttgagtttgttggattataatgttatgacatgatgtgtgaggtttttggtacagtgctaagcacctggtaaggaggcatattaataatttggagctattattaactgtgtgttagtcacatactaggttttgagaagaaaaaatatggtggaatcatagaagcagcaaccaatttttcatggagaagcgtccaagcataacttcattagggtgtgatgttttatcaaggatctgaaagttgaatagggatttggataaatgacagatgcctgctcaagaagaaggcagtgcatgtataatgatatggaaaaggtgagaaagaaaatggcctcatttggggaactaaatggtcagtatttttagaggggaaagagtgggtaaagaattataggatatatgactggacagtagaaattcattaattgattcattcattcaccccatatgtattgaactgataatatgtcatggtgctgttatcttctaggtaccagtatgaagtaagttaaagaatgagcttactgggtttgaggaaaagaagtgacatgtagtgaacaaaggggaggatgatatgcaataatgttagagaggttgcagaggccagtacatgacataatataaagtaaaacaagcaaacaaagttatagaataaatcatacaacatttcttttatgttaaaacaaactcaacaaaactaataaaaaaagaaatttagcttttaattactttacataatgggtggcattggagaaatttaaacagaaaagtgacatgatcagattcgaaaaatgttcctggcaggggtgtggagaatagattttgtgtgtgtgtgtgtgattaagtgctaatgtatgcaaagcagtgaaaaatgggtggaaaaaattcaatggctcttttctttctagttcagaaaggcttttaagagccatttgaattaacatttcactttcttttttcttttatcccaaagaattggatgccaggcaaaaattattgagttctgatgttgggagatggggagtttttgatgagtgaggtagaactttgatgagtgaggtagagaggagatttggggaataaagagagtgaaaactccatttagaaacttatttattagaagtttttcctcttttttggttaaaatttcatggtggattattttgagatgatatctactaaatcagctatcttttgtaccctaccccactacaaatttgtcaaaaactagcatctttaaaaattttattcttatttcataagttctctacaccttaataataggccaatgttaaagtaatgctgatagaaataattctaaaaagtctttctagactaagagaaaacaatatttgagtattttacccacctctcgcaaaatctcttctcaactttcatgcagttttagtgatctcattcattttcgtggttttaagtaccatctatagttaagtatatacagctttaagaattatctatatccaaatatacatctctagccctgagacctcccctaaattctctatttgtatatccgtttgcttaattgacatctccatgcatctcaaccttaatatgtccaaaaccaaattcccaatttttccctcaaacctgctgtttctgcagtttttctcatttcagattttctctatgtggcaattatgtttgcctgttacaaaaaatgcaaaagtggtttcagttagaaaactaatatcaggaaattggcatggggaaattaatatatattaggttcagctcccacagaatatttaatcatttcctctgttaccttgttttacattggtattttttgtttgcttgtgtctcatatctttggtcctgtcttatggttagtttacacatagcatgggctaaattagcaaaacacacatacttaaaagtacaattaagatggaagaagacaaattacagtttttgaaaaggcatatgaaatgaagtatttaggggattctgcctaccagcatatttctctggagttatctatttaagtgtccttataggtttggagagcctgaaagacatacttaaaatgatacaatatggcatcaaaagttcccttgaaagataaacatttattccttccttttaccaattataaaggctattgagaaaccaaagcctatgagacatataatgtttatatggctgcagcggaaagactggaaaaagtaatagggaaattattaaaaaataattttgaggctgtagaaatacttatctcctccaagaaataccttgaaactgcatttattcattcattgagacactcaacaaacatttactgagtgcttactacgtgtaagttgttgggattatacaactgaataagtgataaaaatctcacctcttaactttcactcaagagaaacttgattatgaataagtaaacaaataagtacacaattttactgtgtgatatgcatctggggtagagaggaacagtaactacatcaagtagtagaaaagtctgttgagataactttttaaaagattctgaagaatgaggagtcaacaaagaataacaatggcatgtgttctaagcaaagaaaaaaacatgtgtaaatgagatgggacagagcttggcttatttgagaatatttgctacaagagtctgaaaacacgctcttttttgcccctgcttattttggctctcttattctttgaacccccttgcctgtctgttcattttgaaaaactgctaactgggagctttatttacattgggtagggttggttatggagggcttctattagggtgattggatattggttgacttttttcctgagagagcaaaaaagtttataggtcttgtctgtgagaccatccagtttctccaaagaataatccagtagtgtcctgcttggttttaaatgttccgaaagtaagatgggaaaggagggtgggagtgttccaagtaggcacattgtcattgttttcagccttgggcttcacctttgccttatactgggttgggtgtccttgaaactgagcctctctaattctgtttttgcagagaataaaactggggtcagggctgggagagagagcagttgtctaggtttgtaggggtaccaagtcttttgtatataggccttgaaccaatctctgttttcagtcttatatctcagcccttcaatggtggttaattcttgattttccgtctttttttttttttaacaaagataattttattgttatttaaattaacttcgccttcattcagaaatagaaaactaatgttgataataatagttgcaattatcagctactataatgataactgaaattatctactgaaatgataaaaatgttattggagtagacaaaattttattaaatttaagacagattagtaaatataattttaaaaacttcatgaagtgtattctggtacaccttaattgttaagtgatagttgttagaatgcctactttcttaaaatactacctataaaacagaaaagatagaggtacatagtatgtaatactttctaattttgtttgtgaactcttgattattcaaatagaactattgttcatattttctatatcagatatgttactagctctgtattttattaactttcttttaaaacttctgcaatttagtaatttaattttaatgctgtactgttatttagtgttggcttcttctgattaaatgttcagtagtatgatggtaaacaatatcatatacaaaacataggggagaaaggatttcttttctcacccatctaagggttcatggctgacacccctaataacaaaagaccaattaacaaaagaaagcatacaagtttaatatatttttaaaatttttatttattttttatttttgtaggtacatagtaggtatatatatttatggggtacatgagatgttttgatacagacaggcaatgcatattaatcacatcattaatataagttttatgcgacactggagccttcagaaatgatgacccaaagaaacagggaaaactgtacattttatgataagtctgatgaagaagcagataattgtggagaaacgtgattggacaaaaggggagtgatccaatggtaataaactggggggaactcagcaaggcctgtttatccagattcttctttgtgtctgtcttcacagttaaggacattcctttactctgagtataaggaggaccctctggaagaagggtctaatagctgattttcagggaaaggtcagttaggttttatgacctgcttcagtagagaaggggcaagggaaattctttctagtttctgtggactggtttaggagagaggagatcagagagatcttcctgtttctgcagttttctcaatttccttcaagtaaaaatactcagtgtgcctaggtactgtattttgggatagcatgtcctgaaccccatcaatgtaaatttattttcaatttcatgtttgactatttcttcctattgatcctttttctcctaatggcatttcctcatttcctcaacttttttctgtagtatttttgtgtggtccttaattaagtctagtgagaaagcaagccttgatttccatacaagggttgacttaatacagactgaatatgccctttggtcttctcccagataaacgctctagaaagtcatcatcattgccagacagcaaggtactttgttgtgtatcagggtccccaggaaaattcaaacatgcaaaataaattcttaaatggtttgcagagaaaagtaagcaacttgagtgtagcatgtaaactgaggagccattttggtgcttggcagttaagtacttcttgaaggtccccctggtttttccttgaagtcttttaaatctgatccttcagcatgtaagtacttttacttttcaatagagttgtagaagaataatgattatattcatgagtttgaatgtttattaaataaaaaaagactaaaaatggtaacactttcttagtgaaccttttttgttggaaacagaggcaacaattgaatccatgttgaaataatggtttttgagcttttaaagtgaacctgttgtattatttgtcctgtttcacaaatgatttcttaaaacaaggaaaatgtaataaaactttctttaacttttttttttttttttttttttgagatggagtctcactctgttgcgcaggctggaatgcaatagtgcaatcttggctcacagcaactgctgcctcccaggtttgagtgattctcctgcctcagcctctcaagtagctgagactataggcacacaccaccacatctggctaatttttgtatttttagtagagacgggctttcaccatgttggccaggctggtcttgaactcctgacctcaggtgatccacctgtctcagcctcccaaagtgctgggattataggtgtgagccgtgcctggccttctttattaacttaatcatgattagacttttgattatgtttttttactttccaaacttagctttttttctacaagtttggctttaaattaaataatttttttcaaatactgttttgagtcatactggcatttttgtttttttttttttgagaccgagtcttgctctgtagcccaggctggagtgcagtggcatgagcttggctcactgcaagcgccacctcctgggttcaggccattctcctgcctcagcctcccaagtagctgggactacaggcacccgccaccacgcccggcttattttttgtatttttagtagagacggggtttcaccatgttagccacgatggtctcgatctcttgacctcacgatccgcctgcctcggcctcccaaagtgctgggattaccatactggcattttgactcatacctgcatttagctgaatttgtttatctgcttttattctaaattttagtttatctgtataccaaataatatatttgtaaccctagccacttggagggctgaggtgggaggatcccttgaggccgggagtttgaggctgcaatgagtaatgatcatgccttggcactccagcctgggtgacagagtgagacccagtctctaaaaaaaaataataataataataaaataaaattaagtgattgattcaacttcctaatttgatgtcaaatgatagaataaaaataaaaatagaaaaatagaaaatttattcaattatgttgctattgagtacatttatataaccgtaacaagttgctaatattttgaagtggcatttttatagttcaagtctcttttaggtagtgttggtattttttctatccttttacttctaacccttttctattatttatcataggcatgcctctattaaatagcaaatcactaggaggtttatttcttcatcctttttgacaacctcaatctttcagctgtaaagtttgttctgtttctgtttagtgtgatttttgatgtatttgagtaggcttttgtaatcttgtgtagagctgtttatcctgtttaatatataatgtgccttctttatctgtgggctcatatctttcatcaatactagatgttttgcagcattagatttacaaatgtaacttctcagttctttctgttttctcctgggtctcttttgacatatgtttgactttctcatttatcctccagttctcttaaactttttgttttgttttgtttttaataagctttacttgtcactctatgcagcagtctgggtaattttttcatatctacaagttcttaagtatctctttagctgtgattaatctgccacttaactccactaaatttttgttttaaaattatacatttttttgaaagtgttgtttttatcttcctatccatttttgacaattttttttgcttttaaaatattttaagtatttttaaattttttatattttgcttttactttcattttttcccccaagtgtccagttcccctatgtaaaataaaaagaagataaatctaaacttgattttagccaaaaggctgagaagtgataaaagtaggctaatttagaagcacaacttagtccaggcaccatggctcacacctgtaatcccagcactttgggaggccaaggtgggtggatcacctgaggtcaggagttcgagaccagcctggccaacatggcaaaatcctgtctctactaaaaattaaaaaaaaaaaaaaaaaattagccaggcatggtggcaggtgcctgtaatcccagctacttgggaggccgaggcaggagaattgcttgaacttgggaggcggaagttgcagtgagccaagattgcaccattgcactctagcctgggagacaagagcgaaactcagtctcaaaaaaaaaaaaagtctgtgtgcggtggctcacgcctgtaatcccagcactttgggaggccgaggcgggcggatcacgaggtcaggagatcgagaccatggtgaaatcccgtctctactaaaaatacaaaaaattagccaggcgcggtggtgggcgcctgtagtcccagctactcgggaggctgaggcaggagaatggcgtgaacccaggaggcggagcttgcagtgagccgacatcgcgccactgcactcaagcctgggggacagagtgagactccgtctcaaaaaaaaaaaaaagaagcagcactacttgaagtcatgcaatacatttgtctttcttcttttaggtttagtttatttgttcttaataataagataataatgtcctaggaaggtataactaataatggctaaattgcaccaaggacagaaagaccagttaggaagtatgacataaataccatactgtagaatttgagagtgggaaatttacgttaagcaggaacatcacaaagacaagtctggactattctacgtgaaagccaagagggagtagtcaaaaataacactgggtttcaacttgtaggatgagaatgatttcttgcatttacaggtatggaaaagatgaggttattggcttcagaatatgagagtgatggtaggatgttaggatagaaaaatccattaggtaggaaaaaatgcaggtctgtcattcaaaaagtaaaactttatatattggccgggcacagtggctcacgcatgtaatcccagcagtttgggaggctgaggctggcggatcacctgaggtcaggagttcaagaccagccttgccaacgtggcaaaaccccgtctctaaatacacgaaaatacgaaatttttaaatacactaaaaatacaaaaattagctggacatggtgccgtgcgcctgtaatcccagctacttgggaggttgaagcaggagaatcgcttgaacctgggaggtagaggttgcagtgagctgagattgcaccattgcactccagcctgggcgaccagagcaaaactccatctcaaaaaaaacaaaacaaacaaacaaaaaatctgtgtatatcactaggagaaggagagttgaaaccaagggagtaaaaaattatacagcggaattaaattcaaaagggaaaagacaaagtcctaggctgttaagaatgaaatataatcaaaattaggtcctagaaattgatgtagagtccactgatcaaggaaaacaacataattaaaaagccaggataaataagatcaggaaacaatggctaaatttattgaaatggtaagttttattatttttaaaatagaattgaggtttttgtctgtgtgtacttttttttctaaacagaccatttttgccttatagatgcaactttaatgcttctttgatccattactatgtttcagaatatactgtcataggatcattagtgagatgttctcagagctttaatctgaaatgcagcagtaatggaaatgacgccaccccgaactatgctcatttagcctttaaaggtacaatccatttacttccaagagtcttgatgtagtaagatcaagagactttgttaactttgtgtacttattttccaatgtccattgacaatacaataaaacagttttttaaagtcccaatttacaaacagtacatttggttgataggtggatgagtttgagcacacttaatctttatatataagtttgattttctaactaaaactgtccatttaattgcctacttcttgagttctgtagtagatcttttggggaacagagggtttcagaaaagctttgatttgttctcttttcatgatccgtacttcaaagtggaattttccttgcttgattacacttagaggaagaggggtggtgaggaagggttaaaatcaaagtaagctatgcttcaaggaaaaagaaaagaaaaagtagtcgcagcctggagaataaatttgacctctttagttttatattgttgcagctaaaacctgtgatgaggtcattcttagtgaactacttataactacttagttcttataaatgctgccaatgttttttttaatcgtgatatttaagaaagaaaaaaattaagataaatagtcaatacatattgatgagttatatgaatttgtttattcttggtattgcttcttagttgtaaaatgtgaaatggttccaaagaatgggcttttagttctgttttttgaagtagcagctattaaagtgcaaaatgcatagtaggcaaaatggtgttgatagtttacattctgtattttgtgattaaaattagacagcaatccaaaaagagaatataacttcaagtacattcatgtcatacttttgtttattctttaatgtttttcatcctagtatgaatttgagattagttttactggcattaaaaaaaagaagaaaatattttatcttaatagcttttacacaggcttttgctgttaattgctattgattatcagctgatggtattgaagatttacatctaaaatgctaaattatagatattaaaggggaatagaataattgtttttaatattaagtaagttaccatctactacattagttgggttttatccaaattttgttaccttattactattaatgaaaattggggaacctaagctgaactttattcttagtccagtaagtcactcaatttatttgatacttacttagaggaatttttaaaatttatatataccttttatttcaatagcttttgaagtacaagtggtttttggttacatggatgaactgtatagggatgaagtctgagattttagtgcacccaccacctgaagagtgtatattgcacccaatatgtacttctttattcctcaccctcctcctatccttcccccttctgaatctccagtatccattatagcactttgtatgcctttgcatatccattgcttagctcccatttataattcagaacatacagtatttggttttccactcctgagttacttcacttagaacaatggcctccagctccatccaggttgctgcaaaagacattattttgttctttgttatggctgaatagtattccagcgtgtgtgtgtgtgtgtatgtgtatatatcgcattttcttaatccattcatcgtttgatgggaacttagaacttaggcttgttccatatctttgcaattctgaattgtgctgcaataagcatatgaatgcaggtgtatttttgatattatgacttcttttcctttgggtagatacccagtagtgggattgctggatcaaataataaatttatttttagttatttgagaaatttccatactgctttccatagagtttgtagtaatttacattctcactagtaatgtataagtgttcccttttcttgtttttttttaattttttaatttttttatttatttttattttttgagacgtagtctcgctctgtcaccaggctggagtgcagtggcatgatattggctcactgcaacctccgcctcctgggttcaagcgattctcctgccttagcctcctgagtagctgggattacaggcatgcgccaccacacccaactaatttttgtatttttagtagcaacagggtttcaccctgttggccaggatggtcctgacctcgtgatccgcccgccttggactcccaaagtgctgggattacaggcgtgagccgccaagcctggcaaagtgttcccttttcatcacacccacaccaacctctattgtttcttgactcgttaatagtggccattctggctggggtaaagtgttatctcattgtgattttaatttgctgatcttcaatttcctgttgattagtgatgttgagcagttttttcatatattttttggccatttgtatatcttcttttgagaactacctattcgtgtcatttgcccaccttttaatgggatttttttttcttgctgatttgttttgagttccttgtagattctggatattagttgtttgtgggatgcacagtttgcaaatattttctcccactttgtgggttgtctgtttgctctgataattgcttcttttgctgtgcagaatctttttaacaaggtcccatttatttatttttgtttttgttgcattagcttttgtggtcttattcataaattatttgcctaggccaattttcataagagtttttcctaggttttcttctagaaattttatagtttcaagtcttagatttaagtcttcaatccatcttgagttgatttttttatgtagtgagagatatggatccagtttcattcttctacacgtggctatccagttttccaagcaccatttatgttatcatatgctttgttgaagagcagttggttttaagtatttggctttatttctgggttctctattctgttccattggtctacatatctacttttataccaataccatgctgtttttgttactgtagtcttgtagtataatttgaagctgggtaatatgatgcttccagatttgtttattgaagagcctttattcaagccatcttaagtaaatgtgaaggaaaaaattctaagagcagtgagaccaaagcatcaaggtaacctataaaggaaaacctatcagactaacagcagacttctcagcagaaaccttgcaagccagaagggattggggtcctatctttagcctcattaaatagagtaactgtcagccatgaattttgtatccagcaaaactaagtttcataaatgaaggagaaataaagtctttttcagacaagcaaatgctgagggcatttgtcactattagatcagacatataagaaatactaaaaggagttctaaatcttgaagcaaaaggttgatatgcaagagaatggaacctcttgaaagcataaaactcacagagactctaaaataacacaatgaaaaaaacaaagtatcttgataacagtcaacgtggtgactaatacagtacctcatatctcaatattaacattgaatgtaaatgttctaaatgctccacttaaaagatacacacattggcagactggattaaaaatcacaaagcaaacatctgcttttttcaagagactcatttaacatgtaagaattcttacagactcgaggtaaaggagtagaacatgtttttttttctttaaatggcctattgatttttttcttcctataattatccatcctcctattattgtcagtatgctcttttgtcctttaaacaatgttcaaactttagactagaattcaaaaatactttaccatttgactctaagtctacctttctagctttttttccagctacatctaatactttatattgtcttcaaagggcattcctttttctttcttttcctttttaagaaattcagaggccgggcgcagtggtcacgcctgtaatcccagcactttgggaggccaaggcagatggatcacctgaggttgggagtttcagaccagcctgaccaacatggagaaaccacgtctctactaaaaatacaaaattagcctagtgtggtgatgcatgcctgtaacccaggctactcatgaggctgaggcaggagaatcacttgaacccagggggcggaggttgcggtgagctgagattgtgctattgtactccagcctggacaacaagagtgaaactccgtctgaaaaaaaaaattcagatcgaatttatataccataaaattcacctttcaaaagtgtacaattcagtggtttcagtattgatatggttaggctttgtgtccccaaccaagtctcatcttaaattgtaatccccataatccccatgtgtcaagggagagaccaggtggaggtaattgaatcatggggttggtttcccccatactgttctcatgatagtgagtaagttctcacaagatctgatggttttattacgtataaggggcttttcaccctttgcttggcacttcttcctgctgccttgagaagaagataccttgctttcccttcaccttctgtcatgattgtaagtttcctgaggcctccccagccatgctgaattctgagtcaattaaacctctttccgttataaattacccagtattgggtatttccttatagcaatgtgagaatggactaatgtaagtatattcgcaaagatgtacaaccatcaccactatctaaatttcagaacatttccattaccccaaaaagaaaccttgtgcccatttgttgtcattctccattctctccagccctaggtaaccactaatttacattatttctctatcaatttgcatattgtggacatttcctttaaatggaaccacacaatatgtggccttttgtgtttgacctctttcttgtagcataatgttttcaagattcatttatatggtagcataaatcagtacttcatccctttttatgcctgaataatatcccattgtatggatataccacattttattttattcattgatttattcattaattcaaaaatatttttctttttaaaattttttctatatttattttagattcaggagttgcatgtgcagatttgttgcctgagtatattgtgtgatgctgaggtttggggtacaaatgattctgtcacccaagtagtgaacatagtgtccaatagttagtttttcaaccctttctcccctccttccttctgtcctgtagtagttctcaatttctattgttgccgtctttatgtctataaatacccaatatttagctcccacctataagtgagaacatgtggtgtttagttttgtgttcctgcattaatttgcttaggatactgacctctagttgcattcatgttgctgcaaaggacatgattttatttttttgttatggccatgtagtatcccatagtgtatatttaccacattttctttatccagtccccattgatgggcacctagttgataacatgtctttgctattgtgaatagtgcggtgatgaacaggagattacgtgtgtctttttggtagaaaggtttgttttcttttggatatatacctataagtgggattgctgggtcaaatggtaattcggtttcaagttctttgaaaaatctccgaactgctttccacactggctgaacaaatttacattcccaccagcagagtagaagcattctcatttctccacagcatgccagcatttgttgttttggtttttttaaataatagccattctgactagtgtgagatggtatttcattgtggttttgatttacatttttctgatgattagtgatgtttagcattttttcatatgtttgttggccacttgtatgtcctcttttgagaagtgtctgttcatgtttttgcccattttaaaatgctgttatttattttcttgttgagttgtttaagttcctggtagattctggatattagacctgtcttggatgcatagtttgcaaatattttcttccattctcccattttttaaagttattaaattatttattgtactgcgtttaaaaaaaacccagacaattattattaagctcaataaatgtacatggggtacttggaagattaagttctacagctgcctatttccacatcttttaattcatctgactctgtaaacaatagggaaaaagcccctatttggcagaggagtgttttaaatctgttgatagttttttttgctgtttgtttgaaagctcattagtttaactaggtcctaactgacaatttttgtttttgttgcaattgcttctgaggacttagtcataaattacttcccaaggccaatgtccagaatggtgtttcccaggttttctactaggattcttataatttgaggtcttacatttaaaattttaatccatcttgagttaatttttatatatagtaaaaggtgggtgcccagtttcattttgaatatagctagccagctgtcctagcaccatttattgaatagggagtccttttcccattgcttattttcattgattttgttgacgatcaggtggttgtaggtgtgcagctttatttctaggttctctattctattccattgatctaggtgtttctgtaccagtaccatactgtttggttactgtagccttatagtatagtttgaagccaggtaatgtgatgactccagctttgttctttttgcttagcattgctttggctatttgggccctttttggatccatatgaattttagaatagttttttctagttctgtgaaaaatgacattggtagtttgataggaatagcattgaatccatagattgctttgggcagtatggccattttaagaatattgattcttccaatttatgattatggaatatttcccatttgtgtcatctatgatttatttaatggtgttttataattgtccttgtaaagatcttttacctccttgtttagatgtattcctaggtattttatttttgtgcatgtggctattgtaagtgggattgcattgttgatttggctctcagcttgaatgttattggtgtctaaaaatgctaggggtttttgtatattgattttgtatcctgaaactttactgaaattgtttatcggttccagaaaccttttggcagtcttcagagttttctaaatataggattatatcatcctatgcgcagagatagtttgccttcttcttttgctatttggatgccttttatttatttttcttgcctgattgctctggctagctcttccaatactatgttgaataggaatggtgagagtggtcatccttgtcttattccagttctcaaggggaatgcttccagtgtttgcccattcagtgtgatgttggctgtgggtttgtcatagatggctcttattattttgagatttattccttcaatgcctagttttctgaaggtttttgtcataaagggatgttggattttatagaaagctttttctgtgtctattgagataatcatatggtttttgtttttaattctgtttatgtggtgaatcacatttattgatttgtgtatgttgaaccaaccttgcatcccaagaacaaaacctcctttatcatggtgaattaactttttgttatgctgttgaattcagttttctagtattttgttgaggatttttgctcctgtgttaatcagggatattggtctgtagttttctttttttgttgtttctttaccaggttttggtattacagtgatgctggctttgtagagttagggaggagtccctcctccttgagtttttggaataatttcagtagaattgggatataccacattttatattattttattttattttattttgttgttgttgttggtttttttttttttttttaaatggagtcttgctctgttgcccaggctggagtgcagtggtgtgagctctgtgatctccgctcactgcaacctccgcctcctgggctcaagtgattctcttgccacagcctcccaccaggctgagattacaggtgcctgctgccatgcctggctaatttttggggatataccacatgttagttattccttcatcccttgacagatttttggattgatgcctcctttgggccattatgaataatgctgctattaatagtcatacaagtttttgtgtggacatatattttcaattctcatggatatatacttaggaatggaagtgctgggtcatatggtgattctatgtttaaccttttgaagaacttaaaaattattttccaaagtgactgcattattttacatttccatcttcagtgtctaagtgttccagtttcttcacatcatcaccaacacttgttattgtgtctttaaaaaaaacaaaaacaaaaacaggcttgatttactttatttttcttgtataaaccctacattgtagtcacagctggagcctgggtcctctgcatggagactctggagtgggtcttgatggggtggtcagtgaattcctgatagggagacttggtgaatacagtctccttccggaggtcaggggtcaggtggctgtaggtcttagagatgtcattgaagttggccttggcgaaattgcccagggtggccatgcagcccctggctgaagtgtagcagtcatcgataccagccgtcatcagcagcttcttgggcatgggggctgagatgatcccagtgcccctgggcacagggatgaggtcaccagcacagagctgcagtggcctgtcaccttgcaagggatggtgtggggcttgctgatcttgttcccccagtagcctgtgcacacagggacaatggagagcttggctgggatgatggcctcgtgtatggcagtggccacctccttggagcacttagcacccagacctacctggccattatagtccccagtggcaacaaatgccttgaacctggtgttctggccagcgtaggtctgcttctgcactgacataatcttcaaaacctcatccttgagagagcccccgaaaaaaatcagtgatctcagactccttgatgggcaggaagaagagatagatctcctccagggacttcatcttcatgtccttgactagctggcccagattggtgacaggcatccactcctagtccaaggccttgcctctgtgagctccgtggcttcagccctggccctgaccatggccatgaccttggcctcagatgccactgccgaagcctccacagaagccactgcggtttcccatccctgggcccccgggatgcacccttgcactggcatcatccgccatttggtattttctcagagaaggttattgtgtcttttttgttatagccatcctagtgggttcgaagtggtattttactgtggtttttatttgattttcacaaatgactaatgatgttgacgatctttttatgtgcttattggccatgtgtatatcttctttggagaaatgtctattaagatcctttactcatttcttgattgagttatttgcctttttattgttcacttgtaatagttttttaaataaatttgaatattagacttatcatatatgattcgcaaatatttttcctcatactctatattgacttttaactttgttgatagtgtgttttgaagcgtgaaaggttttattttcaatgaattccaatttacctgtttttttctttcattacttgtgcctttagtgtcatatctcagaaatcattgcttaatacaaggtcataaagatttactcctatgtttttttctaagatttttgtagttttagcccttacatttaggtctttgggttcgttttgaattaacgtttgcatatgatgtgagatggagacaaagagtgcttgttgtccttctgtatacaaaacacattttcacaatttgtcctgttacttaaaagtgttcctgtacttgagctagtcttcccctattctaaatcactaccaaattatattttttaatgttctagctcaaatgcccagaaattcctttaaaacttctttcctttattgccaagaaaccaagaatgatcttacctctcatatggctttatatatatccttcttacagcacttttgtcactttccatctaatattatagctgtttatgtaaatatattagcattttttccctaagataaagttcatagttttatttgttttcatcatttagtgtaggggggcaaaatctttcccttgaccttcttagagttcccagctgagtctgaaaattaaatggaataagacatgttaacaagtgaaaagcacacaaatttatttaagttttatgtcacacagaagtcttcataaggaaatgaagacacaaagaaataacaaaagtaaataaaaaataaacaatgaaaataataaaaaataattttaaaagcctgagtgtttttatactaggtttgataaagaatggaaagttgtaagaaaatgtgatagacaaaggggtatgagctaagagtagtagtaaactggggaaaacttagcaaggcctattcattcagattcctcatggattcccgcctctttcttcagagataaggatgcttttttcctctggatatagggagggcactttgtacatgagggttttatgacttccttcctaggaaaagggagtggtcagagagtacttcatgcctgctgtttctcagattcgttcagtttaacatattcaatatgccaaaggatcatattttggagcaatgtgtcctgaaccccatcattagcagttagtatatgtctgttgatttaattatgttaatagatttctggtgtagtgggggcaaaaggaaattataattgtttagagacagagtaagtttagtctaaaacaccagtagagtagcaatcttcagtgaccactgtgaatatataacatgtatattttattttattaatgtacattatattttattaatttaattgctctaaatgtgtaagaacaggatatatatttttattgtaaaatgacgttaacattatggcatcaggttacaagtgcaatttttgatgggatttgaaatggcagacattagataaaagcattcttcagggatagagaggaatgctgcattatataatttaattggccagttgggagtgattaataatattgcttatattttaagtcatattttaaatattgaatctttttacaattagatgtttacaatattattaaaagaattttccttaaaaaatccctgccatgtttgttatgagaaatgtttttggaaaatctgagtattacactgtcctactgaagaaaattgcctgggaaaactgtgattgacagcttatgttaaggtttgcaatcttgcgtaggtatcatgccaagttttcatttattcactttcttgaaagtggaaagaaatttagaaaagcataggcttaccacagagttcctttacagaaactattttcatgtgagaaggtggcccgctgagcctgttttagtctgtgattctttaagatatggaggcctgttgctaggtcttataaggccattctgagaggctagaaattgatcaaaaagacaagttcttcctttggtgttacagagaagtaaatgcagtttcatgaactttgatttttgatacgtaggttggaactgtttgttagcaaactattaagcaagctatagaggattgctaaatcttgatattcataagattaaatagtatagcaaagagtaatgaagtgcatataattagagaattgtaaagtaatattaacattttcaactacaaataattggattaaaaaactctggtatcagtattatttgaattagttatggttttcaattacttcaactgctaattttcaattatattattacttttaatttagtttcatcatttattttgtttttagttgttatttgatatcaaatatgtattttgcataagcattttgtttttgaccaaagttttctaataaccaaattgtcatatatttcctatatggatcattttattgctaatgcagatgtatgcaaaatgccatcttctccaaatttttttgtgtagtgacatgttatcagtgatgtgtgcctatgaatgtgaaaatagcttataatacactgtcaaggtaagagtaatacgattactgctttagaaatacttaaagggcattgttttggtatcaaatcatgtgtatttggtcaagtattgtgtgtgtgcgtgtgtgtgtttgtgtgcctgtgtgcatgtgtgtatgtgtgtatgcaagtgtgtatgtgttttcactaaaaaagtacttctatataatgctgtaatcctaatcctctcttccgaggactaactatgaacaggtgagactttgcattagtcttagtcattctactattacaatttaatttcttggtttttaagggcttttagtatttaacattcccattttcattttaaaaatgtatattcttccaggatatatcacatattaaggatttatagcattaaagatcttttcttgcattttgccactttactgtgtgaaattgaggcaagttactttactttgtacttaaatttctttacccataaaatggacagtataataataacctaccttaggtaatggttgtgaagatgaaataattcatgtaaatgtcttagaatggtgcctggtttaaattatgactcaataaatgatagctattattaacattagtactgtagtgggactaattgacttggtagaagacttcatgggatacatagtatggcatttctaattccctacttctttatacttaaggatatagtaaagggaactaaagagcactctagaagtttagtttgtgtcagccttttacaaaggcataatttttcaaagacctatatttaaatgttactacataatattatttaatataaatgttttcagtgactaaattgtttttctctcttcctccttccctttatacacttatctttgaataaagttgaatcagcaagaagatgcagcatgttttaacttatgtttttccctacctgtgacaacctatcaaactcccacgtcactcatactccggtttgagacatacagggaccagatagactatggggaaggattgacacaaaaatggaagacagctggagtaggaggaaaatgctgatgaaggagataataggattccattggattacagtcatttatagaaatttggctcttaaacttttccacttctaaataaagactttttattcaaaatttattaagagaaagaaagctgtataggcactatggaaaacagtatgaaggttcctcaaataataaaaaatagaactgccataggctccagcaatcccactgctaggtacatatccaaaggatatgaaatcagtatgttgaagagatacgtgcactcccatgttcactgcagcacagcaaatcaaactcactgttgaccgatggataaatagattttaaaaatatgatatatacacataatagaacactatttacccttaaaaaagaagcaggccaggctcagtggctcacacctgtaatttcagcactttgggaggctgaggtgggaggatcacttgagcccatgagttcaagaccagcctgggaaacatggcaagacccgtttctacaaaaaatgcaaaaaattagctgagcgtggtggtgtgcggctgtgctcccagctactcaggagcctgaagcaggaggattgcttgacctcaggagctcaagactgcagtgagctatgattgcaccactgccctctagcctgggtgacagaatgagttcctaaaagaaaaggaagtcctgtcatttgtgatggcatgaatgaacccggaggacattgtattaaggaagccaggcatagaaagacaaatactgcatgatctcacttatatgtagagtatatataaaaaagtcaaagtcatagaaatagagagtaaaatggtggttgccagaagttgtgggggttaggagatgttgatcataggacacaaaatttcaatttggaggaataaattcatgagatctcttgtacatcatggtggctatagttaatgataatattaatatattgcatacttgaaaattgcaatggtataaaagagagtagattttaagtgttctttccataggaaaataaatatttgaggtaatgcatatattattttgatttagctgttccataatgtatacatatatcaaaacatcaagctgtatgttataaatatatataatttttacttgccaattaaagaaagaatgctaactcttgttggctgtaacttttacccataatttattcaactgattgagttatgagtagctcaatgtaaactgttaagtataacatgattgaatttctatctaacaataatttatacatgaagaaatgttatttttcataatacattgacttttgttgcgtagttggttatctgcaagttctggtacttgagcatttgtgacatgagttaagtttgtcattggaagtcccaacttttctttttgatgtgttttcccacattttctctgctctcagtattgcccgtcttcttttctctcaagcacaagtgtttttaggaaagaatatgatgaattcaatcaaatgaagttggaaataattttgtgaaattacaaatactgtgttttttctttctagagtatgtgattttaatagcggtcaaaccttttatgtaacttatattgcatatgataaaaaactaagtctgcatctattgagataatcatgtagtttttgtctttggttctgtttatatgatggattacgtttattgatttgcatatgttgaacaagccttgcatcccagggatgaagcccacttgatcatggtgaataaactttttgatgtgctgctggattcagtttgccagtattttattgaggatttttgcatcgatgttcatcagggatattggtctaaaattctctttttttgttgtgtctctgctaggctttggtatcaggatgatgctggcctcataaaatgagttaggaggatttcttctttttctactgattggaatattgtcagaaggaatggtaccaactcctccttgtacctctggtagaattcggctgtgaatctgtctggtcctggactttttttggttggtaggctattaattattgcctcaatttcagagcctgttattggtctattcagggattcaacttcttcctgatttagtcttgggagggtgtatgtgtccaggaatttatcgatttcttctagattttctagtttatttgcatagaggtgtttatagtattctctgatggtagtgtatttctgtgggatcagtggtgatatcccctttatcattttttattgcgtctatttgattcttctctgttttctgctttattagtcttgctagcggtctatcagttttgttgatcttttaaaaaaaccagctcctgaattcattgattttttgaagggttttttatgtctctgtctccttcagttctgctctgatcttagttatttcttgccttctgctagcttttgaatgtgtttgctcttgcttctctagttcttttaatcgtgatgttagggtgtccattttagatctttcctgctttctcttgtgggcatttagtgctataaatttccctctacacactgctttaaatgtctcccagagattctggtatgttgtgtctttgttctcattggtttcaaagaacatctttatttctgccttcatttcgttatgtacccagtagtcattcaggagcaggttgttcagtttccatgtagttgagcagtttggagtgagtttcttaatcctgagttctagtttgattgcactgtggtctgagagacagtttgttataatttctgttctttttcatttgctgaggaatgctttacttccaactatgtggtcaattttggaataagtgcgatatgttgctgagaagaatgtatcttctgttgatttggggtggagagttctgtagatgtctattaggtctgcttggtgcagagctgagttcaagtcctggatatctctgttaactttctgtcttgttgatctgtctaatgttgacagtggggtgttaaagtctcccattattattgtatgggagtctaagtctctttgtatggctctaaggacttgctttatgaatctgggtgttcctgtattgggtgcatatatatttaagatagttagctcttcttgttgaattgatccctttaccattatgtgatggccttctttgtctcttttgatctttgttggtttaaagtctgttttatcagagactaggattgcaacccctgcttttttttgttttccatttgcttggtagatcttcctccatccctttattttgagcctatgtgtgtctctgcacgtaacatgggtttcctgaatacagcacactgatgggttttgactctttatccaatttgccagtctgtgtcttttaattggagcatttagcccatttacatttaaggttaatattgttatgtgtgaatttgatcctgtcattatgatgttagctggttattttgcccattagtttatgtagtttcttcctagcatcgatggtctttacaattttggcatgatttttcagtggctggtaccagttgttcctttccatgtttagtgcttctttcagaagcccttgtaaggcaggcctggtggtgacaaaatctctcagcatttgcttgtctgtaaaggattttatttctccttcacttatgaagcttagtttggctggatatgaaattctggtttgaaaattcttttctttaataatgttgattccaagtctttgctattgtgaatagtgccgcaataaacatacgtgtgcatgtgtctttatagcagcatgatttataatcctttgggtatatacccagtaatgatgatagactggattgagaaaatgtggcatatatacaccatggaatactgtgcagccataaaaaatgatgagttcatgtcctttgtagggacatggatgaagctggaaaccatcattctcagcaaactattgcaaggacaaaaaaccaaacaccgcatgttctcactcataggtgggaattggacaatgagaacacatggacacaggaaggggaacatcacacaccggggactgttgtggggtggggggagggaggagggatagcattaggagatatacctaatgctaaatgacgagttaatgggtgcagcacaccaacatggcacatgtatacatatgtaacgaacctgcacgttgtgcacatgtaccctaaaacttaaagtataataaaaaaaaaaagaacattgaatattggccccccactctcttctggcttttagagtttctgccgagagatctgctgttagtctgatgggcttccctttgtgggtaacccgacctttctctctggctgcccttaacattttttccttcatttcaactttggtgaatctgacaattttgtgtcttggagttgctcttcttaaggagtatctttgtggcattctctgtatttcctgaatttgaatgttggcttgccttgctaggttgggctggttctcctggataatatcctgaagagtattttccaacttggttccattctccctgtcactttcaggtacaccaagcagacgtagatttggtcttttcacatagtcccatatttcttggaggctttgtctgtttctttttactcttttttctctaaacttctcttctcgcttcatttcattcatgtgatcttcaatagatgcagaaaagatcttcgacaaaattcaacagcccttcatgctaaaaactctcaataaactaggtattgatgggacgtatctcaaaataataagagctatttatgacaaacccacagccaatattatactgaattctaaccagaggtacaaggaggagctggtaccattccttctgacactattccaatcaacaggaaaagaagcaatcctcccaactcattttatgaggccagtatcatcgtgataccaaagcctggcaaatacacaacaaaaaaagagaattttagaccaatatccctgatgaacatcaatgcaaaaatcctcaataaaatactggcaaacggaatccagcagcacatcaaaaagcttatccaccatgatcaagtgggcttcatccctgggatgcaaggcttgtttaacatacgcaaatcaataaacgtaatccatcatataaacagaaccaaagacaaaaaccacatgattatctcaatagatgccgaaaaggcctttgacaaaattcaacaccccttcatgctaaaaactctgaataaattacgtattgatggaacatatctcaaaataataagagctatttatgacaaacccacagccaatatcatactgaatgggcaaaaactggaagcattcccttggaaaactggtgcaagacaaggatgccctctctcaccactcctatttaacatagtgttggaagctctggccagggcaattaggcaggagaaagaaataaagggtattcaattaggaaaagaggaagtcaaattgtccctttttgcagatgacatgattgtatatttagaaaaccccatcgtctcagcccaaaatctccttaagctaataagcaacttcagcaaagtctcaggatacaaaatcaatgtgtaaaaatcacaagcattcttatacaccaataacagactaacacagagccaaatcatgagtgaactcccattcacaattgcttcagagagaagaaaatacctaggaatccaacttacaagggatgtgaacgacctcttcaaggagtactacaaaccactgctcagtgaaataaaagaggacacgaacaaatggaagaacattccatgctcatggataggaagagccaatatcgtgaaaatggccatagtgcctaagataatttatagattcaatgccatccccatcaagctaccaatgactttcttcaaagaattggaaaaaactactttaaagttcatatggaaccaaaaaagagcccacattgccaagtcaatcctaagccaaaagaacaaagctggaggcatcacactacctgacttcaaactatactacaaggctacagtaaccaacacagcatggtactggtaccaaaacagagatatagatcaatggaacagaacagagcccttagaaataataccacacatctacaaccatctgatctttgacaaacctgacagaaacaagcaatggggaaaggattccctatttagtaaatggtgctgggaaaactggctagccatatgtagaaagctgaaactggatcccttccttacaccttatataaaaattaattcaaaatggattaaagactgaaatgttagatctaaatccataaaaaccctagaagaaaacctaggcagtaccattcaggatataggcataggcaaggacttcatgtctaaaacacctaaagcaatggcaacaaaagccaaaattgacaattgggatctaattaaactaaagagcttctgcacagcaaaagaaactaccatcagagtgaacaggcagcctacagaatgggagaaaatttttgcaatctactcatctgacaaaggtctaatatccagaatctacaatgaactcaaacaaatttacaagaagaaaacaaacaaccccatcaaaaagtgggcaaaggatatgaacagacacttctcaaaagaagacatttatgcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttacactgttggtgggactgtaaactagttcaaccattgtggaaggcagtgtggtgattcctcaaggatctaggactagaaataccatttgacccagccatcccattactgggtatatacccaaaggattataaatcatgctgctataaagacacatgcacatgtatgtttattgtggcattattcacaatagcaaagacttggaaccaacccaaatgtccatcaatgatagactggattaagaaaatgtggcacatacacaccatggaatattatgcagccataaaaaaggatgagttcatatcctttgtagggacatggatgaagctggaaaccatcattctcagcaaactattgcaaggacagaagaccaaacaccatatgttctcactcataggtggcaattgaaccatgagaacacttggacacaggatggggaatataacacaccagggcctgtcatggggtaggggcagggagcagggataacattagcggaaatacctaatgtaaatgacgagttgattggtgcagcacaccaacatggcatttgtatacatatgtaacaaacctgcatgttgtgcacatgtaccctagaacttaaagtataaaaaaaaaactaagtgaattatattttcttaattcattaatgcattaatgatatacaatactaaaattttgtcatggtttattggagttttttcaggatttggtatataatctctggatttcattgccaacttgggcaaagattcttaagcattgattttatattgggagaaagtataatattcatgaagttattcatttgtatcaggcactcttttttttctgtgcattctatgcactgaaatataggagtgaacatacaagattcttgttctcttctgaagaggttacattttactaggggacacaggtgaaaagaaagataaagaaatatggaataaggtacgtagtgataaatccatgaagataatggagtctagagagttatattatttgtatatgtgtgtgggaattgctattttacatgtaacttttttacgtggtaacttgatgtcttgctattttacatggtaacttgttttcttgctattttacatggtaactagttgtctcattctaaatatgtacttggaatagaatgccaacagatttttcaaaatttattgtataagagtatgagagaaagaggaataaatgaaaatgtgaaagttttagactcgccaattatttgaatggaattgcttcttacaagataggggaaaacatgctggaggaacaggtttataggggaagatcgagaattcttgatcatgatcttgctaattttaagatgcttgttgatgagcctggatttcagaagggaagatagaaacggagttaaaattttgggagacataattatatagatagtattcaaagccattagactagatgagatcatacaggaagtaaatgtatgttcagaaaagaagtgtttcaaaggtggagtctggattccttcagtgtttaaagattagagagaagagggaaaatcaagaaagcagacagaaaaagcagctagttagatagaaagagaatcacgagaaagtgttgctctgaaagacaagtgaaaaaattgtttcaaggaggaaagcatcatcatctatatcagatgactgtgatagtttgagtaaaatgaggccttaaaattcattattgtattaggagggatggagctattgatgactttgaaaagttattttaacagaggggtaagcagaaagattgactggaatgggtttatgaaaaaaaaaggaagaaaaggaagtaaagacattgcatatacacaacttattcaatgggttttgtcataaagcagaccatagaagtcaggctgaagagtccatggagttcatgaagttttttcatttcatcttgttttgctttttaggatcatatattgtatgatagtgagaattattaaagctagaccaaaattgatgatgtaggagagacgggggaaaacagtagtaacagtgtccttaagaagacttaaagggaagggatccagcgccaaatatgggggggggtgtccttggataggagcctggacatttattcattgtgatagcaaggagggcggagtatgtgcatcaaaatataattggtcagatttggtgtgtgagcatctggaagtttccttctggttgtttctattttctcagtgaaatagaaagcagtcattagctgagagtaaataataagaaggtgatgttatagatttgaggagagagaagaagtatgaagtaatcattgatgaaagtaggagaaagtccctagtgaaatgtagtagcattgttgggtattgctaaggtcttacttgaggtcacttgttgattttaaagtgaaatcagtcagcatggttatattttgtcttcagtcacattcatctggttgggtagaagtgcaggataggtagagatttggatttccctaggatatatgttttcgcaagtgagttcattggagagagagaagagaaagagacataggagtagatgcaagaaggtggtaagaatgactaaccatggagtgtaagccaggtaaagagagaaaaaaattatgtgaagacggtgaggaacagtgaaaagtggtaaacttggaagatgagcgatggtagagagtgcaatgcttgaaattagtaatgacaaggtcttggatatgattacggaagtagatagctaaggcagaaggaggaaacaaccactggaaataacaatgttaaataaatgagaggccagtgtattaggatgatttaagttggtattgaaatcattgagagttacgacatgtggtagtggagacagtaagggagggaaagaaagaaggagggattgaagaaggaaaaagtgagaaaatcaaagaatttcagtttctacaggtaaggagctttgaagttgccactctatcctaacagtacacaaaaatctgaacaaactgaaaaatcaacaactcttcttacatctataagagaagtgagatcacaggacaaacagtgtctcccaaaattggagtgacagacaaatacagagaatcacaacatatcagagcagaaacctccatggaaaccagtgctgggataggaaaacctgacctgtaattgacaaatttctggaggctctgtgtggacaagtgtaagagttaaaaactccaggaggacctagttttaaatggaccctcacacttgagaattgtacctgtaggagcttgactaggttctcacagtaaatattggagaaaaactcccttgtgttcccagcagcagaaggggaaagggatctatctgggaatttgccagagcactctgttctttttaataaggtctgacctcaggagaaactagctaaccagagcctaatctgtggggtttgatcagagcctaactgatctgggagaatggaaatactcaactctagtcatcctgtcccacctaaaaggggagaaaaaagactagaaaatatttgttcaagagttcagaggcataggtgcactgaaaggctgagacctaattgtaggactatagaatgtttcccctttccccacaccttatcaccacattactaaaggcctatttacagctattgcttttacccagtatatcatgtctggctgtcaagaaaaaattacaaggcatactgagaggcaaaaaacacagtttgaagagacagagcaagcatcagaagcagacatggctgagatggtggaattatcagatggaatttactactatgattaatatgctaaaagtgttaatggagaatgtaaacagcatgcaagcacagatgagaactgtaagcagaaagatggaaattctaagaaagagccgaaaagaaagtgctagagatcaaaaacgctgtaacggaaatgaagaatgccttgatgggcttattagtagactggacatgactgaggaaagaatttctgagctagaggatatattaataaaagactctaaatctcaaaaactaagagaacaaagactgaaaaagaaaaagaagagaacatccaagagctgtgggaaaactacaaagatgtaatacatgtgcaatgagagtaccagaaagcaaaaagaaaaaggaatggaaatatttgaaacaataatgaccgagaatttatctaaattaatgtcagacaccaaaccatagaaaacctattcctaggcatgtcgcttttaaattacagaaaatcacagaataagaaaaaacctagctggctgcagtggctcatgcctataattccaacactttgagaggccaatgcaagaggcttgcttgaagcaaggagttagagaccagcctgggcaacaaagcaacaccctggtttctacaacaacacaaaaaacgaaaaagccatatgcagtagtgtgtacctatagtcccagctattcaggaggcaaaggtaggaggattgcttgagctcatgagctcaggaatttgaggctgcagtgagctatgatcatgacactgtacgccagccaggaccacagagtgagaccctatctctaataaactaaaatgtacgtttaaaaattaaaaagaagaaaaaattctgaaagaggacagagaaaaaaaaatcttacctatagaggaacaaaggtaggaactacatctaactactcaacagaaactatgcaagcaagaagtgagaggagtgaaacatttaaaggtttgaggaaaagaacaccaacttagaattctgtaccctgtgaaattatccttcaaaagtgaaggggaaataaagactttctcagatgaacaaaaactgggaaattttattaccaatagatctgccttgcaagaaatgttaaaagatagaagaaaaataatatagatgagaaacttggatctatgtaaataattgaagagcatcattgaaggaattagtgaaggtaaaattaaaacttcaattttactattattgatctatcagacagataacagtttgttaaaaatgataatagcaacaatttgattatgtgtgcttatgtatcatatgtatgtatctgtatctatatatgctcatgtataaatgaaataaatgactaatatcacaagggaaaggaggaaggaattaggattatttcattattataagttacactacctatgaagcagtatagttttatttgaaaatgaacttgcattagttgtaaatgtatattgcaaactctagagtaaccacttaaaaaggaaaaaaaaagaagcataattgatacacgaaaataagagagaaagtggaatcatacacaatgctctgttaaaaaccacaaaaggcagagtggaaaacaaaaataggaacaaagaacaagagcaacaaattcggtagatattaatccaactgtattaataaatattgtgaatatcaatgctccaaatgcaccaattggaagacagagattgttagagtgaataagaaaaataagacccaatgaaactatatgttgtctacaagaagtccactttttcttgagacagagtctcattctgtggctcaggctggagtgcagtggtgcaatctcggctcactgcaacctctgccttccgagttcaacaattctcctgcctcagcctcccaagtagatgggattacaggcgcccaccaccgcgcccagctaatttttgtacttttattggagacggggtttcaccatgttggccaggctgatctcgaactcctgacctcggacgatccatccacctcggcctcccaagtgctgggattacaggcatgagccaccgcacccagccaagaaatccactttaaatataaagacacatatagattaaaagtaattggatggatgccagtcctaagcaaaacaaagcagaattagcttgcttctttttctttctttctttctttctctttctttttctttctttctttctttctttctttctttctttctttctttctttctttctttctttctttctttcttgctctctcttctttctctctctctctttctctctttatctctctttctctctctctctctttctctctttctgacagagtctcgctctgtcatccagactggagtgcagtggtgcaatctcagctcactgcaacctcaagcgattctcctgcctcagcctcctgagtagctgggattacaggcacgtgctgccatgcctagctagttttttttatttttagtagagataaggttttgccatgttggccaggccggtctcgaactcctgacctcaagtgatctgcctgccttggcctcccaaagtgttgggattacaggcgtgagccaccgcacccggccagctgtattaatttctgatagagcagaatgcaaagcaaggaaagttatcaaggataaagaagggtattacgtaatgataaaggagtcagttctgcaagagacataacaatctttaatgtatatttgcctaacaacagatcaataaaatataggaggcaaaaactgaaagaactgttgggagaaataaatgaatctactgttatagttgaagacttcagcacccctctatcagaaatggacaaattcagcaactggaaaatcagtaaggacatagttgaactcaacaacaccgtcaatcagctggatatgattgatatctgtagactactttatccaataacagcagaatatatattcttctcaagctcacatggaacagctaccaagacagaccacattctgggccattaaacacatcttaacaaatttaaaagaatagatatcatacaatatctgttctcaaaccacatggaattaatctagaaatcaatcacagcaagataactggaaagccccaaacaatatgtggagattaagcaacatactttttttttttttttttttttaagacagggtcttactctgtcactgaggctggagtgtagtggcaaaatcatagctcactgcatcctctgcttcctgggctcaagcaatcctcccacctcaacctcctaagtagctgggactacaagcatgtgccaccacacctggctgatttttcttttttttgtagagtcgaggtttctccatgttgcacaggctggccttgaactcctgagctcaagcaatctggtctcctgggcctaccaaaatcctgggattacaggtgtgagccaccacacctggccataaacaacatacttctaaataacacatgggtcaaaagaaaaatctgaagagaaattaaaaatactttgaactaaatgaaatgaaaacataacttaccaaaatttatgagaggcagcaaaagcagtgcatagagggaaatttataacattggttgcatatattagaaagggaaatagacttaaaaaacctaagcttccattttaggtaactagataaaggagggctaattaaactcaaagtaagcagaagaaaatgaataataaaaattagggcagaaatcaataaatttgaaaacaggaagtcaataaagaaaatcaacaaaaccaaaatttggtaagataaaattgataagcctttacccagcctaagaaaaaaaagacgcagattactaatactagaaatgaaagagggaacatccacagatcctgtgaacattaaaaatgttataatggaatgctatgaacaactctatgctctcacatttgataacagagaagaaatgtactaattccttgaaagacacagtctgctaaaactcacacaagaagagatagacaatctgaatagaccttttagctattaaagaaatggaaccaacagttaataatcttcccaaacagaaagcactaggcccagatagtcactggtgaattctgcaaaatatttacaaaagaaattatactgattctctacaatctctcagaagatagaagcagacagaatgcttttgaacccatcctatgatgccagcatctccctcatacctgaactgacagagacattataagaaatgtcttatgcagaccaatatctcttatgagcatagatgcaaacattcttaacaaaatattagcaaatagaatccagcaatgtataaaaagaatgacatatcatgaccatgtcctagccatgaaacagcgtcctagccattaaaagatgtatttagtgttttctaaaggcagaatcagtgaagactgaattttctgagtacttatccgatggacgataagatgctttctgcttctaaatctctagtgactggagaggtagccagagggttggagtgggaaagaggtgatggtttgacagcacagatgagatgggttagattaagagtaaccaggagagaaactgggtggccatagacagaaaatatctgtctgtttcaatcagagagtagtgttgttttctttcttatcgcataatcaagacatttgaaatcctataaactttattttaaagtttctttctgaatttagatgaagactgtcacagcattctaattcttggcaataattattaaaagggttgtatgcatgcataaaaacaggagtagaaacaagaaatgatatcctttggactatttattcaatttctccccaaaaggaaggttgtacaaaatgtatttagagttctagtttgctttttttgagataattaactagtttacttcatttttttatttctgtaaatttcctatgatgaaataaataatcaggttaaactttattggcatattaccttaattttatgtatttattttttaagaactgaagtgccatgttagtgattaagcaagtgtattgtggcttatgctgggctaatgtgacaagtatgtggcttgaagccagttaaatgtttgtatgttcccaaccctacttagtgttttcagatatatagctgtcatagttactgtgcctgttacaccgttatgattgagtctattgttaatagtacaagttattgctgaatgtcaaaatttaagttatattgtttctttgtatcattggctgggacgatttttttggtatatcttttcaatgttgcaaatgggaccagggatttacagtagaactacagaagctttaaaatattaacagcccattaagtacaggatatggttcatgaggtttaatgggaagttgttaaaaggagatggaactattccaatggttggggaggcatggttagtggcaaagaacagggcatagaatttctaaaagcttgtttttttgtataaataatattcagtgtttgggcacactaaacaacagcaacagcaagaaacctcctctgtctgacaagcagtatcttggagctcaccaaatgagaattccatttggtgcatatgttaactttccttttcagaagatatccaacagtgttgtgttaaaaaaatttcctgtggatttgagatgcttggcattcattaaatcaaaccttaaaggactttgaaatagcacctactttgtttaacatttaaaaaattacaaggctcctgagactagtccttgggatagtctttagtgattatccagagtataataaaaatgcaagattttcagaagagggtatttaaaaagcaaaatagtgtaacacttaggagcataatgtttaatatacacctgaatcttggttccttagagagtggcacacacagactctgtgtcacatggtcagtgattagagtataatgtatcatgtgtgttccatacacatacttagatcttggctcccaaatcagggtagcaggtctagtcttctacttgcttgaattaaatactttttcccctagttccttaatcctgagcaatttttgtaacttttctgagactcagtttttttctctatgacgctctgctacttcataggattatttataagatcatatgaaatcaggtacgtgaaagcactttggaaattatcaagtgttaaacttactatatataatattattactagattagagtagataagacagaagctaagactctgtaagtttggagggtcaaatactggaaacatagctctacttaatgctgctgctaactctttttagtagacctaagttagatttaccacacatgcatcatggattttttcctttggattttatattagatccatatcattgaagagaatttgaagaaaactgagagccctgtggaaacttgaatgagaattaagtgaacattcagcatgacttccataccttaattccctacttgagcaatcctcctcaacccaatccatgttattattcattattcactatctggaatgctgacatgtccagctttttattgcttcgtgataagttgccccaaaacttggtggcttaacacaacagcaatcatttttattattgctcgtggtttctctgggtcaggagtttgggaagtgctcagctgggcagttctggctaggtctctaatgcagttgtagttagactgttactggaggtgaaacagcaggggactgaagcagctgggggatggccgggcatctttctctcctaatgtggtttttccaagtggactagtttgggcttttgtccagcatgctggcttcagggcaaccagcctgcttgcttggaggctccaaaggccagtgttgcaagagaaacaagggaactggactgtgatgtaagacttagcctctgacactacaagcctgccaagaatcaagggaaagaaacatagatcctgcctcttgaggagaatgtcaaagtcacattatatgtggatgggagatgctattgtgaccatctttggaaaaaaaaatttgccacatgaatgattaactctgtcacttcatatatagcttttgctccctatttacctgacctctctagggccactgtatggaatgatttattcttccttttattttgcagctacacagttttcctgacacaaatgaacaagaaagaaataaaagctaactaaaagtaacagaactcctctttttatatcctcttaaacctaaaatcaacatcattttggaaagattgttttacacatacaatgaaaaagaaaaactcgcaatttttcttgacatcttactttcttaacaaaagataggctcctaaatattgttttggaaagctcatattaaatagaaaaaaagcattgctactgacttgcattaaaactccagaaattcatgctcagagaatcatttgtactctgacaggcattgaggatgtttaattttatttcccaaggcactgattttttataggctgagtctttgtgtaagaaaaaattcaaaaattgtagagatctgtttacataatgaaatgtcctaatacacctcaaggaattacaagttttcagatgataattcagccatttggagaaatgatgagagctaggtcatagtgttaaaattatggatataaacattagcttttgcataacaagtatggatacaaacatgcattaatatacttaaattggcatatgttcatggaaggattatgttaaagaaatatgattgcaataaaacagttttaggggtacacatttttaaaaggagtttgcaatgacatttttcctacacacttttttaagcaattgttcaactggccaactttccatatgtccaatacatgtaatattttaagcctagagagtaataagacattctttttagcttcctacctttgtgttctatggagaaaggatagttttggtaaataatgtttttggcttgagtatttgaactaattttcaaagttggcttgcaatgaatgactataaatgagatctactgagcacattttgaaaatcagtttttaacaggaaaaataaaagcattgctaacttcaaatgttgagaaaatttggtagagttggcagggagtatttagagtatactactcacatcttgagattccagataagttagaaagacatgtaaaatataatattttaatatttcatgattatcatgtctcagatagctgtaagattgctggataattaaaacatttaaactcttaaacaatcgaagagattttttattttaaatcaccaggcagttttataatgttggtttttccaaagtgttagaaccttctgaaagtgacctttaaattctaatatttaaagataatttaactttgcaaagaaaaggaggcttctcagagaagtggctgatttcaggagtataggttagggtcagtgctaaataaaacaatggggtcatataacaagaacacagggatcctactggaggcattcccactggcgaacttgagaccaattgagcacaaaaatataaagtatagtaatagtttgtaaatcactgaaaaactaggaattgataggcctataaatagatgaggaagagaggttcctctttatagtaaaatactgagggctgactagtattaatatatagagagacctggagttgaaaaatcaccatgataaagattgtattaggcaaggatcatgtatggatgctaaatttgggggaggattttgatgaggagcagggtatttgattaacttcaagtgttagactgcttattaaattgcaataaggaaaaaaagtctactatttatgtagtggagaaatcagataacatcttgaccaggtgataaaagtttatacaatgaatgaagaacagatagatctggtatttctccagatgtgattttcttctcaagaatgtataacctcaaactaatcacatcagacaaatgcaaaatgaggaattttttattaaaagaaagggaagatggtgtcctttaaaaaatgttaatgtcagcttgggtgcggtggttcatgcctataatctcagcactttgggaggccgagacgggtggatcacttgagatcaggagtttgagaccagcctggccaatgtggcaaaatcccatcgctgctaaaaatacaaaaattagcttggtgtggtggtgggtgcctgtaatcctagctacttgggaggctgaggcatgggaattgcttgaatccgggaggcagatgttgcagtgagccaagatcatgctactgcattccagctgggtgacacagtaagactctgtctcaaaaaaaaaaaaaagttaatgttgtaaaagacaaagaggctgttgaaatattccatgttaaaagagactaaagagatatgacagctaaatataatgtctaaccctaaactgggtcctgtactagaagagaaaaaataaatactataaaagacagacaaaattggaatatggatggtagagtaggtaaaagtgttgcaatgtaaatttatgcattaaggtatgcattaagtggatttcttaggatttacatactgaaatattaaggggtaaagggccatgatttcaaatagttgagaaaaaaaagtgtgtgtgtgtgtgtgtgtgtgtgtgtgtgtagagagacacagagaacatggctgcaaataataaagcaaatgttagcagtatcaatagataagtctgggtaaaaggaatatgggtattccttgtgctattttcattttcgcaactttattttaatttaaattattttcaataagtttttttaaggaacctgaaaacacctacctcattttgaaattaaacaaacaaacaaggccaggcttcgtggttcatacctgtaatcctggcacttgggaggccaagttcagcagatcgcttgggcccaggagtttgatacgagactggcctacatggcgagaccctgactctacaaaaaatgcaaaacttagccagctgtggtggtgtgtgcctatagtctcaactagttggggggctgaggtgggtgaacagagatcgtgctactgcactccagcctgggtgagggtgacaaagtgagaacctttcaaaaaaaaaaaaaaccctcaaaaaacaaacaaaaccaacttcccaaggcacagtttcataatttaataaactagtagaagatccattacttggagacatctgaaagtatatcacataaagacatgaaggagattctttatgagcaccaaagtgaacaatatgatgtaattagctctggtgtctataattctttctctctgtgacgtttcaactgatataaccaaagatgtgagaaaagaaaggttgtagtaaagatgaaacaaaatagcagtgagtttattgataatatcctaatttattatttctgttattttggactattcacatgtacagtatgaaaaaaggacctaaactattgtctttccttttagaacatatgcagaattagagaagaaataacatacattcttttcaatggcctgaatgactgaatttatgctgttactcatgaaaatagttgcctgacctctgctggtatattaaccgttctgttgtatcttgctttgaaagctcccttctgtcctgaagctttgtaattagattcattaatcctctaatctactctagtttttaccagctcacggaaatctctgtcagcctactctatcaatgccttttttacttatttttttctctcatctttgattggatgataaagttcctcttatgaactgtttaggcaggaggaatcttgacacattcagacactttaaaatgctcgagtaagcaagtcacaacaccaggtgaaatctctcactttagtgaacctggtctatactaaaatttgtcatatttttatgaccttattaatattaatatgcttgtatcaaattgtgaaaaagtgacaggccatatataaatgaataaaactaaatagttttttttcaatgacttatttctactttcagaattgttcaagagtgctagaattactatataatctgttaagccctaattacttatacttctaagacactgtgattttgggctttgagagttctcttgaacactctacatcctgttgttttcattaaatcaaagaaaaacgtttctaatgacaaaattccaaaaatggccattaaaggtttctctttattgtcactcaaatgacattgcataagcagtaattgctaaattggcctatctttaagcccattgattaattttgccatataaagcctgaaaactgaaatcaaattttgcccattagacctcccaattattaccaggaactggaaaaaacaaataagcccagccaaatgccagatagctatgtgataataaatgtataggggggaaaaaaggatgggtactaaattttactaacagctggctttggctaggtactatgtatctagtatcacagtttcaaaagagaaatgtacagactccttgtaaagaaaaaaatatactctcatatcctccaatattaaattatttttgctttgtttaaatatgtacaaatataaaacaaaatgtttttatgcttatagctcttacagaattataaagtcataataaattataattttaataacgacaaaagtacaaaaccaataggtgttacaccttactaggaagttcttccatactaggaaggcagaaatcattactgaaactaaattgctttctcaaagtgagtatgacacaggtttctctgaggcttagtatgcctgtaccactgtatgataattattctcccatcatttttctttattccaagtgttggaaacctttatttctttctttctttttttttttctttgagatggagtctcgctctgtcgcccaggctggagtgcagtggcgcgatctcagctcactgcaagctccgcctcccgggttcacgccattctggtgcctcagcctcgcgagtagctgggactacaggcgtccgccaccacgcccggctaatttttttgtattttcagtagagagtttcaccgtgttagccaggatggtctcgatctcctgacctcgtgatccgcccacctcggcctcccaaagtgctgggattacaggcttgagccactgcgcccggcctggaaaccttcatttctatagcattgtgacttttttgagccttcacttgacacgaaaacattctttatgtaagtatttatctatttctcatatggctatgacaattaaagtagtaatatttggggacagtgccacccagaacacaaatgccaaagcaggcactgacactacgtagcagtattttgttgtaacatgttcacattatgtttgtttttatgagaatatactcatgttcattttttaaaagatcgtcatcaagatttaaatctaaatgaaataagaaattatcaaaaggaagattttatagactcctaggatgagtgacactgtattatcagatctaatcttgcagatgaggggattgaggtctagaaaatttagtaacttgcatcaggtcacgcagtgagaaagtacatttaatcgcgtgcttttctagctccaaaaatcatgctctttctgttaaaacaacttgcctaaactaaaagtttaggagctcaactgagtgtaggctgagggtttcagtgttataacttcatcccctgtacctcatcagaacctcatcagaagtttcagtgttacaacttcatccgctgcatacatcagatgcagtggactacagaaggatggtagttgtaggaatggtaacagtcagattgcatgatatatttagtgtgacaatctgaaaacatttattgtacaaattctttttttttgggggggttggagtctcactctgtagcccaggcaggaatgcaatggcgcgatcttggctcaccgcaactctgcctcctgggttcaagcgattctcctgtctcatcctcccgaatagctgggattacaggcacctgccacaacgcccggctaatttttgtatttgtggtagagacaggttttgccacgttggccaggctggtcttgaattcctgacctcaggtgataggcccgccttggcctcccaaagtgctgggattacaggtgtgagccaccgtgcccggcctattgtacaaattctattatttgtttatttactttagtctcataccttatataggtattctaaggcataagaatgctatggtatttaagttcactgttgtttcaattcactgaatagtctttcatttgtggtagtatatagtaatctccccccacttgctttttcttttttttggccagaagattaaccaacaaacctcactctggaaattttcagagtgacccatgaaaatccacatgaggtgaacatcaaacgagttattgatgctctccttctttaccacgctctgtgaccataaatgtcaccactgtaaaaccgctgattattacctactcggagagtaagaaactcattcatgcaatccagtgtcttgttgtatccttcagacatcaggctcatttgacccaaccatgaatctgaagttaacaacgaccttactgtcaacctgtcagacattttaaacttttaatttaaaaggcacactataagtatatataaggtgtgaagtcctagtcctgtgctggatatagaattacaaaattttaaaaatgtgatattaatcacttagctacaatagtttgatgattgaagaataaaggaataattaatctatgaagtacattatatttcctattttgaatatgttttaaatgtgaatatgaatatgaatatatatttgcactcatgggtaattgtatatataatgttagttttctagctttcaaattaaacttcagactaatagtgtaggttttgtttcttagcacttatgctgttatcaataattctgccttatatttgaaccaaagaatgactctctactcatggaatttcaggtaccacagaaggccaacatgagataatttttaaattgtgtcatttctaaatgactgaaatataaattggcttgcattattgttcttctttccatagcaaatacagtgaagtcatctttgtttttcaataatcattttgtgcttatctttggcaaaaaatgaacagtcaatgcttgttaagatgttgattaaagaagttaatacttggctgggtgcagtggctcatgcctgtattcccaggattttgggaggccgaggcgaatggatcacttgaggtcaggagtttgagaccaacctggccaacatggtgaaaccctgtctctactaaaaatacaaaaattagtgggtgtggtggtgggcacctataattccagctactcttggggctgaggcaggagaattgcttggacgtgggaggcagaggttgcagtgagtcaaggtcaggccactgcactctggcctgggtgtcagagtgagactccatctcaaaaacaaccaaccaaccaaaaaagaagttaatagttaaggtattgtatcatagttcctcatatctcctgtgcttggtagtataaattagcataatatttctgcatcttgttgttaatgtaaatcaacggtgttaaacatttttcaaacttacctttgatctatcaggtacacttctagaaatgccttataaggacacaaacaaatgtatcatcaaagatttgtgtacaaggatattgccatactatttattatagataaaaatcaggtgcaacttaaatatccaataaaggggagtgtttaaatatacattttcaaatatatgaaaaataggatagatgtactcatcacccaactttaaaaaggaacattttttaaaaaaagaaaaatgtgaaatattatcaatgttagacatgacataataatatatagcctggaattcaatgagaagaaaaacatatttaagatgtagttgagaaatcattggtattctttgtggaggactcataattctggtagaattatagcttatttagtaaattacatagcccatattgttaaaatgttcaataataggctggagggattctgataaaatttagttgccgtgaacagcttatcttttctctaaccatagaagacatcactgcttcttaattcttagtcccttctccaatgctcagccaaaataagcagtggtaaattgtaatgaccacattgaaccttacatttggtcagtgcttttactttatgagatacttcacataatgtatttcttatgttaattttaaattcctacaattgcttcttctcatgtattataaaattggctgtatttgcccctttctttataaaatactctgtaatctgagataagatcatgccatagcaaaggaattacaagcatctttctatcctcatgctttagaaatttattgggaatcagaattaattgatcttcatatagagtggctcaaaatgtaaataatttaagaaattaaaatataacaataaataaaataaaaaatgatgataatttttactaagtggtactatgaatcggtcctctgctaagccctttatacatagcaattgatttcatactaatataatctcacttcacagtggagaaaactgaagtacaaaggagattacccaagatcatgaagacccagttaaaaaatcgcaaagctgaagtccaaacttgggtctctctgagtttagtttgcagtcattgttgtctgaatatttgttagtgtttattttatgctactgtgcaatgaagtgattctacatttgtgaataaaaaattcatactgtctgtactactggaatttctattctaaaggggaaagataggcaataaacaagtaaacaaatacatatttgctaattctgatgaattctgtgcaggagaaaacaagatacaatgtgctatgatctgaatgtatgtccctccctgcccctgaaattcacatcttgaaacccagtatccaaggtgatggtattaagaggtggagacttgaggaagtgaatagtgagggcagagccttcatgaatgggattagtgcccttataaaagaagcctgagggagcttgttagccccttttgccttctaccatgtgaagatgcagcaagaaggtatcatctatgatgcagaaaacccttatcagacaccacatctgctgctcccttgatcttcttccctgcctctagaactgtgagcaatacatttctgttgcttataaattacccagtctaaggtattttgctgtagcaagcttaatggactgaaacagataatggtatcaagaagtggggtgttgccgtataacaaatacctaaaaatgtggaagcaactttggaacttagtaatgggtagaggttggaagttttgtggtacatagctgtgaaaggaggcttaaggacaattctggcaagtgctcaggagaagaggagagctgtagaaaaagcctcaatcttcttagagattacttaagtggttatgagcagaatattggtacaaatacggataaagtaggtcatcttaatgaggtctcccatggaaatgaggaatatgttattggaaactagaggaaagatgatctctgttataaattgacaaagaacttggctgaattgtgtttgtgttctgctgctttgtgaaagatggaacttctgagtgatgaaataggatattgggcagaagaaatatctaagcaaagtgttgaggatgtggcatggtttctcttgtggcatggtttctcttgactccttatagtaaaatgtgtgagagagaaatgaattaaagatggaatttataataaaaaagaaagcagaatttgaagacttggaaaattctcagcctggctatatggtaaagaatgaaaaatgtttgggggagaacagtaagggtgtggcccatcaaacgtttgataaggagattagtatggatagaatgaagccagatgctattcatcaagacaacgaaagaatgaccctaaaggcattttggtaatctttggggttgccccacccatcacagggtcagaacgccagggccttggtggtggaacgttttaaggctctactccccgagttctgatgcagtgctccttcacagatttagttgtgcctcgggctgcctttccaaaaggcatgggtggtagatcacgctggtgttcatgcagtagcatcttcatgactgtgcagagagcatgaactgtggtggtatgggtacctccacctagattccaaaggatgccacagagagccttggggctcaggcagagaattgctatgaggggagtcaccatagagggcccccactagggcaatgcctagtggagctttggagagagtctccactagggcaatgaccagtggagctgtgggggtgggaatgcccccaacaccccagagcagtagaggaatcaaagtgcatttccagcccgggagagccacaggcacatgactacaattggtgagagctgcagtgtgggcttcaccaagcaaagccttgagagtaggattgcctggagccttgggggcctaatccctgtcccagtatgtctggaaggtgagtcatggagtcaattattctctagtcttaagattcaatgttgtttgccctgttgggttttgaacttagaaccagctacccctttcttccttctcatttctctcttttgatttgggaacatctatcctatgcctgacccaccattgtattttggaagtttataacttgttttatttcacaactggagagcagtttgcctcaggatgagtcaaaccttgagtctcaccaatatttgatgactttagacttttgagttgatattagggtgagttaagacttttgggactattgggatggaatgtatgcattttgtatgtgagaaggatgtgaattttgtggggtcggagcaaaaagtgtatattatggatatatatgtcctcccaaaatttgtatgttaaaacctaaccctcaaggtgatgatattaagatgttgagccttcaggaggtgactaggtcctgagagcttagtcttcatgaatgcaattagtgcccttataaaacagatccaaaggagcttatcttctcctttcaccatatgagaacacagcaaacaattgccatttaggaagtggactttcaccagacgtagaatctgcttgtgccttgaccttggacttcccagcctctgggacagtgagcaataaatttctgttgtttataaattaccctgtttaaggtattttgttatagcagactgaatggactaagatacataaaagagaacagtagagggcatacttagatatggtggtcaggaaagacctctcttaggagtgacacttaagcaaatatctgaaagatgaggcatcacctgtgaagggcaatgagaagactactccaggcctagaaatagcatatgccctgtggcaggaggaaggcaaaaatgaagtatgaaatgaggttgaagatcaataaagtgccaggtccccattcttagaaaggcactgtgttttgtgtgatgctgtcttgtcatcatcttgaaattcttaagtgctttatgcaaggatacaagctgatggctcaacatcagtacatagaaattaaaattgaatttgacaatcatgacccaaaatataagtatccaatttcaaatgagtactttcggagttcaacttgttcaattacttgtatttcaggagagtgtggggctcaaatcagatatttcataggagtaatattgagacttcttatatggccaagtcaggtaatgactaataccttatctaaacatttattagaaatcttaatcagtggatccaaagttgatctttgaggaaaatcttagctttgcctgcagatatgccttactttctgttgaggtgacaataccattttggctttttattatattagaaaatccaagagttacggagtttccttcatttagaactcttgtgctcccagctttttccaaagagttaacctcaaattgtgtgtgttccaaaaagcaaaagtctagctgaaataatttttaagaaaaatagtccaagggagctgctagctatctactcttctagttatacaaaagtctgtttttagcattatgatatattaccatgtttgaattatattattgtgattcattttacacattccacaaatactaatttgaaaataaccttaattcctcacagaatggcatttatcaagtgagcttttactctgtatctataaaactattgttaaagatatcatgtgttacccaaattaagttttctataacttttctttagtttcatttttttaaactctatgaagaatctctataggaaaagtctgtgtctttcaaaggattactatgttttcttttatcagcaacaaaaatggtataatccagaggccaggcatagtggctcacacttgtaatccccgcacttttggaggccaaggtgggtggatcacctgaggtcaggagtttgagaccagcctgtccaagatggtgaaaccctatctctactaaaattacaaaaaaaaaaaaaaaaaaaaaaaaaaaattagccaggcacggtgatccatgcctgtaatcccagctactctggaggctgagacaggagaatcgcttgaacccaagaggtggaggttgcagtgagccaagatggtgcccttgcactccagcctgggcgacagagtgagactccatctcaaaaaaaaaaaaaaagatataatccttcatagtttccattttgctttggttacctagaagcttatagccaaatttaatgtttaatacaatgtttgcctttttaactgtcacaataaagctagcacatttgcttttttctgtacttgaccatttaaaaattttcattttgctgaccttttggtgaggaagagagaacaagagagagagacaaagagagagaatcatttagtatatgcctcattagattgtttttgaaaagaaagaaaattaacatttgtaaattacatgagttatctcaagtgcagttactgtatttatagggttataattatgtttatcatttagaaaataattttctaagaattctgtacttttgcttaatttacattaattgagctttcctcaatcagtagccagaatttccacagtttcaaatcagaatacttatacaactgttactgcatatagaattttatatgtcataagtcattattagaaaaattataagacagatggtcaaaatgtaaaaatgtttatattatatgtattggacaagtgtttaatatcttcaatagtaaaaaacttacaaaccaatgagagaaagctatacattccagaagcaaaatggaagacataggtgataatttaatacacacaaaaaatctgtggccaatacagttattaaaaaatgttagatctcaccagcaaacaaagaaatgcaaaaataaattttaaaaattttgtccatcaatttaggggcatttcagaagtgatgagtcatattcccaatatgtttttgctttttgagacagagtctgacttttttacccaggttggagtgcagtggcatgatcttgtctcactgcaacctctgcctcccaagttcaagtgattctcctgcctcagcctcccaagtagctgggataatgggtgctcgccaccacaccctgctaatttttgtatttttttttagtagagatggagttttgccatgttttccaggccggcctcaaaatactgacctcgagtgatctgcctaccttggcctcccaaagtgctgggattacaagcataagccaccactcccggcccccagtatatttttaaaggtagtatagtataaagtgctagttgttaattccgtatgtactgatatgcataatctataagatatataactaaatttaaaaagcaagatgcagaacctatacagcattctcagtggtatgctggtgaaatggctgtctggagaaaaaaaagttctgatttatactatttttatattttcttggtgtaacttattccaccatggcctattttattactgatatgctgtcacggaaaatggagatggaaagagacatggataatcagtcgtcatgagtcagtaagaactgactccagcacactgttaaatagtataatgtatatctattaggaattcgagaaataaatatgaaagttactcttgatttaaccttaagttaaaaggcaaatgtatgtatcaaatatttattgtccatatataattatttatataattatatataaacacacatgcatacgtgtgatcccagttttgtttcaaggttatttacatgtgtgtgcgtgtgtttaggaggggtgagaggagaaagcggggacactgtttgccaggtatcgaggacatgaaagttatgtacatgtgtgtgcatgtgtttaggagggctgggaggagaaagcggggtcactgttttccaggtgttgaggaaatgaaagtgctaccaacagagtcttctctgtgacaatgtagaaaagaaagaaaatcagtttattattaagtaagcataacagaatatgcacacaggcagcctgctagagactacaaagttaggatgagatctcacataatttatatggcaaagcagagaaaagaacaataatttttatcaccttgtgacactctgtacatctcatgagagccctgggctaattctggcagtatgtgtttacatatgtagaagttatttggtcttacaaactttcatgtatctctttactataaaaatggagcaaagatggggttcaatccctagagacatttatctatattcaaaggttaaagacttggattcaccatgtcttcaaggaaaaactctacaaaagtgaagagggataaaaaatggcctctttgccctttacaaattgggaaaataatttgtatttactcttacacagctgtaaatgacgactaaaacaaaggattaaatgaggattaaaacaattttttaaagtggttgtttgatgactggctttatttttaaatgattacctgtgttttccagatatttctaatgaacacatgtatcttataattatgaaaaaatgttattaaaaacagattttgaagacttgattttacaataagatcatgactttttttttattctcttgagattcctttttaaaatctccagttgttttattgttaatcagtgtatgcagaagtttattactatgttctcttttctattctggagaatacagaaagaagcacagagaatgactttgtcttcaagagtttataatatattcagagttagaagcttaatttatatgaaatagcagtgaatgatacaagcaaatgatatatatccagggatttcagtgtgtagtatggtgctgtagtaaacagagaaagaactcagggtattcttaagttgaagaaaggttatttagaagaagtatgtttggggttagctttggatgttgcttctttagggggatgaaaatccctttagatgagtgtaacatcataagacaaggcaggggggcaaaaatgaaactggaggagtttttaagagaattatgtaatttcacgcatattgagaggagtgaagaaagcagtgtatatagaatggattcctttgatggggagagcctggaagtagagaggtcaattcggagacttttgagaacaaatgaaactcaaaggactaaactgaattagtaccatgagaataaagagaaagactgataggcattgatggttgattggatattgggagaagatagagaaggataagttaaagattattccaagaggtatgggagaagaatgaaagggaagaaaaatctgtagaataaaataatgctttttatatttgaagcaacagttctgcatctaatttgaaatgtccatttgtcagatgctgtatgggttggattgtatccccccaaaagatatggtgaagtcctaactcccaatccctcagaatgtgaccttatttggaaatagggtcttgcagatgtaagtagctgagattactccagtatggtagacccttactctgatgtggctagtgtccttataagaaaaaaagacatacagagacagagacaaacatggagaatatggccacatgatggtagaaccagatactgaaatgatgcatgtcaaggaataccaatgattgccagcaaaaaacagtagccagaaaaggcaaggaaggattctcccttacaggtttcagagagagtatggccctgctgataccttcatttcaaacttctaccctccagaaattgtgatatgataaatttgtgttattttaagctagccaatttgtggtactttgttatggctgacatgagaagctacgatgctggtgctattctttcattcttctttcttaccatccctcccacccactgaaactttctccctggaaaaaatttatcaacacaaaataaagcaaaaaactatacaaaacacaaatgaggtacatagagtcaaaattagagtgaacaatgtgttaacattttgtaatattttgtatctactagtattttattctctttatcattcttaaatgggattttaaaaggggctaaatcatctctccggattgtgcagggatagctcattggagtgtgtgctctgcatatccttttaggaggtatttaaagatagtaatgtctctccagcttgtttggcagtctagaattccattgcctaactttttattcaagaatatcagatgtcagaatgaagtgacaacttagccatgtggaaatgggaagaatatggggatcacaaagtaagcaaggcagtatgggtcatagagcacatgggcaaaggcatatgcttgaatgccttgaggacccactgtagtaagaggaaatataaaaatggagagagaaggaagtacttgtctctgtcactcccaccagaaatttctcacttgagtatttgtattaatgttgttgtctttactgattttttcaaatttttaatgattgaaatgagatcagtcatattctattccagaaagtgttccctcttttcttaatctgtttttcttgttgagtatatttatatatatataagtcttccatgaggtaggggggatactctcacccctttttcgactgttaaatcaacaacttttagagattggtcaattaggttaccaaacattttacataacttggaaaccaaatattttacataatctggaaagtaaagctgttttgttaatttttttttttagctttttaatttttttgagacagggtcccactctgtcttctgggcttgagtgcagtgctgtggtggttatggctcactgcagcctctacctcccaggctcaagtgatccttccacatcagcctcctaagtagctggggccacatgtacatgtcaccatgcctggctaatttttgtattttttgtggagatggggttttgtcacattgctcaggatagtcttgaattcctgaggcaattgatccacctgccttggcctcccaaagttctgggattacaggcatgagccaccatgccgggcctgtaaagctgttttaagtgcatgtgaatatatgaatttggggaactaactatgcctaagccataagcttttatttcttttctttccttcctttttttttgagatggagtctccctttgtctcccaggctggactgcagtggcgcaattttggctcactgcaacctccacctcctgggttcaagctattcttctgcctcaacttcccgagtagctgggactacaggcgcgtgccaccatgtccggctaattattgtatttttatttttatgtttttattttttattattattttactttaagttttagggtacatgtgcacaatgtgcaggttagttacatatgtatacatgtgccatgctggtgcgctgcacccactaactcgtcatctagcattaggtacatctcccaatgctatccctcccccctgcccccaccccacaacaggccccagagtgtgatgttccccttcctgtgtccatgtgttctcattgttcaattcccacctatgagtgagaatatgcggtctttgtttttttgttcttgcaatagtttactgagaatgctgatttccaatttcatccatgtccctacaaacgacatgaactcatcattttttacggctgcatagtattccatggtgtatatgtgccacattttcttaatccagcctatcattgttggacatttgggttggttccaagtctttgctattgtgaataatgccgtaataaacatacgtgtgcatgtgcctttatagcagcatgatttataatcctttgggtatatatccagtaatgggatggctgggtcaaatggtatttctagttctagatccctgaggaatcgccacactgacttccacaatggttgaactagtttacagtcccaccaacagtgtaaaagtgttcctatttctccacatcttcttcagcccctgttgttttctgactttttaatgattgccattctaactgatgtgagatggtatctcattgtggttttgatttgtatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggtttcctgttcactctgatggtagtttcttttgctgtgcagaagctctttagtttaattagatcccatttgtcaattttggcttttgttaccattccttttggtgttttagacatgaagcctttgcccatgcctatgtcctgaatggtaaagcctaggttttcttctagggtttttatggttttaggtctaacgtttaaatctttaatccatcttgaattgatttttgaataaggtgtaaggaagggatccagtttcagctttctacatatggctagccagttttcccagcaccatttattaaatagggaatcctttccccattgcttgtttttctaaggtttgtcaaagatcagatagttgtagatatgtggcattatttctgagggctctgttctgttccattgatctatatctctgttttggtaccagtgccatgctgtgttggttactgtagccttgtagtatagtttgaagtcaggtagtgtgatgcctccagctttgttcttttggcttaggattgacatggcgatgcaggctcttttttgattccacatgaactttaaagtagtttattccatttctgtgaagaaagtcattggtagcttgatggggatggcattgaatctgtaaattacgttgggcagtatggccattttcacgacattgattcttcctacccatgagcatgcaatgttcttccatttgtttgtatcctcttttatttccttgagcagtggtttgtagttctccttgaagaggtctttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaatatcctttatttccttctcctgcctaattgccctggccagaacttccaacactatgttgaataggagtggtgagagaggccatccctgtcttgtgccagttttctaagggaatgcttccagtttttgcccattcagtatgatattggctgtgggtttgtcatagatagctcttattattttgaaatatgtcccatcaatacctaatttattgagactttttagcatgaagggttgttgaattttgtcaaaggacttttctgcatctattgagataatcatgtggtttttctctttggttctgtttatatgctggattacatgtactgatttgcgtatattgaaccagccttgcatcccagggatgaagcccacttgatcatggcagataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttacggaggattccctctatttctattgattggaatagtttcagaaggaatggtaccagtttctccttgtacctctggtagaattcggctgtgaatccatctggtcctggactctttttggttggtaagctattgattattgccacaatttcaaatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagctgtttatcaattttgttgatcctttcaaaaaaccagctcctggattcattgattttttgaagggctttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatacgtcccagagattctggtatgttgtgtctttgttctcattggtttcaaagaacatctttgtttctgccttcattttgttacgtacccagtagtcattcaggagaagcttgttcagtttccatgtagttgagtggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctaagaaaaatgtatattctgttgatttggggtggagagttctgtagatgtctattaggtctgcttggtgcagagctgagttcaattcctgggtatccttattgactttctgtctcattgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaacccctgcctttttttgttttccatttgcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattatgatgttagctggttattttgctcggtagttgatgcagatggtctttacattttggcatgattttgcagtggctggtaccggttgttcctttccatgtttagcgcttccttcaggagctcttttagggcaggcgtggtggtgacaaaatctctcagcatttgcttgtctataaagtattttatttgtccttcacttatgaagcttaatttggctggatatgaaattcggggttgaaaattcttttctttaagaatgttgaatattggcgcccactctcttctggcttgtagagtttctgccgagaggtccactgttagtctgatgggcttccctttgagggtaacctgacctttctctctggctgcccttaacattttttccttcatttaaactttggtgaatctgacaattatgtgtcttgggagttgctcttctcgaggagtatctttgtggcattttctgtatttcctgcatctgaatgttggcctgccttgctagattggggaagttctcctggataatatcctgcagagtgttttccaacttggttccattctcctcgtcactttcaggtacaccaatcagacgtagatttggtcttttcacatagtcccatatttcttggaggctttgttcgtttctttttattcttttttctctaaacttcccttctcgcttcatttcattcacttcatcttccatcgctgataccctttcttccagttgatcgcattggctcctgaggcttctgcattcttcacgtagttctcgagccttggttttcagctccatcagctcctttaagcacttctctgtattggttattctagttataccttcttctaaattttttttaaagttttcaacttctttgcctttggtttgaatgtcctcccgtagttcggagtaatttgattgtttgaagccttcttctctcagctcgtcaaagtcattctccgtccagctttgttccgttgctggtgaggaactgcattcctttggaggaggagaggtgctctgctttttagagtttccagtttttctgctctgtttttttccccatctttgtggttttatctacttttggtctttgatgatggtgttgtacagattggtttttggtgtggatgtcctatttgttagttttccttctaacagacaggacactcagctgcaggtctgttggagtacccggccatgtgaggtgtcagtgtgcccctgctggggggtgcctcccagttaggctgctcgggggtcaggggtcagggaccaacttgaggaggcagtctgcccgttctcagatctccagctgtgtgctgggagaatcactgctctcttcaaagctgtcagacagggacatttaagtctgcagaggttactgctgtctttttgtttgtcttgccctgcccccagaggtggagcctacagaggcaggcaggcctccttgagctgtggtgggctccacccagttggagcttcccctctgctttgtttacctaagcaagcctgggcaatggtgggcgcccctcccccagcctcgctgccctttgccgtttgatctcagacttctgtgctagcaatcagcgagactccgtgggcgtaggaccctccgatccaggtgcgggatataatctcgtggtgcgccattttttaagcccgtcggaaaagcgcggtatttgggtgggagtgacccgactttccaggtgccatctgtcacccctttctttgactaggaaagggaactccctgaccccttgcgcttcccaggtgaggcaatgcctctccctgcttcggctcacgcatggtgcgcgcacccactgacctgcgcgcgctgtctgacactccctagtgagatgaacccggtacctcagatggaaatgcagaaatcacccgccttctgcgttgctcatgctgggagctatagaccggagctgtttctattcggccatcttggctcctccccctaattattgtatttttagtagagatgggatttcaccatgttggccaggctggtctcgaactccagatctcatgatccacctgcctcagcctcccagagtgctgggattacaggcgtgagccaccgtgcctggccgcttttatttctttctaaatgaaaacatacattttgaggttcactgaccttaaaatatatttccttttcccagaagagtatatactgttcatttggtttccatgtaaaactctccccttgaacatattgataatgagtaatctttatttccctaggaaataaaggaaaataaataaaggaaaaaaaaataacttccctaggaagttagttctattatcagctgtgaaatctgagtgactctacacttttgttgcttcagatgatttttagaattgctgttttggtgcagaattaatcacagcaagagaaaatgtatcaatatggaaaaatataagggctaaaaagaagccagatagctcatattcatataggttgctaataatatacccaatgtatagtacttaatatccctattactgccaattctattaaataagatgtcaaaatattttaatattgtctcatgagatatcataaggctatatgagtgcttagaatttcttgatttattagttgttttctgtgaaatctgggtggctgtaattatagttcacatttgctgtattaagattctactgtttttttttttaatgaagcgtaacagtgattaatggtttagctagctaagaacataagaaagatgtgaatgcccagccaaaaaaaaagatagtttttctttctgatgtttccgtacttcttagtttgaactatatgaaattgccacttttgtaggtcaaatagacaactttttatggttcaacctattatatggtttagaataataatgtctatagtctactctgccctagccagctctacataaaactttaacttgtgggctataaacttacccaatttatacaaattttggcgtaattatttctgtttttattttttgttattagggtttgctttttagagaggatctcactcaggctggagtgcagtggtgtgatcatagctcactgcagcttcaaactcctgggatcaagggatcctcccaactcagcctctggggtagctgggactacagacatgcatcaccaaaactggctagtttttaaattttttgtagagacagtctcactctgtcacccaggctggagtgcagtgccttgatctcagcccactgcccactctgcctcctgggttcaagcgcttctcctgcctcagcttcccaagtagctgggactacaggtgtgtgctaccatacctagctaatttttgtattttttagtatagacggggtttcaccatgttggccagactggtcttgaattcctcacctcaagtaatacacccgcctcggcctcccaaagtgctgagattacaggtgtgagccaccaagcctggccaagtcattgtttttcttatgcaccaagaagtttggaggtagccagtccaagggcaggtgtagtggcttcacaataacattgatgttccagactctttctatatttctactctgacatacttagcctgtggctttcattctttttcgtgttgctttagacccaagatggacaccgcatttccaggtattacatctaccttccaggcaggaagaagagaagaattaaaagcctcattcttttgaggcttcctctcattgcctacaaagaagggaagttatcttgaggggcttctccctgagagtatttcagttaactattttagcttcatgtctctttagtagaggaaggcacagaaaaaagcattgaaaagcaaagtgagggacactttgaagcaacaaatggtaagccattcaagactaataaattgtaggccaattgagttggtttttgtattttaaaggcaagtgtgctttgaatagcatcaggatccaaaagaaatgctgttgctggtgaaatgatcatttaaataagcaaaaggagtttctattcttaaatgtagagagacaaattgatttctgataaccatcttgctacagggaaatgtgaaattggaataagagggcaaaacagacacactaggaccaattcttaaaagttaagtaacctttagtcttatctttattaaatctttcctttcaaaatatagccctgtaaatcttctgagttttgtgaccttagtgacagtagacttttagcctttgattactttgtgaaataaaataatgaattaaaaaagataatttttttgtagtaaaatatgccatggtacaatcacaaatagaattttatgtgattggtcatatatatacacatatatatacacatatatatatacacacacatatatatacatatagatatatatatatgtagtactgtttggtttatatacaacagttgccagtttgttccccaggaaacaagattaatattcaggaagtttgtaagtgggaactcttgggatttacacctgtagggaaagggatggaagcaagattggacaaaaggagaagttggatcgtgacgcagtcagaagaaaggcctcaaccagctgcatgggaaggctgtttggagttgttccaggttgaagtaaggaggctgagcctttgtactccagtattgaccagtcatttgatgcaaattgcccctaggagatagtgtgatcctgggcaaggtaatctgtacaattgagggtaattcccagagaggactagatagctgagggatgacagcagttgagaaataaattctccaaacttaattgtatcttgggaaaatcagatttaacttataaattttagttttacatcttactttttaggaatattacccatggtaagtgcaatattgtacccatatgtgttctcaaggctctagggttggagtattaaagatgatttattctagctcaggataaagaatgctcttttaagattaatatggaagctccacttgagactcctcccacctccaaaaatattaagttaattctgtttcagtcacttatttgtaacagcatcctgtgtatgccgaatactaaagaggaatagtgagctgttattcagttttttagtttttaattcaatttgatcatgggaatattcatttcagtacagctccatgattatctctaattttttaaggattctgatgtaatgcataattcttgattcccttgtcctgtctcataaaataactggcttttatttaaaaagtctccccaccccccgcatcattctttttcttggaatgagagctcagaaagcacagagtctgtcttggttgttatccatgcctccttgcctcttggatagactgctaaaatttattttcttttggcctttccctgaaagtcatccagaagcaacagtatttatagaacagagcagctctactactgaacatggcagggggtggtggcgggagggtatcctctggagtgtgtatttactgcaagaacagcagtcagatggattgaatttagattttactgatttaatacttagaataatctgaactttaaatctatgaacagttagtaagaatctggggtcagcaagatgatagctttaggagcattgatttttatgaaattagattataatgaacacactatgtgatggtcccacacatcttatatagtagaattagaatttttggagtgaaaatctacaaggctaaaaaaattagtaacagtttaagcaccattttactcagctaccaggggcattgtgactaacttcttggttcaagtgtttctggtcttggttggattcaaatatcattggtagattttggtagaattctatattaaatattttcttttccttcccattgttctttttctttgactattttaagacattgtcggaatgaaaatgttatagatagtacttttataagacctgccaacatttttttaccattaccattagtaaataacttaaaatattttatataggattctctgaagcataatttttacttctacctttatctaaaactaaagttattacattcctttgtcccttaggaggttgcatttatcaggttaggtgtgtttgcttcaggttagttttaaaaacaagtttctctgagatctgatgcaatgattggttttaaacccagaacaaatggatttttgttttgggggttttattcaatgactttgtacctatggtaccaaaagagatttttttttttgttttatttaatgattataaagttcaaaaacagaaccagaaacttatctcttagcatttgattatatagaaataaatgctcatttcctggaactatagatgtattaaatctgtaaagtgctgaaaagcatgtactcaagtgaaacaattggcaggcaaagacacattttactttgtaaaataagagcttatataggatgttttatagtttgtattcgagctaattttacataaaaatgtgaccatctataaaagatatactaaatagggtccttataacagggttcctagtcccttagaaattctgttccaaataatttattgaatattgctccttgttcagttaatttttttttttttttttgaaacagagtctcactctgttgcccaggctggagtgcaatggcatgatctccgctcactgaaacctccgcctcccaggttcaagtgattctcttgcctcagcctcccaagtaactgagattacaggcatgtgccaccatgactggctaattttttgtgtttttagtagagatggggtttcaccatgttggccaagctgatctcaaactcctgacctcaggtgatctgcctgccttggcctcccaaagtgcttggattacaggtgtgagccactgtgcccagcctgttcagttaatattgagaagtattttctaagtttgcccacttgcaaaatcatttgtgaatactatgcttcagcttatgagtagtttggttttttattacttgattagcataattctatggaattattaagacatattattgtccctaatcttggtattgtctgtatactccagatgagtgatctggagtatataattaacaaatgatagatctcctgattgcagtggtctttctgccacatcatactgtttaccgtggatgacatcatactgtttactgtggatgatcagttgttttggtttcagtacaagttaagtagttcctctctgcctgggccttgagcaagcaaaacctcttttaaaaggaaagaaataagtggtgttaggttataaatgatgcagatcttcattagtctggcaagatctataacctcgtaagttgatctgatttgagcatcatatctataataagtagcctgtaagaaattcaatcaggcaggccaggcgcagtgactcaagcctgtaatcccagcactttgggaggctgaggcgggcagatcacgaggtcaggagatcgagaccatcctggctaacacgatgaaaccccgtctctactaaaactaccaaaaattagctgggcgcagtgacgggcgcctgtagtcccagctactcaggaggctgaggcagaagaatggcatgaacccaggaggcggagcttacagtgagccgagattgcgccactgcactccagcctgggcgacagagcaaggctctgtcccaaaaaaaaaaaaaaaaaaaagaaagaaattcattcaggattccatagtcaataacttaacaaaaggcagcaggaaagctttactgatgatagtgttaccagcgctgtgtttcaaaactccagggggcatactcatattgtattctttatgttatcctctggtgttgtgcaacatgatgatactccatgatattttaagaatattgaaagagagttgtttaatgaaagagctctgaagattgagctcttttattctggctaactctgataatcagtaagtcattttcccagagagaatcttttcgtcttaaaaggctgaggtcaactgtcacagctgcagtttctccagggaaaaatagtccttgtacttagccaaaaacctttcaatcaatatttgaagagagagccatatcctgcagtcaaattgagggtagttttgcccccttcaaacacagagcagttggctttttagatggatgaactgcgtttggccaggtgacaggagttcaggacactagagtccttatcaaatcttcatgtgatttttgtgcttcagtttttctaaattcaaaatagattgtgaagatagttctcagttggctctgagaattttaagttatggcttagatcaaattaaatatcctgggattatctttaaatgatttatagttaggcacaagcttttcacaacattaacatttctatttgatacagaaaatcattctttttgaatagttggtgatttattttgatttgaaattctaaatcccaaagataattttcttaccgtgaacattgtgttgtttggctggtagttttccctaaagattatttaaaagtctcttattcttaattgaatatgttacacagcctagaagtccactaagcaatgcttccaaaaattatttgcatttagtggattatgcataaccccattttagagctgatgaaaggagtaagcttaaatgcattttcaagatgttgaaacactcgttgccaaaaagaagaataaatattggtctgaaatgaattaaaagtaaatgttttctttgataccagaaagtaccattttgggatgaaaaggtaaagatttttcaaatttatgttaatgataacatttgcttttacttttctaatgctaattttaaaatgccagcatagcattattttcagtctatgcataagggatgtgtaatttttgtagcacaaaaggggtgtgaagctattgttacaaccttgctggtcgtagattaaaccattttagtatgttatcatattaacctaaaagtagaaaaatagaaataaccatatttgaagcagcttatgttgaaattgtatcagtaacatactatagtattttctgagtatttctcccaaaaggttgagtattagctattttatttacgtgagaattatatcttatccatggattagtatgtactcagagaactatagtacaataatatttaatacaaacactactttgaatataatttaatatacaatgaatgtgaaaccgtgacaggcttctgctgtatcttggggtacatctttatgagttttagatattatatggtaccttggaaaaatgctaattgttctcattttaccttttggattttggataaactggggtttgttatatattcctgctatattctttgatgcagaaatttaagaagcaaattatttttattcagtgatattcaagtttgctttttaaaaagatttcttgacagaaataggatagctctatttgattgcatttatgaatgattcctctactggagtgaaaattgtagactaaactctatttgtctctcgcaccactgaaggcagaaatctcttctgaagtcagtaaaaggttaacaggggaaaagaaaaatatgtgatggaaagaattgagcccaataattcttgccattatggtacttacatctgaaacatgtagagtactcttcaagctctacttcccattgttgaattaatatagaaatatttatagaatatgattatgagcagtgtttacttttctagatttataattttattttttaagaaacagtctcagagaagtacttagccttggataattttttggaggaaaaacaatattctttgacaaaattgtctctggtcaaaacgacaacatgaaatgaaatgatttttgattagattgtttaataagtttaagtacttttctgttatgtagaagatttcacctgccttcctagcaatgctataaagttgagatagccgatatgggaaaattacagtacaatgagatgcttgccaaatggtatatatagctagttaccactgactgggtatcaccaggactagaattcacatcgcctgacaggctaacttcatgttcttttcagccaaccacagcctcattttataatctgtggatcactatgaaggcaaagttttgatgttacagagataagccctttcaaaaatctaccagaatgattccttcaggtatactaccactacttaataccaagcagttttcttgagtgataaattaaaaattaccatggtaggccgtctgcagtggctctcgcctgtaatcccagcattttaggagggcaaggtgggcagattgcttgagcccaggagtttgagaccagcctgggcaatgtggtgaaaccttttctctacaacaaatacaaaaattagcctggcatgatggcccatgcctgtcatcccagctactaatggaggctgaagtggaaggatggcctgagcctgtgaggtcaaggctgcagtgagccgtgatcatgcaactgcactccagcctgggtgacagagtgaaaccctgtttcaaaaaaaaaaagaaaaagaaaaagaaaaaaaatcaccatagtaaaaataactttcacccaaaaaggtagagactaaataaggtgatgcattgacttactatttcctagcccagctaaggtaccatttctagcccaactgatttagatctttatcctggcttgaatttggtggcacctcctagtccctcatggactttttttccacatcagacaaaaccactgaatggttttgtgtagtctggcaggattgttagttgcggtggtgtagaagcggaaacaatttgggagttgtaggttgaaactgaggtgcctagttctatgaagtggtattggtactgaactttgagtaccagatttatgtatatatttaaaacatttttttaaaggtggatagtagtggtggctatttgagtgtctttggaatactgagacactcggcataattgtacatcttataaagtggaattttggagcaggatgggttgtaaattcactgtaaatttagaatccaaacaaaactcatttcatgtttgtctaaactattttaaaccattttgatcttactaaaatttctttctgtagtctgtatttttgtgtttaaggctaggtttttctttttcactatggggttcatattcagttggcctgctaaatcacttccatactggtcctaagagaggttcatgctactctgttacactaaatccattataatctttattgacaaataatattgaggatccacaggattcactaagttcttaggagacctgacgtgataaagagaagatatgatcagtgcctaccaaaagcccatgttatagggcattagaaaagcatggtaaactattaaaaaaattggtaaaaagttttatcagatatacagcagtaagcaacttacatgaggtagataagtttggggttgttttaagaacatattttgcttcttcttttgaactcttataacattcactctttttcttaggtgtcggattaaagaatcagatcacattgctttgtaatggtcaattcccaccgtgtgaatgaaataagaaaaatggtcttgaattttggattacaaatacaatattgccttcaatctacaatttcattaattttttacacagttacctacattttctactttttttttttacacttcattataacacattgacttgtttcttgttttttcctcagctctattaaggtataatcaacaaacaaaaatagtatatatgtactgtgtagaatgcaatgtattgctatatatatacattgtgacaggattacatcaagctaattaacatatgctttacctcacatactgatatgatttggatctgtattcccacccaaatctcatgttcaattgttggaggtgggtgcggctggtgggtgattggatcttgggggtgatttattgtggtttaacacaattctcctagtgccgttctcttgatagagttctcacgagatctagttgtttaaaagtgtgtagcaccttctacttctctctcttcctcctgctctggccatctgaagtgactcactccccgtttgccttctgccattattgtacgtttcctaaggcctcctcagaaaccaaacagatggccagcatcatgttcctatacagcctgtggaacatgagccaattcaacctcttttctttataaattacccagtctcaggtatttctttatagcagtgcaagagcagactgatatacatacatacagttatttgtggtagagaacactgaaaatatactctcttagcaatttttaagtatacattattatcagctatagtcaccatgctgtaaaatagatctcgaaaacgtatgtatcctaactgaaactttacatcctttaatcaaaaacttcccccttcacctctccctagcttgtgataaccactattcaactctactgtgagtttcacttttttttttagactctacacgaatcagtatttgtctctctgtgcctggcttatttcactcaatataatgccctccagcttcatctgtgttgtcttaaatcacaggatttccttctgttttgaggctgaatagtatttcattgtgtttatgtagaatgttttcattatccattaatcatagatagacaattaggctgatttcatatttttgctactgtaaataatgccacagtgaattgactttggacatatacctgtaagtgggattgctggatcctatggtagttacaattttaaaatttggagggtcctccacactgttttccataatactaatttatattctcactaactgtgtagcagggctccctttctctacatcctctgtaacacttattatcttttgtctatttgatgatagccattctaacaggtatgatatgatttctcattgtggttttaatttgcatttccctgatgattagtgatgttgaatattccttcctatgtttgttggccatttgtgtaccttgttttgagaaatgtcgttcatatcatttgcccactttttgttctatggatcagaagattctttgtacatttttaattggctgattggttttcttgctattgaattgtttgagttgcttatatattttggacattaaccccgatgaaatatatggtttacaaatattttctcctattctgtaagttgtcttttcactctgctaattgtttcctttgctatgcagaagccttttcatttgatactgtcctattgtctgcttttgctttttaaatctgtgcttttgaagtcatatccagaaaatcattgcccaaaccagtgttgtagagtttttctcatatgtttttttctagtagttttagggttgcaggtcttatgtttaagcctttaatccattttgagttgatttttgtatatgatgtgagttaagggtccaatttcattcttctgcctgtggctgtccacttttccagcaccatttattgaagaaactgtgttttctccattacttgtccttggcacctttgtcaaagatcaatttagtgcaaaagcatgaatttatttctgagctgtctgttctgttcccttgggctatgtatctgtttctgtgtcagtaccatggtgttttgattattacagctttatagtatattttgaatgaggtagtgcgatgccttcagctttgttctttttattcaaggttgctgtggctatttgaggtcttttgtggttccatatgaattttaggaattgttttttctatttctgtgaaaaatgtcattggaagtttggtaaggattgtatagaatctgtatattgctttgaggagtacagaaattttgacaatattgattgcacattttggtcttgttcctgatcttagaggaaaaaccttcaccttttccccactcaatatgatgttacctgtgggcttgtcatataggatctttattgtgtttaggtacatttcttctgtacctaatttgttgagaagttttaccaagaaagattgttgattttgtcaaatgctttttatgcactcattcagatgatcacttgattttagttccttattctgttaatgtgatgtatcacatttattgttgaaccatcctgcatccccaggatgaatcccatttactcatggtgaatgatccttttaatgtgctgttgaatttgctttggtagtattttattgagaaattttacattaagcatttatcagtgatatttgtctgtaattttcttctcttgtggtgtccttccctggctttggtaccataatacttgccttattaaatgagtttggaagtatttcctctttttcagtcttttggaaattttgagaaggattgatgtaaagcctttagatatttagtataattcactagtgaagccattagtctggagtttttattgctgggagtttttttgattactgatttgatctccttttacattatttgtctgttagagtttgtatttcatcatgattcagtcatgataggttatgtatctctaagaatttgtccatttttttagcttattcaatttgctgccatataatttttcatagtaatcttttaggatcttttatagttctatggttcaattgtattgccatctcttttgtttatgttttttttgaaactttcttattttttagtctagctaacgatttattcaatttgtttttcttttcaaaagacccactcctaatttcattgatcttttttattgtttttttagtctctatttcatgtattttgctttgatcttcttccttttgctgactctaggcttaatatgttcttttttttctagttccttggggtgcaaaattggtttttattgacatttttctttattcttaatgtatctattgctatatactttcctcttacaaatgtaagagtgtgcatcccataagttttggtatgttgtgttttcacattacatcttacaaatgtaagaatgtgcatcccataggtatgttgtattttcattttcatttgtctcaagatattttttgattttgcattctatttcttttttgacccattggtggttcaggggtgtgttgtttaatttccacatatttgtgaattttccaatttttttctattatttatttctagtttcataccattgatacacatgaagtagttttacacagtttttgagtccagtaaattctattatttatgcttttattatttgacactcctctcctcctttgtcttcaccccattatacctcacagcaaactctttaccaaacccagttagcatttccctgtctgcactagaggatattttattaataatattattacccctgaaaaataccttcatttaaaataagaagctaaataaaacagaattgaggtatagaaggaaagtagaggtagaaagctaaacaccttcaatgcttattctctgaaacacataattttaagatatcctaaaacttcagagagcagctgcatcaatatttagttggaacttaaaatccccagtagagtccaacttcccagcaagatagagtttgagcaaagtgataaatgttagtatggtattattggcttgaattaatttgaagagacatacgcagaggggatccttggcagtaatgataatgcatataaacaaaagatactaaatgctaaacaagaaaaggtgcaaaatattttccaagaaaagaactgaaaagcatggctctttggagctggccagctgctctctggtcctcttgtttggctgttcctgttatattgcatgccttccattcttatgaaatatgcttttgagataaacaagagggaaagaatagcagttgtcatttgacataattgtggagaggttcaatgatacaccacaaccagaaccaggatggagttctcctgtttgccaaaattagggatctttctattgatgacagctagttttcaagagacccacaaaaatgttttatttttaagataaaatatttgcacctgagattattttagtggattattatgtctgtcttcatctaacatttttatgattgtttacatttttctggctctcaacttgcaaaataaataccgtattgatgaattgaatgtatgaaatacattgaaaaaattcaaaatggggaacatttttttagtcatttaaatgtagtctaacaatatgtctactaaatgcaggagccctgatactaaaaaaaggaaaaaaaagtctgaacatgaattgtttcttagcattactctagtgtataaatgtgtgtgcttgtgtttgagctaggagcgcaggaatgaaacaataaaattaggggataacaggaaacaattttaaaaataaagaaacaattagagtagataaaccaaccttatgacagcaattataattccagaacatattttctgaaataatcttatgcctgaagagtgtgtattattagttttatacaaattcctaatccaattataatatacaaactctaataaattaattaaaatgaagctgataatgttaatataattaaaatagctttagctctcgattagacttcttggtcatgctttagataagatgctttagttcctttgtttattatttcccatagatagagtaaatccaattctatttatccaaattggctttgtgttttacctctcaaacagtcattattttgaaatctaagtggctaagtgccatgacgggctaaagatggatttagagaaggcatgtgatttgagtgagagaaaggttatctttactttggtcaaatgtatttctcttgtttcagtaatgccagatgtgggtgtcacagttcaatttcccttttgccctaatgatttttttgtgagagagtcatgtcctatatagcataggaattgagtaagttgatgatggaagttgaaacctcaggtgaagataaattttccaactaatttgttatttggaggatcattctgagctattgaatcttgcacttcttgtctaaaaaagtcaccaccttggaaaactcgtccttgtacagttttaacataccattatcatcacatcttttaactattttatcagaaaaatgtttaggattggaagcagtgtcagtgttaaggaactagaggaagaaattagaagatatactagatttggccaacaaacaacaagagtacttcagggatttcaaatctgatttataacttctttaaaaatgaaagttaactatttttaacaggactcacgagactaaaagaataccaatgtttttggaagaaaggttgaggaatatttgaattggcaaatgaagaaaatttacaagccaaatatgccttcatagttgccacaatacctttcccgacacttcatttatcttaactatattagggctaataagtttttaggttggcgacctccaaggaaaaccttgttgaagattcggaataaaatacaaggcttgatattagttacattataatgccacaaataccatctttcagtgtctattttttttaattcaattaagtgagaatctacagaaattagaatattgttagctgcttcataatatttagtaaaagagatattattcctaaattaaagtagtttactgagcgaaatttgaaatttgtaattaggttttagtaaagaaatagaagaataaagttagtagtattatcaaatatcaattcaaaataacaattttattaacgactgaattagccatatctaataaattagcttacaaacatttactcatattaacaaaagcaacaataattaaaatgtcaaaaatatttgttaagccttattacatgaatgcacagcttatatacattatctaagtctatctagataatgtatatatacattatttgtattatttgtagaaatcataaggagctatagtagccattattttccccattttatagataagaaaactgaagttccataagtaggtgagggatgagataattctgtaagtagaacccattttagaaccctattatggaagacacagaagcagtagaaatcattgcctctgctctcattgtgattgcaaattagttggagagataaaattaaatgaaaaaaatgaaaaatgcaaagcaataaagaattaattgcataatttaagagcagctggagctcaaggaagagatcaacagaagagtaggcataaaatgcttcatggatgaggtgaatcatggatatctcatatttacatagaaaggtggtagaggaggtatggggaaagaaaataacacgtatggaagaaaccatgaacactgcacttgataccagtccaaaaagaacaatgaactaatatgtcagtcattactactgcaacaatttaataatctatttgaagaaaaggcttaaatagtcttccagagagaagctttgggtttttttgcatatatttttgttatagtgtcaatattcactaaagtttccattgcctaaacatgttggaagagactaactccctttagatgagccaaagaaagaaagcttgtgtgtcttgttaactgctgtactcacaaaatctagaacagtgcctccctgcacatgttatgttcacattaattatctgttgaataaatgaattaatatataaatatatagaatttgtgagtaacatcacagtttttaaatctgagaacatttaagctttttccaaatgttaatcattgataaatatcacagtaattttatttaactagaaactaaagaatagtgagagttaatgtttacccagcattccatagtgattcaatattagggacaagaatcttcacatttcctctcttccaaaagtaaaagatttcattatgttaccttcaacaaatgataagaacactagactgttttcaaaattactgagtttgaatcccaccaagtttactacttcccagccctatgctgttgggtaagttacttaacttctgtaaatctcagtttgctcatcatagattgaaattgtagaatgaaaataacctttttgcttcctatacagcagaggttattgagatccaaatgagataatttctatgggggaaccattaacatattgtagaaatgttacatgttttgaatcatttctttaatattaacaatgtttctggccaagatgcacctcatagataacaacataatgttaagcctgttattattatagcattaattatggaatgtacgtatttacctatagggtaagattcattcattcatataaagatctaaggagaaatcctcaggtagaaagaagttattcatatttaggaaagaatgtaggccattgtgctcaatagtgaatgagaaggaacatagtgctggagggtctcatatgtcgtttaggttcttagatcatttacatatcatttagggtcttataggccatgacaagtagggtggatttattggtaaatatatatatcattatgtttatttgaaatgtagtacttttcaactgaggatggcagtgttatcttactttttaattggaagagaaatcaagataagagaacttataggtatgtacacaactggattatgagagatgagcagttatatatatgctctgtggtatcctgcacattttttaggctaagtaaaaacagtaatggttatgatattactgtgtcttaccttaaatttattttagagtcatctgatctattctaaattttgtttggccatgaattatattttatttagtcttgtgtaggacaggatttttctttgttaaaatttttttttaccgaagtattatagtatataattatggggataagcaacagtttcttaccccgtcccttcccactcatagttgagtagcttagccaaaaaccgctgttaattttttaaaccattacttctggaaattggtgccatatttctaaataatatgatttttaccactagtttttgatttgtcaatttgagacattctttttatttacttctctatgggtaagaatttcactgatttaaagaacggactctatgcctatcttcctgatatatttaatcattttaaattcttcttttggttatcattttaactttaagcaacaaattcaccttttttcttattttatcacttataaacatctttgcatctatgctttgtagagggcagtatcagtgcctgctagatactttgacaagttggctagaacagcgttgttcagatggagcatagaacatcgagattacttttcttcaccatggcaattgagtactgatctttgtcttccatctcttaagtacatttacttctgaactatgtatgctatataattcatatctgtgatagtagtgggtgacttgatagatattatctggctatgtgtacttccatgttagcaagtgatttatgtgtcaaagtttctacccagtgggaattaggtcagtttaattttgttgttgttgatgttttttccttcttcttcttctcttttttttttgttttttaagaagacgaattctctctgtgttgcctgagctggaatggagtgcagtggctattcaaaggtgtgattatagcacacaggggcttcaaattcctggcctcaagccatcctcccacctcagcttcctgagttgctaggactacaggctcacaccactgtaccactgtgcctggctaattttcttggtattttatctggcatagctccacatataataaggtcattataaaaattcttttttagatatttatccataaacattcaaacagatttattcaattaatgacagaatcaaatgcctagtagaccaaggtaacccaaagagttataacatattgtgattccccaagattttcattgttttctgcaaaagaaatgtcagcattctgggaattttaaacttaactctttgagactttgtgaagttttaaaaacattttggttatttatactttatgctgtatagcccttgagacagtcaatgtcacttgagacaatcacttgaaagtgatggagcaaatttaataagtctttcataattatatattttccagaggactgtgaattctggcactcagtcttgtagaacacttaaacacctcttgtagatatgtgatggttagatttccaatgttaaattattggcaactggaattggaaagaaatatggcgccatcaaagctttatatcataaaagagattagtgttagactaaagtaattttgcaaattagaatattgatttgaaattagaattatgaaatatagtaggagacaaacataaagcattatggttagagagggaaaatagcataaagtccagaggatgagtaactgactatgtataaagttagaggccgggttcagtggctcacacttgtaatcccagcactttgggaggccaaggtgggtggatcatttgaggtcaggagtttgagaccagcttcgccaacatggtgagaccctgtctctcctacaaaaattggccgggcctggttgcgcaagcctgtaatcccatctactcaggaggctgaggtaggagaattgcttgaacccagaaggtagaggttgcagtgagctgagatcgcaccactgcactgcagcctgggtgacagagtgagacaccctccccaccccctcacgcccccaaaaatgttagaaactcccttaatagtaaagtattggcattagctcacaatataatgtggttaaagcaaacaaaatacattgtgacataaatatgaataaaaaatgtaggaaactcgagattatttttccattgtccttctcacttggtcagacccttacatgagctttgtttctagttctctgtgctaccgctaaagaaggacgtggaaaagttggagaaagttcggaagaggaccacaaagataattaaagggttgaaaaagaaacctaaaagaaaaaaattaaagtagcagggattattgttccagagaaaagaagacttagaggtatttaacttatgcctgaaggatggaggccagatgttctcaatcttcactgaaggtcagacaaaaaagaaatcaacttaacctgcagcatgaaggatttaagttaaatatgaggaaaattttacactgagaatgttagaataggctactatagaacgtgtgacatcctttacaacactatagatacttactgacaacatcaaagagctcaaagggcattcatctgatgcacttatcattctagtagctcattagtaaacacgtattttagcatttttgaattctgagtgaagaaaattaacagctgatctggacattctgacttatgatcagttccatggaaaatgtggttgatttcatagaagtaatgtaattaaagttacaatgaattctgtttataagacactgtagtgtgctgctccattaaatcagaaggatagacaatctgacctctgaaagtctttttttttttttttgagacagtctcactctgttgcacagctggagtgtagtggcacgatctcggctcactgcaacctccgcctcttgggttcaagcaattctcttgtctcagcctcccaagtagctgggattacaggtgcccaccaccatttctagctaatttttgtatttttagtggagatggggtttcaccatattggccaggctggtctcgaactcctgacctcagctgatccacccacctcggcctcccaaagtgctgggattacaagtgtgagccaccatgcctggcctcaaagtcttttttaagcccactttcttttaactacacaaaactttaaaaggcaaaggacagctgtttcttatcagttggtttgatgataaataccagtaaaaaagcgaaatgattacattgaaatttaaatatattttaattctagattttaatttttatatacatatttaaaaattttaaagtgctgtggtgattttttttatagagtagctctttcatctgcatttttattatgaagtccagttttcaaaattagtgttgttgaataatttgccagactgtaaataaaaattctttaactttgcaaaccaacttccaaggtactgcctagcagaattagactattggctgcttgaagctagacttaaaagaccctactaacaatagaaattttttctttttattgagcaatgtgtaacatgtatattatgctttttcttccttgacttaaatagcttctttggttttgaggtttttgaggaagacaaaataagctgtgtactttattttaaggcaaagagctgttgtggtctaccatgttctgtaaaactaaaataatactgtagtaaaaatttggaaagaaaaaattttagatgtagtaaagtgtataaaccgtcttcatattacaagtaacattaaatggactgatcaattttttattgttcataaagcattttcattatatgctggtatcaagtatagtttttaattcctttttaaatttattttttgtatttaaaaaatttattgtttttattgtatattgacaagttataaaatttttttaatgggcaataattgtatatatttatggcgtacaatgttatgttctgatatatgtatatattcattactggatgattaaattaagctaattaatataattatcaccccacatacttttatttgtggtacaaacatttaaaaatctacttccttagtaatttttaaatatacattacattcttaactatagtctccatgctgtgcaatagatctcaaaaacttattcctcctaagtgaaaccttgtatgctataatcaatatctccccattcccttctctcccatccctagcctgtggtaaccaccattcaattctctacttctatgagttgagatattttggatcccatatatgagaccatacagtatttgtccctctgtgcctggcttatttcacttaccataatgtcctacaggttcatctatgttgtcttaaataacaggatttccttctcttttaaggctgaatagtatttcattgtgtatatattaacacattttcattatccattcgttgtagatagacagagattgatttcatgtcttagctactgtgaattaccccacaatgaacatgggagtgcagatagctccttgacatactgactttggatatgtactcataaatgggatagctggatcctatggtagttataattttaaaatttggagggtcctccacactgttttccataatactaatttatattctcactaacagtgtagcagggctccctttctctacatcttctgtaacacttgttatcttttgtctttttgatgatagtcattctaacaagtatgagatgatttctcattgtggttttaatttgcatttccctgatgattactgatgttgaacattctttcatatgtttcttggccatttatatgccttcttttgagaaatgtctgttcatgtcatttgcccactttttgttctatggatcagaagattctttgtacatttttaatagggtgattagttttcttgccattgagttgtttatatattttggacattaacccctgatgagatgtacggtttaaaatattttctcctaatctataggttgtcttatcactgttaaatttcctttgctgtgcagaagctttttcatttgatataatcccgtttgtctgtttttgcttttttaatctgtgcttttgaagtcatatccagaaaatcattgcccagatcaatgttgtggagcttttctcctatgttttttttctagtagtcttatggttgcaggtcttatgtttaagcctttaatcctttttgagttgatttttgtatacggtgtgagttgagggtccaatctcattcttcagcatgtggctatcaagttttcccagcactgtttactgaagaaactgtgttttctccattactcgttcttggcacctttatcaaagatcaattgagtataaagcacagatttatttctgggctctctgttctgttccattgggctatgtatctgtttttcgaaatgtggtagttcaattcctccagctttgttctttttgttgaaggttgctgtggctatttgaggtcttctatggttccatatgaattttaggaattttttttttctatttctgtgaaaaatgtcgttggaaatttgatagggattatatagaatctgtagattgctttggaaagtgcggacactctctgccaatattgatttttctgatccatgaacatgggctatctttccatttatttatgtcttctttaatttttttaatcaatgtcgtatagttttcagtgcacagatctttcacctttttggctaaatgtattcctaaggtttttttttttaatggtattgtaaatgggattattttcttgatttcttttttgggtagttcattgttagtgtatagaaatgctactagtctttttacattgattttgtattccgtatttaccgaatttatgttattagttctaacagttttttagtagagtctatttctgtatttactgaatttatgtattagttccaacagttttttagagttttctatatgttagatcatattaccagaaagcagagacgattttatgtctttctttcaaatgtttgtgtcttttatttttttcttgttctttttcctttttttctttcttttttgcctaattgctctgcctaggacttccagtactatgttgactagaagtggtaagagtgggcatcattgtcctgttctaatcttagagacaaaaactttcacctattttttattcagtatgatgttagctgtgggtttgtcatataggatctttactgtgttgagatacatttcttttatacctaatttgttgagaatttttaccatgaaagattattcagttttgtcaaatgctttttctttacccattgagatgatcatatgatttttgtccttcattttgttaatgtgatgtatcacatattgatatctatgttgaaccatcctgcatctccagaatgaatcccatttgatcatgatgaatgattcctttaaggtgctgttgaatttggttttctgttgaggaattttgcatctatatcaatgagtgttatttgcctgtaattttcttttcttgtaatgttcttgtctggctttgatatcatgataatgctagcttcataaaatgaatttggaagtagtccctcttcttcaatcttttggaaaactttgagaaggattggtataaattcttttttagataagtcaaaattggatgcagcagaagatttcataaaggtaaatttaagctagattattaggggttttgaacttcaggctaacgtgtttagattttggggacaattgagtttttgagtgccagaatggcatgagcacaactgtgctttctttaggaataataagctatgtactgtataagatagatttgaataaaagatatttgcattaatcctaacacagttaaaggtataaattagggatttgtaaatagggtcagaactgaaaggacaaatacagctacactgagaaagatttttcattcgtatgaaagaagaaaggaaagggaagactcaaaagtgacttcaaagtgaccaaagttcagtctaataaattgtactccaatggtgtaaaagaatgaaaacactttcttattctggtaacgtataatcaaacctttcctgattatagaaaagtttctaaattttctaagttgagagattatgtcagtcttatgtgctttttctttccctgatacctggtaagctctggtatttgttgaaaaagtggtttaatttttttgattcactaatcatgaaagaatatcttattaggtgaatttttatgtgaatcaaacatattccattatctatttaccaaggcaatactatattaaatataccttttaaattgttttgattcccttacaaacatacagcaacttcatgatctgtattttgatacttcaaaaataatttttttcttattttttcttatcttttgtggtttcttacacattttagggttttcgttttctgtgaattgggaaatggaaatagggagtggaaattggaaggttattagattactggaaattaaggatattgagaatggatttgtgtaatcctaagctgatataatctttctagagggctttaactctataaacattataaacacttactatgctccaggaatttttttagatgctgggatacaatcgagagcaacagagaccactccctaatctcagagaatttgagtctagtgtagaaaaacgcatatgtaaaaattaccagtttgatgagagatatgtaagaaaaatttaaggagctaaattttattaggggaatctcagttaggaaacatttccttcaggaaatccattgaaaagaatccgaagaattagtaggaataacctagccgaagaaagtttagtcagtagaaaagtgagccagatagcatgaatagcatagtcagatgacataaaatagaacaaagcatttttgtttgggaaacgaaaataagacgaatatgtcttgagactgaaaagagaggacagagtggacataaggcaacagaattggataggagtcagatcatgacaatataaatgataatccttaaatatgtttcactccttggaatttataatggaaaaatcagacaaatatataaaaatatagtgatgttcattgtgattaattttgtatcagtgaaaacttggaaacaaaaattttcaacaatagagaattcttcaattacacttttctacatccatacggtaaaatatgataaagccattaaaatgatatccatatatctttcctgacttagaaagattttcaaaatatgttggtaactaaaaatcaggatgcaaatgatgtaatatcccatttttgtggatgtatagaaatatagtaataacttatttattgtaaataaatatgtaacataatttagtgacagaacaatgaaagagaaagttattttgttatccaggagaaggaaaagggttggaatagtaatgaagaaaggcccagaggacagatgttataatctgttgaattggggttattgatgatggcaaagaagtgaaaactctctattcataggcttttgtaactgagctcttgttagctaaatcaatattttaaaatggtgtggggacagttttgccagggcaaaagacatttctggctatctctatgctttccaataaaaaataccctatattagaatgaatgtaaaactcaaattatgatgtgactagccagggagatattttacaaatggtaaatctttaattcatgctatcagcaaaagcatgacgattagtgatgttgagcattttaaaaatgtatgtgttggccattcgaatgtctttttttgagaaatgtctgttcagattatttgcccattccttaaatggattgtttgtacttttgctgttgagatgttttaattccttatatattctaggtatgatgttaatctcctgtcagatgagcagtttgcaaatattttctcccattgtgtaggttggcattgtattctgttgattgcttattttgctctgcagaagctttttagtttcatatagttccatttgtttatttttgcttttgtggcctgtgcttttgaggttttatttataaaagttcttttctcagaccaatgtcctgaagcatttcccctacgttttcttctagtagttttaatgtttcagatattacatttaggtctttgatcaattttgaattgagttttgtatagagtgagaagtgggggtctggtttcattcttttgcatatggttatctggtttccccagcaccatttattgaagatactgtcctttgcccaatgagtgttcttggcacctttgtcaaaaatcaattggccgtatatacgtggattaattttgtgttctctgttctgttctattggtctatacatctgtttttaatgccagtaccatgttgttttggttactgcagcttcgtaatgtattttgagttctggtagtatggtgcctccatctttgttctttttgcttatgattgccgtgtctattcggggtcttttgtggtttcttacacattttagggtttttgttttctgtgaagaatgttgttggtattttttaaggaattacattaaatccgtacattgatttgggtagtatggtcattttaacagtattaattcttctgattcataaccatgggatatctttccattggtttgtgtcctcttcagtttctttcatcagtgttttgtagttgtccttgtagaggtttttcacctcctcggttaaatttattcccaagtattttactttatttgtagctattgtaaatgggattgtcttctggatttttttcaactagttcatttatgtatagaaatgctactgatttttgtacattaattttgtattctgtaactttactgaatttgtatatcagatctaagaggttttttgatagagtctttaagttttctatatataagattatgtcatctgcaaacagggacaagttgacatcctctttccaatttggatgctcttcaactttccctttcttgctttattgttctggctaggacttctagtactatgttgagcaagagtggtgagaatatgcatgcttgtcttgtttcagattttagaggaaaagcttcttttctctgttaaatatgattttggctgtgggtttgtcacatagggcctttattatgttgaggtactttccttctgttatggtttagctgtgtccccacccaaatctcatcttgaattttagctcccacaattcccacatgttgtgggagggacccggtgggaggtaactgaatcatgggggtgggtctttcccatgctattctcatgatagtgaataagtctcatgagatctaatggtttcataaaggggagtttccctacacaagccttcttctcttgtctgccaccatgtgagacatgcctttcaccttccaccatgattgtgaggcctccccagccacatggaactgtgagtccattaaacctctttttttttgtaaattgcccagtctagggtatgtctgtgtcagcagtgtgaaaatggactaatacaccttctatacctaatttattaagagtttttatcattaaacaatattgaattttatcaaatgctttttctgcatctattgagatgattatgtgggttttgtccttcattctattcatgtgatatatgacatttattgatttgcatatgttgaactatccttgcattcctgtgataaatctcatttgatcatggtgtattatctttttgatgtgctgttgtatttggtttgccactattttattgaagatttttgtgtctacatttatcagggatattggcctggagttttcttttcttcttgtctccttgtctggtagtatcagagttatggtggcctcatagaatgagttaggaaagatttctctctgcttcacttttttggagtagtttgagaagaattggtacttacccttcttagaagatttgttagaaatcagtggtgaagtcacctggtcttggacttttctttcttagaagtctttttattattgattcagtctcttataattggtctgttcaggttttctatttctttttggtcaaccttagtaagttgcatgtgtccaggaatttatccatttcttctaggttttcacatttattggaatatagttgttcatagtagtctctaatgaccctttatgtttctgtggtgtctgttgtggcatcacttttttttatttctgagatattattcatttgagtcgtctctcttttcttcttagtctagcaaatggcttgtcagttttcgttatcttttcaaaaaaccacctttttgttttatcgatctttcatattttttagtttcattttcatttattgttgctctgattttgttatttcttctacaaatttggggtttgggtttttcttatttttctagtttcttgagatgcattgttaagttgtttatttgaaatcattttagttttttgatttatgcatttattgctataagctttcctcttatattgcttttgctatgtcctataggttttggtatgttgtgtttctatttttatttgtttcaagaaattttaaaattttattcttaatttattccttcatccatttgttattcaggagcatgttgtttaatttcatacgtttgtatagttttgagtgttcttcttgaacatctgatgtttccttgttgattttctgtctagatgatctgtccaatgctgagagtgacatattattgcagcctatctctctctttagatctgataatatttgctctatgtatctgggtgttcctgtgtagggtttatatatatttacaattgttatattctcttgccgaattgatccctttattattttttaaataatactttgtctctttttacagcttttaatttcaagtttgttttatctgatataaatagaggtatacctgctctcttttggtttcggtttgcatggaatacctgtttttatctctttacaggtgaagtgtgtttcttgcagacaatttatattgggtccttttttttttaaatctatttagccagtttatatcttttcaatggggaatttaatccatttacattcaaggttactattaatagataagaatttattcctgtaattttatcgatcattttccagttatttggtttatcatttgctccttccttcctctcttattgtttacttttaccattgggtggttttctgtaatgctgaggtttgattcctttgtctttattctttgtgtatttgcttgaccagtgagttttataattctacatgttttcatgatgatggttattattttttgatttccagatgtgagatttccctgagcatgtcttgtaaggccaggctagtgttacgaaagttccttaggttttgcttgtctgtgaaataatatatttttttaaatttctgaaggatagctttgctgggtatactattctttggtggcatattttttttttctttcagtgctttaaatacaccttctcattctctcctggcctataagatttctgctgagaaattagctgttagtctaatggtgatttgtttatatatgacttgacacttttctctcattgcttttaaaattctttgctttgacttttgacaatttgactatgtgtgccttggagaggacttgtttggagtaaatccatttagagttattcgagctttctggactctctcctaagactttggaagtccatctctttcccaagtctttggaagttttctgttattatttcataaaatatggtttcctcacttttttccttcttttctccttctggaagctcataatacaaacttttgttaacttattagtgttccataaatcctataggctttcttcattcttttttgttcctttttctttctttactttttctgcctgtgttatttcaaaatacttgtctttctgtttggaagttctttcttctgcctgatctagtctgttgttgaaactcttgattgtatttatttccttcatttaattcttctattctagtatttctcttttcttctattttttatttcatatttatctctattgaatttctcattcaaatcgttaattgttctgatttcattaaattgtctatctatattatatctcactttccttaagattatttttttgaattctttttctggcatttcatatatttccttatgatttggtttctgttactgaagaattattgtttttctttgtgggttgcattttttttttttttgctttttttatgattgacatgttcccatattgatttctgtgcaactggtagaaaagctacctcttctaattttatggagtaggtttcatagggaaagattaatccatataaataggtcttggggtgtcagtttggtggggtctgttagccttggttctagatagacacagtagtattgtctgtgtatagtttcttcagctgtaattcacattagtggtgtttgtgaatttctcagtgaccttggctgagagagtttgttttgatggtggcatagctttgccggggtgggcttgctgggctatttctcaggtcagaaatgtatgcacatggtgggttggctagcttgcagtctgactcactaggtttagggccatcgtgctattactctgattggaaacacaggcatgcagttacttagacagcctgggggtgtgcctgccaagagtggcttggagggctatttctcaggtccaggacatgagtgcacagctgcttggctggcatggggatgtgtctgccagggttggcccacagggctatttctcaggcctgtaatgcaggcataaggatgttcagctggcttggtggcaagtctgctgggggcaggctgtttatcttgcctaggacacagctgcacagctccttggttagcctagggcgtgtttgccagtggtggcccacacggctgtttcttaggcctgggatgtggtcacatgacttcttggctggcctgggtgggtgtctgctgcaggtggcccatggggctatattcctggctctgggctcaggcacacagctgcttggctggctgggagggtgtgtctttcaggggcagcccatggggctgcttctcaggcttgggattcagacaaaaggctgcttggctgccctgggggcatgtctgctggtggtggaaggtaacgctatattttggagatcttaaaatgcaacttaatcatgtgttttggtcagtttcttctgatagccatgcctaggcaaaagtgactagaagattaaagagttgaaagtatccatacccaaaaagtataccaacgttacagtctcaaccaaattctctagttttgatcttgctcaattgtccaacgtcattatgaatttagggtaaaagaatggcaacatatgcattcatctactcactcaaaagtggaaccctgatttccctaaagtactgggctttatgtagattccctatgaccaactttcttaattctttttcatctgaagccgttattacactttcacgaaaagaaaaccaaaaaagtaccatagggataaggtgctatttttctatccaaattcagaataaagaacattttccaattttatttcagcttttcttttaattcttagcattccagtgtacttcttagcctagtctgaagttaggatcacaggcctaagtttgggggcttctgccacctgtgggttggtaaggatttagtagtgactgatttttgtaaagggtgttgagagtaagcaattagaattccttttcctcaatctcttctttcttcaatttgtactgctgcaataaaagtcctaaaagtataccaattatatatttgggataaagcgagactccttgcattatttttctttgtaatttttcctgaagtggcttggatctggaggaaaataaggtaaacccacagtatggcagagaagagttgatgggatgtagagtgaatatgatgcaaagtaaaaatgagaaagttaggtaaaagaaagaaagagggtgtgaagttagtgaagattattattatagcataaaatttaaaaatgatatttaaatataagatgggagacgactgagagttatatcgaggaactgaaataagctggttcatatttggcctactttaagagacattggcttaagtgtagtagagcttgaattaaatgatttctcaagatttttacatttgtaagaaatatggggctgacagcacagagaatagtttgtgggaaaggaaagaatcaggaatttatacatgaagaagaaggaaaataggaataagagaatgaatagagtaagaaatatcccacaaaaaagaaattgaaaaaggtaaaatatgagataatagtaagtttataaaatatgtaaataataaactaaaagcaattttgagttttaaaaaatgtctcaaatgattaccttgcacttctgctgaacattttgttatgtgcaggtaacatgatattgagtgagtatacacaaagtatggaaaaatattcatattcatcaattctatatttgaatggaaattaagtatagtgaagtttaccttcaatagaaactttaatgtttcagatttattattcccaatttatagtataaatacaacttgattctatattatataattcatggataagatggtgtactttttaatccatgactgaagtctttcttctgcccacagtctgtttctgctattccatgatacatattcagggaaggcaattataagaatggcctaaagaagataaatctattagaagtaggtatcatggtagatatagccacatataaatttttttttattaccttgtcatgccttccatttatcaatctggaatttttattgttgcaaactgagctaagctagtatgttcaggcaaaaccttaggatttggtggataaaggttatcagttataatgaagggaagttttagatcaaattccattataaatataaatatctgtaaaataagcaggaaggcacaaatatcatattccttattttataagcttgatgacattccaactctgttatttaggtgctctgacaatactttgcatgaagagtgccctcaatttgtatatgaaaatattatggggacagaatttattacccttatatttgttatcaggaaccctaatactccaaaccattgagtggacatacaggacaaatctcagatgtgttacctaagtatacatcctgcaaagcttgtggggtttttgtatgggttcatgcaaagtggggcagtgcttctgaaatattttggccaatctacagatctggagcaccactaattttttccttcaatgcaatgaaaaacacatttttaacattcattagacattcattggctaattatcaagtttctcttgtgtttatcatcagagacaggcatagctgaaagagtttctgattaaagttggttgtacagaaatgtatatatgtatgtatattctccctactctcccacctctcccttagatacccactgttatccttccagatttatatctatatataaactcaatctgtatatatactcatggtttgaaaaaatccttctctactatacaaactattttctaagttggttttgtctataagaaaaacaaatctggtttagcattcaatgtttcagcctctctgaaattctcatcgttcttcagatatgccatactctttctagactttgttcctttgaatactctattcttttcttggaatgcttttacttttctttttttttaatctggcttaatctttaaaacctgtttcagatgtatgtcctatatgaatctgtttcctagttttctatgtgtattcactgttttgtctgtatttctatattttgtttttaagtaggttatggcaataatcatcatgatagtagttaacaaatactgattgcataatgtaactctaactatttttacatttattttatttaatcttttttcaacatttttctgtaatatatcacttgtgttttatttccccaaatagaccaaaagtaacttatttatctttctattcctagtatatggcactatacctgggcatatgataaatgttcagcaaactggtagaccagttttaggaagggcactgtggaacttggaggtttagaaatagattctattgaaacatctgtatctgcattaccatgaaaagtcttcctttacgttttcttgaagactgctagaaaaggttgtggctatgtaacaataggcataacacactatgttgcaagataaattgactgtgacaccaagaatatactttatggtgcttcgatgagtacactggtaccctctctatatcttacattcgagggtgttccaagcattgcagtcccatggcttaccaattacaaaagaagaaatagagaggatgaatatgtgaatggtcagaagagaagtttatgcaagaggaaaagaaaatccctttcctcaaatgtaaaatgagcaggatgaagagtttgaaattctaaagatagacagagggtatctccagaaattttaatgagttcaacaacccagtgatatggctggttataatatacaatttagtctggtgattgataagtaagaatgggattatttgctaaccctctcccctactaatattgactaatcgttatttatatataataaaagagaactcttacaacttgaatttccctgtagtttgtgaagctttactttttaactgaaatcttttcgcttctagcataaaacagaggcaaataaaaatttttagccttttacatttattttttactctcactttagaaactttaaatacttttggttttaaaaatgtttacaaggatatactgaaaatgcttaaaataaatgtttatatcaatattgacaggattcgaaatgtaatatttttaaaatatgcaacattatggactcaatattttgtattgagttataatgcagcatggtatagaataaatctgatcaacattagggaaggtttctattgacagattcatttagcctgttgtaaaatcacttaaaaatatttgtattttagccatgctaatttgctggtatacaactaggagaaatatgtaatataaattttattcccattgttgtattacaatatctttttttctttaacaagaacctgtgctagagttaaagcaactccaaatagtgcctatagctcagaagtataaaatgcagtctgtgtctgtaacaaaacctattcccacaggttcaaaggagattggaaataagaagccacctatttgcgttttgcagaagtagtaacagtctgcagacaaggtactctagcttcaaaacagtatggcagatcgttttatggaacttgcgattacaaaaatccactttaacctttctttcttactggcaggtgttctattggcttgcagccagaggctgtgagtgtagtgctgcctgtggtgtccctcagcactgtagagtgctgaaaatgccgacactccagttgattgctcataattgcattaattgtggtctgacaacttcaggagagaagtatgatgaatatagaaaaatatgttacaaatctgatcagattacaaatttcatctctgttttctccatagatatgatatctgcacttataaaaataagccctgtggaacactgggtaagttttttttggtttttttttttttttttttttttttttttaataaaggtagaatggttctgattgtctttttggaccaatgactttaatctttattattaatttggtcattttcctttctgtacatctgaaatcctaaaacctgttacacccagcctttgtggatatgtcatttactaggaaacaaatatttattaccatcataaatattatataaatttcattggcttttttgacaactggaatgattattaaaattaacttagaatatgattcaaattcattaaagaattataaatcgaggttatcactcatgttcatataatctatctctgtaatgtattttctagaaataccaagattgtgagagtaaatgaaagcagtcaacatcttgaaatttcaggctagaaaaggaaagaaaaaaaaaacacaactaaggatacttaatgaagaggcaccaagaacaatactttttttggtacaattttgtggaaaaagtatagccccataaattaagatagtattggaaattttatactacccaaacaacaacaacaaaaaataatcttataaaatattatagccacaggtgaaaagagaggacaggattatctttcttgtgctccctaagggtcatttgtctttttaaaagcatttttgtagtattctagaattttaaaaattacacattgttacagagcataatttcatagttaactgcaaatacaaatgggcaaaaaaggtagctctccagtagtctaaattattaagcaactaaagttattttaaaggacagaagctttttttctcaattttttaaggtcatagagactttttacagactcagaaggtaaacaactgaagatgaattctctagtttctctatgacaagtctcaattttcttatctgtaaaacaatagttatgaaattgattcctatgcacctcacaagcattttgcaaagatcaaattaaagtagttgtaggaggaaaagtgttatgcaactgcctgggaagttcagtgaaatatctcttcggaaactaaaatttctcttgataattttacctgacttcccaggcttctcctacccatttcccttaggatttatggctgaagaagaaatctcaaatagccaatgctgagtattaactatggagaagcttgctagttaaaaagcataatggagacagagctctctttgctgagcgagctcacatcaaaaagatttactttgtagtgttttaagctaacaagaccaacataatccaacagaggggactctgaactgggaactaacaactggctttgacagtttcagtacattaacttttacagtgtatttaagctctttgttcctcaattttgttatctatgatgtaggagtaatatctgcccttatgctacatggacatggttaaaatcatttaaggaaaaaaatgtagatgtatttagtaaagaggtttataaaaatgaactggtattatttaatgtagaaattgcctattcttttaaacttaccccccatatttactgttcacagattctctaagtatttattaagtgttcagtcaattttagatataatagacactagacctcaaatcaggtgcacatattagccagagctagtatttttctagtgtatctatatttgaagaaatgtgtatatacacacatacacacatttgcacatatacactctctctctctctctctctctctctctatatatatatatatatatatatataccctcactgtctctccctatatatatattctgctttttgaaggtaggttatttacatatgctcttcattgtattagattggtgcaaattactttgcaccaacctaatgacattggtaagacacacatacagtgaattttacttttattttgataaataaagtattttgagaaataaagtattttgagtactgcctagtactttgattgtcattattggcaaagatttgaggtgttttcctatgctacttctcattttatttttctcaaaataatgtgttctaactttgatagtttattaatttatagaatcagtacattaataggtatgtgtcaatgcactttcaagctcaatataagttatttttcaaattataaacttgtatattgtttttatactacttcttgtgaaaactgaatgagctgcatatatatgtatatatacacacacacgttttaacttcatctatggaaaatatattatcagtacagaattgagcagattactttttaagttgtattctagtcactttcatattggtttttatactgatttttccatagtcttttgcttaataattctgatgaccaattgtaacatggctaagtaggcttaagggtgcaaactgtggccatcaagctgaggaaacctaaatgaccgaaatagttatcaaatcgccattaacacaatcacacataagaattttgacagtctcaattttataggtatacagaaaattgtggggggttgtgaaaatacattagcatttaaaatactttcattttagttaagatttagctttatatttcaataagtaggaattttccaagtatattctttctgaagttgttgttctagcagagataataattttatataagatggcagaagtaaatctgtgcttgtaaatacaccttgaggagtcattgagaattctcaattgaaaatacagccacatggcacataccaaaaaacgacacaacaacaacaaaacccaaaagctaacccatggaataatagattttgggaaatgtaagaaacattaatttaacaataattattcttagtaattctgcttttcttttgaaaaaacatacatttcataaaggccaaaacagaaacagtattcagagtggctttgttcttcccatataataggccacattgaaccaaataacttaaagccagataatataatgcaatttttaaaaaaatatttcaggtattttcctattctacttctcattttatttttctcaaaataaaagtaaaattcactgtgtgtgtctgtctctttctctcagtggagattggaaatgacattcattaaaatattttaaatatttaaacaaatattaaatattaaccaaaaattaactgaaacaaaaaaataagttatcctgctccactttttacattctctttttcaggtcccaatacctctaatgaatggaagggcagcccaggggtatcaccagtatttataactctgtgaggcagaaatcaactccctccccaactcttgcctgtctcgcataaaacagtaggaaaagcaaacgatctattagcaaatccagcattaatctcatctctgttccaatgtagctgttgatactcatattagaaaatacagagaaacacaacttctagagctttcttgtcagtaaaaatatggattgaataccatttattgtttctaattagtacagctgggaaattatacctagcacagaacattgcttactgtattcaataaatattcattgaattgaatcgaaatcacttttggtgggaaagtaattattaatgtttgggtgatgatagtagactactgaccataaaaaatgtttttcctacttccccttcaacttctaaataactttttgtttctatgtgcatgaaatatgatttggcatctgtttccttataagagatgacatttttgcttttgcacaaaaattctttttttaagcactgctttaaagttctgtagtatttcacacagcatgatattcatttgaaagtaaatattaaaacttctacatactaaaatccccaaggggagaataccttgagtaacataacatttcactggaatcagcgaattaacaccatagtatttgctttattagtaaaactctaatgcattgaagtaagggataggagagaggaaaaacgacactgaatgtgtgaatgactttcctcctattaaaatactaaaagaaattgttgcatcactgtcaggattaatttgagattaaaaaaaatgcaaaaacctcccatctttaacagttctcctttccatcttttgaatcattcattttattttttaataaaaatatcacttaaaaaataatttgggattccccctttttttggtaactagaaagttgcttgtatatttttatgaacccactaaacttaaacagatctctttagaaaaataatgtggatatattttgctttctacagcctgaagaatgttaaaatagaaatgctttcttgaattccctcttctggctcaagttactaggtggtcccaagttaccagaagtaaaatttataaatctaacccctagtctagacattttccagcactgactgcagttcaaaaaatattaatgtctagccggcaaagtgaaattccccccagtgattttgcaaatgactagaaagttaaccttttgccaacggctccttctgtgcatggaggttattaaaaagaatccaggcatttataaatataggcttttaaagactgaaacaccttggcttgaccctttgtgtctctttctgtttattcaggcttggcctctgtggctggaatgtgtgagcctgaaaggagctgcagcattaatgaagacattggcctgggttcagcttttaccattgcacatgagattggtcacaagtgagtgagtttaagaaaatcaaaataaattttagaactctgctcttgagcaacttgtaactactgtatggaaaggctgtgctgaaccttattttactacctttttgtctgattccaatagatgatgttattattgtgggtattgggataaatcacctgaagaactggagacttgttagataatctttgttattcaaagagtagtatcctcagtggtgaatgcaccacatttaagtttttgttcagtctcctcaatacctgtttccttataaagtccagttatttaaatgatctttattttcctcaagtgacaatgcatatatattttaaaatcattgacgtcactaccataaaatgtatttttagttttcactcttcatacagctgtcagcatcccttttccaggcataaagtttgtgcagacattgctatgtaacttgtattttcaggtgcatttgtatgtcattgataaagaaaaaaaaaactgcaagaagtacacaataccatcctcctttctttctaggaggacctgaaggttttaatgtttgttttaagtgaacctgtgccaaaggaaaaactatcttatgtaccctgcccccacccatgcaaaaaataccatttttaaaattttaaacaacaggcagtagtaatatgaaagcctattcatgtggaggaagagaagcttgataatactttttttttaaaatttcaacatttgtgttgaaatttgactgaaagatgacttgcctcaattagtcaatttctaagctgattctgatgcttttataaaggtaaaaactaaacaaacgagcttccaatttactaacaggattttttttttttagcaggaaagctcttctaaaacagaaacagttgacgtttagcaaatgactaattatatctgctaacaaaaaatgagagaaaactttaaaatgttagtcaagcatttttagctaaaacaaccagcttacttgcaagaactcctgacatttgtagaatttaagttttatattctgctttttttggtggcgtcatagataggggaaaaagaacaaataaaaatcaatgttttttatatacttacctcagaggtaattcctgaggtaaatctgtagttcagcttttttgttgttgttgaagtggagagtaaaattgggtcagtcggctgcattatttcaaaattgcaatcaaattttatcaagttgatatgatttaggtgtaaatttaaataaacagcaagtttcaaacccggcttgattcagacacaggaaaagtcagtattacactcttaatgaagactttaaaatattggtattctactttccattgtaataaacatcaggtgaataaaaggaaaagcccccccttaaccaagcagtttatctttaattcacttaaaaatctggctaattaatgactgtcatactcttatgcaatcaaactgaatttattaggttctgttagattcagttaaattggaaggttaggaaaagtaacatacagtgggtgaacactgtgtatgtgaaaacactattatcttatgtagtcacaagttagtcaatgtcaacacacacatttcacattccattcttgtatgtacgtacttaaatagctgaggtaagggtttatctttctttgtatcttttataaagattctgattgggcaacttcccaggtttcctagattttgttgttgttgttggccttataggtaaatcctttcaattcttcctacaatgaatggcttgtaccttatgtagaaaaattgtgaaagagaaatagaatatacctctgaagttttatgtatcttggagtaactttgtttcacagttaactcttgtttgaaagtatgagtgttaaaaatggggaaaaaattccacaaaatccttggattgagagccagaaaaatgcttccatttaaaaatgttgtttgacagacaaaaaaaaaaataggtttttccccatgtccagtttatcaccatgtttctatcccccttccccagacaactgggcagatgtgtttagcatatatagtctgttttgtgttgctctaaaggaatacctaagtctgagtaactcattttaaaaagcggtttatttggctcacaggcatacaggctgtatgagaagcataatgccagcatctgcttctagtgagggactcaggaagcttccacttgtggtggaaggcaaagcaggagccagtgcaccacatggcaagagagggagcaagggagatgctgtgctcttttaaacaaccagctctcatgtgaactcatagagcaagaattcattcattctccccaggaaggcaccaagccaattatgagggatctgcccccattacccaaatacctcccaccaggccccacctccagtatttgggatcacatttcaatatgagatttagagggaacaaacatccaaactatatcaacatactatttttttcaatatgtcaaattattatttggtcaattagggaaaatttgtttcatatgtgaagatccctttactttcttttaagatcttagggtttagcctttagggacttagcggtcaactctggcacaattcatgtcatcattaaaatacagtgatctctattcttcctgaaccaaagcagtagccatagtaaatatatccaatatattttcaggtgaagtatactgattttttgtgacttgtatcctttatgagatggatgttaagtgacgtgatgatatcaggagattaattacagtgaagaatatttgaccataaactactgagaagagcccctactgagtaactagactgtgtgaatattttctccctttctttaaattgtgtagaatatggttttgcacccagtgtttacttgtgtagggatataatatctatttaaaatagctgtgagataacattttctttggctaagccttagtgaccacttttatttctctccatcctctccatccttttgtgaaaacaagaaatttatttccttgtcaaatgaaaaattgaggtttatactatatttaaatgacatgtctaggtttaatataggctataagccaaaggcacttaatgaaaccttataggaaagaatgttctttgaaagattttaaaaattaattatgtagttgccatgaattttataagttgaaaagattataatgtcaaagaggggtggcaagaattcagccagacatctagtatattgagaaagctatctagtgtatctaaactgtacaaaaacaaataatcttaacaaggggtcttaaaaatactcattttttggttatgaatgcatattgaagtatgtgagactgaagtgacatgatgtccaggattttcttttaaaagaaaggaaaaaaagaaagagaaaacaagaatagcaacatcttgaattttattatcttgatgatgtgtttatggcagttcattatgccactgtttctactattgtatatgtctgattttttccacaaaatgagttctaagatcatacattgtttaggtgtggcttaactcatttattaatcatgattgagtgaactttaactctaatattgagagaatttttaaagtattacaatttgtagtcagacactgtggctcatgcctgtaattccagcattttgagaggccaaggtggaggattgcttgagcccaggcattggagaccagcctgggtaacatggccaaactctgtccctacaaaaaatacagaaattagcaaggtgtggtggcatgcaccgtagtcccagctacttgagaggctgaggtgggaggatagctgagcccagaagatcaaggctgtagtgaaccatgatcgtgatcatgccaccgcactccattctgggtgacaggccaagaccctgtctaaaaaaaaaaaaaaaagctatattgaaagctatagggatatattggtcttgctttaggaagtaaatatcagtatcttgtctcaaccgtaggaattctctctgtagattagttaggagatgagttttaatgttagttttataaaatgaattaggaaatattttctagaatagtttgctttcccataagtacattttaaaacattatttagatgtaatttacatacattaaaaatgcacccattctgtatatggttcagtgagcgttggcaaaggtgtataaccatgtcccaccaccacaatcaagatatgaacatttctattacctgaaaaagtcccctttacagttaatttctaccctcctccccactcctccatccccagacaaccatggatctcctttttaccactatagattaggcttgcttttctatagtttcatttaagtggaattactcagtgggtactcttttgtgtctaggtatttccgctgagcataaggtttttggagagccatctgtgttgttgtgtctatcagtagttcactttttttctgaatagtaatccatatcacatatcacttttctggttgtttttagttttgtgctattatgaatagaactattatgcacatctgttcataactatttgtactgatgtaagctttcatttctcttggatgatacggttggtagcatggtgtttaatgaagttagtgatggtgagcatcttttcatgtgcttcatatacataactcatatatcttctttgaagtgtctgttcaaatccttttcccactttaaaaaactgggttgttcttttcttattgaactgtattatggataaaagtcttcatcatatttatgtgtatattatgtgtgtatatatacacatataaatatgataaagacttttatccattatatatataacatgtagcatatatatttatccgtaatatataacataaaacatatatagtttatatatgtgtatatatcatgatattttctcatctgttgcttcctgtttactttttaaattgttgccttatgaaaagcagaaacttaaaattttgatgaagtgtaacttaaaatttttcttctgtggtttgctttttgtgtcctaaaaaagctttgcatatttcaagattgtgaggatattttcctggagaagatttatacttctagcttttatatttagatctatgctccattttaatttttatgtatagtaggaggtataggttgaggttcatcttttttccatatgaatatccagtaacttcagcacaatttgctttaaaaagttggttggtttgcaaggacttcatgtctaaaacaccaaaagcaatggcaacaaaagccaaaattgacaattgggatataattaaactaaagagcttctgcacagcaaaagaaactaccatcagagtgaacaggcaacctacagaatgggagaaaatttttgcaacctactcatctgacaaaggtctaatatccagaatctacaatgaactcaaacaaatttacaagaaaaaaacaaacaaccccatcaaaaagtgggcaaaggatatgaacagacgcttctcaaaagaagacatttacgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctgaagaagatgtggagaaataggaacacttttacactgttggtgggactgtaaactagttcaaccatcgtggaagttggtgtggcgattcctcaggaatctagaactagaaataccatttgacccagccatcccattactgggtatatacccaaaggattataaatcatgctgctataaagacacatgcacacgtatgtttatagcggcattattcacaatagcaaagacttggaaccaacccaaatgtccaacaatgatagactgaattaagaaaatgtggcacatatgcaccatggaatactatgcagccataaaaaatgatgatttcatgtcctttgtagggacatggatgaagctggaaaccatcatcctcagcaaactattggaaggacaaaaaaccaaacactgccatgttctcactcataggtgggaactgaacaatgagaacacatggacacaggaaggggaacatcacacactggtgactgttgtggggtggggggaggggggagggatagcattaggagatatacctaatgctaaatgacgagttaatgggtgcagcacaccaacatggcacatgtatacataggtaacaaacctgcatgttgtgcacatgtaccctaaaacttaaagtataataacaataaaattaaaaataaataaataaatgaaattggttggtttgtaattttcttttaatgcctttgtccagttttggtatcagaataaagtttgtcttataaaatgggttaagtcacaatcaacattatactgaatgggctaaagctagaagcattccccacaaaaactggcataagacaaaagtgccctctctcaccactcctgtttagcttagtattggaagttctggccagggcagtcaggcaagagaaagaaataaacggcattcgaataggaagagaggaagtcaaactatccctgtttgcagatgacatgatcctatatctagaaaaccccatcatcccagcccaaacatttcttaagctgataaacaacttcagcaaactctcaggataaaaaatcaatgtgtaaaagtcactagcattcctatagaccaacaatagttaagccaagagccaaatcaggaatgaactttcattcacaattgccacaaaatgaataaaatacctaggaatacagctaactagggaggtgaaagatctctacaaaaaaaaaaaaaaaaaactacataccactgctcaaagaaatcagagatgacacagacaaatgaaaaacattccatgatcatggataggaagaatcaataacaagaaaatgaccatgctgcatgtaaatttacagattcagtgcttttcccattaagctaccattgatattcttcacagaactagaaaaaacagttttaaaattcatatggaaccgaaatggagcctgaataaatagccaaggcaatcctaagcaaaaagaacaaagctagagacatcatgctacttggcttcaaactgtgctacagggctacagtaaccaaaacagcatggtactggtacaagaacagacacatagaccaatggaacagaatagagaactcagaaataaggctgcacacgtacaactatctgatttcaacaaacctgacgaaaacaagcaatggggaaaggattcccttttcaataaatgctgctaggataactggctagccatatatgtagaagattgaaactggaccccttctgtacaccatacacaaaaattaactcaagatggattgaaggctagtcacggtggctcacacctgtaatcccaacactttgggaggctgaggcgggtgaatcacctgaggtcaggagtttgagaccagcctggcaaagatggcaaaaccccgtctcttctaaaaatacaaaaattagccaggcatggtggcacatgcctgtagtcccagctacttgggaggctgaggcaggagaattgcttgaacctgggaggcagagattgcagtgagctgagatcgtgccattgcactccagcctgggtgacagagcgagactccgtctcaaaaaaaaaaaaaaaaaaaaaaaaaggaaaagaaaaagatggattgaagacttagatgtaaaacccaaaactataaaaccctgaaagaacctaggcaatacaattcaggacatagacatgtgcaaagatttcatgataaagatgccaaaagcaattacaacaaaagcaaaaattgactaatgggatttaattaaactaaagaacttctgtacagcaaaagaaactaccaacagagcaaacagacagtgtacagaatgggagaaaatttttgcagactatgcatctaacaaaggtctaatatacagcctatataaggaacttaaacaaatttacaagaaaaaaaaatccccattaaaaattgggcaaaggacatgaacagacacttcaaacaagacatacatacatacatatatgaaaaaaaagctcaacatcactgataattagagaaatccaaatcaaaaccacagtgagataacacctcaaaccagtcagaatggctattgttaaaaagtcaaaattaaccgatgctggtgaggttgtggagaaaaaggaatgcttatacactgttggtgagagtgtaaattagttcagccattgtataagacagtgtggtgattcctcaaagatctaaagacagaaataccattcaacccagcattcccattactaggtatatacccaaaggaatataaatcactccattacaaagacaaatgcacatgtatgttcattgcagccctatgcacaatagcaaagacatgaaatcaacctaaatggccatcgataacagactggataaagaaaatgtggtacatgcacaccatggaatactatgcagccataaaaaagaatgagatcatgtcctttgcagggacttggatggacctggaggccattattctcagcaaactaacataggaacagaaaaccaaatactacatgttctcatttataagtgggagctaaattatgagaacatatggacacataaagggggaaaacagacactggggccttttggagggtagagagtgggaagacaactaacgggtactaggctttttaaacctggatgtattagtcagggaaataacctataaaacagacccccatgacacaaatttacctatgtaacaaaccttcacttgtacccttgaacttaaaagtaaaaaaaaaaaagagagaaaataaaatggtttttctattttttggaatagtttgtatatttaatgttattttttctttaaatatttttagaattcatcaatgacgtcattggagcctagaatttttattgtgggaagatttttaattaaaaatttaatttctttattagatataggataacattttctaaatcttctgagtccttgttttgtaattatgtctttcaagtattactcaatttcagctgaattgccaaatttattaacatttgtgatacgctgttattgttttttaatgcctgtaaataattatattccctcatttattcctgataggtacaatttgttttctcccctttttcttgatcagtctagctataggtttattgattttattgttctgtttttaaaaaacatcttttggtggccaggcgcgatggcttacgcctgtaatcctagcactttgggaggctgaggcaggtggatctcctgaggtggggagttcgagaccagccttaccaacaaggagaaaccccgtctctactaaaaatacaaaataagccaggtgtggtggcacatgcctgtaatcccagctactcgggaggctgaggcaggagaatcacttgaacccaggaggcagaggttgcagtgagccaagatcacaacattgcactccagcctgggcaacaagagtgaaactccttctcagaaaaacaaacaaacaaaaaaaccttttggtttcattgatattctctattgtttgctcatttccttcctctcttccttccttccttccttccttccttccttccttccttccttccttccctccctccctccctccctcccttccctccctccctccctcccttccttccttccctccctccctcccttccttttttttttgtttttgagacagtcttgctctgtcccccaggctggagtgcagtggcacaatctcggctcactgcagccttgtgctaccacacccagctaatttttgttttcttgtatttttgcatatatatataaattttttttttttttggtagatatggggtttcaccatgtttcccaggctggtctccaactcctgagcttaagcagtccttccacgtcagcctcccaaagtgctgggattacaggcccgagccaccacacctagcctgtttgctcattttctatttcattgtctactccttattatttccttactagttcttactttgggtttaatttgtcctttatttaaaaacgtttttaagagagaagtttgaatcattgattttggacatctcttctttcataaaattagcacttaacagctataaatttctttgtatgccctctagcagcattttacaaattttattatactgtatttttattttcagttaaaaatttttcgtgtgtgatttcttcttggattgtgattagataatatactctgattttaatctttctaatattgaaatatgcctcatggtctatcatatgttctaccttgatgaatgtgtctcacatccttatttttaatttttgtgtttacatagttgatatatatatttatgtgatatatgagatgttttgatacaggtgtgcaatgtgtaataatcacatcatggagaattttggtatccaacccctcaagcatgtatcctttgtattacaaataatccaattatattattttagttattttaaatgtataattaaattattattgattatagccaccctgctgtggtatcaggtagtaggttttgttcattctatttttttggtacctattaaccagcctacccgcatcccccaccctccccaactaccttcccaacctctggcaaccatccttctactctctatgtccataagttcaattgttttgatttttagctcccacaaataagtgaaaacatgcaaagtttgtctctctgtgcctggcttatttcgcttagcataatgatctcgagttccatccacgttgttgcaaatggcaggatctcattctttcttatggctgaatagtactctgttatgtatatgtaccagattttctctatttattcttctgttgatggacacttaggttgcttccaaactggctactgtggatagtactgcaataaacatgggagtgcagatatctcttccataacatgatttcttttattttgggtatatacctagcagagggattgctggatcatatggtagttctatttttaggtttttgaggaacctccaaactgttcttcatagtggctgtactaatttacattcccaccaacagtgtatgaggattcccttttctctacatctttgccagcatttgttactttctgtcctttggatataagccattttaactggggtgagatgatatctcattgtagtttcgatttgcatttctctgatgatcaattatattgaacaactttttgtatgcctgtttgccatttgtatatcttcttttttttttttttttttgagatggagtcttgctctgtcacccaagctggagtgcagtgccaccatctcggctcagtgcaagctccacctcccaggttcacgccattctcctgcctcagcctcctgagtagctgggactacaggggcccaccaccacacccggctaattttttttgtatttttagtagagacagggtttcaccgtgttagccaggatggtctcgatctcctgacctcgtgatccacccgcctcggcctcccaaagtgctgggattacaggcatgagccaccacgcctggcctgccacttgtatatcttcttttgagaaatgtctattcaaatcttttgcctattttttaatccagttattagacttttttcctgtagagttgtttgagctctttatatattctggttattaatcctttgtcagatggatagtttgaaaatattttctcccgttctgtgggttgtctcttcactttgttgattgtttcctttgctgtgcagaagctttttaacttgatgtgatcccatttgtccattttttgctttggttgcctagcttgtgggatattactcagtaaatttttgcccagaccactgtcttggagattttccttaatgttttcttgtaataatttcatattttggggtcttaggtttaattaagtgtttaatccatcttgatttgattattgtatatggtgagagatagggtgtatctttcatccttgaaaagtatatctgcccttgttgggcctggtattctagcattgtcaattagatcccttttgttgataatgtttttcaagtgtttggtattataccttttctttatagttgatcaatcaattactaagggaggagtgttgacaactccaaatgcatatgtagatttgtctacttctccttttcactccgtcagtttttgcttcaagtattttaagtttctaaattaagtgcattcacatttaagatttttatgtcagccaggcgcagtggctcacacctgtaatcccagaactttgggaggccaaggcaggtagattacttgaggtcaggagttcgagaccagcctggccaacatggtgaaaccccatctcttctaaaaaataacaaaaattagccggcttgatggcgcacgcttgtagtctcagctacctgggaggctgagacaggagaatggcttgaacccaggaggcagaggttgcagtgagccaagattgcgatattgcactccagcctgggcaacagagcaagactccgtctcaaaaaaaaaaatgattattatgtcttcttgatgaatcaacctctttatcattataaaaaggaaaaaggaaatgtttatttttatccttaataatattagttattctgaaatcttctttgtcttgttaatatagtggccccagctttcactttattgtttgcatgttacaacttttgtaattcttctgtttgtaactttcatacatctttatatttaaagtgaatttcttttaagcagcttatagttgtttagtcattttttaaatccagtctgacagtactcatctttcaattgtatcatttctttcacttatatatacaatgtaattacagatataactaggttttagttgataatattgctgtttgttttctagcttttttcatttgttttggttccattttctttttcaattaattgaatattttaaaaatatttcattttagaatgtgtatcctgcagtttttggatggagtattctataaatgtcatttggattaagttaattgatggtgctgttcaggtcaactaactatatatccttactgactttttattaagattgatctatcaattactgaaaaggggtgtaaaagtttctaactataggctgggcgtggtggctcatgcctataatcctagcactttgggaagccgaggtgggcggattgcctgagctcaggagttcgaaaccagcctgggcaacatggtgaaaccccgtctctactaaaaaatacaaaaaaattagcgtgtgacagcaggtgcctgtagtcccagctactcaggaggctgaggcaagagaattgcctgaacccgggaggcagaggttgcagtgagctgagcttgcgctactgcactccagcctgggcgacagagcgagactccgtctccaaaaaggaaaaaaaaaatgtttctaactataatagtggatttgtgtatttctctttgcagttctataagtttttgactcacttttgttttacacttggttgttaggtgcatacacactaagaattttttttcttcttcttagagaattgatgcttttagcattatgtaatgtcattcttatccatgagaattttcctttatctgaagcgtgctgtgtctcacattaatatagctaccccagttttctttagattagtgttagcatggtatatctttttccatcccttacttttaacctagctgagtctttatatttatggcagatctctatggtattcaacatatagttgggtcttatatttttcgccactctgacaatcttgggcttttaattggcatatttaaaactttcatatttaaagtgatcattgagacaattgaattaatatctgtcatgtgtgtaacttttctatttattgtattttgtttctttttatctttttctgccttttcttgttttaactgagcattttatgattccattttatctcttctcttagcatatcaattatacttcctttaaaatattttagttgctgctcttgagtttgtaatataataattttatatacaaaatatatttaatgtgtacatatatataaatttctaactaatctaagtctgccttcaaatagcactaaattgcctcatgtgtaatgtaggctcatttaaagaatgtatgtccagttcttcattcctgttccttatgacattgctgtccttcattttatttatccacttactgtaataactaatacattgttactattattactttaaatagttatcttttatatcaattaagaataagaaaaatttattttagccttagtgttttttaatttttagtttttatagatacataatagttgtatgcatttatggggtatgtgtgatattttgatacaaggatacaaggtgtatgatcaaatgtgggtgattgggatattctttttttgatgtccttcctttctgtatatagacctaagttcctgagcgatgtcattttcccttttcctgaagagctttaaaaaaatatttcttgcagtgcaggtctgccgataatgaattctcttagtttaggtttatcttagaaactctatttctctttaatctttgaaagataatttcactggacacagaatttacatggtttctgatagaaatagctgaaatttctattcttgtttctccaggagtaaggtgtattttttctctgtattctttcaagattttctctgtgtcttttattttctgcaatttgaatatgatatgcatacatgcagattttttggtatttacctatttggtatttctgaacttcccttcctggatctgtagttgggtatctgtcattgatgttgaaaaattcttagccattattacttcaaatacttttctgctcccttctctttttcttctccttctagtatgtcaattacatgtacatggaagtcacaccttcagatattgtctcaaaattcctggatggtgtattctggggtgtgggtgtggatgtgtgcgcgtatgtgtgtatgtgcgtgattcttttttctctctgtatttcagtttgggaagtttctattcaccctattatcaagttcactggttctttccttcgcatgttcagtccttagcatgttcagacattcatcatttcagatatctagcattaaaaagcttttttcttaagagttttcatcactctgcacacattaattatctatctcttcttgcatgttgtttactttttcctttaaagctgttaacatattaatcatagttattttaaattccctgtctgtttattccaaaatctgtgtcatatttaatctagctctgatggttgttttatcttttttgcccatgtttcagtatgtcttatatatattttttttaactgaaagctagacatgatgtattgggtaatgggaactgaggtaaacagtcgtttaatgtgtggtagtaggtattctgtcaataattgctaatgaatgatgcatgtttgcgttgtaaagtgtaactctaaaatgaaacttgtggctcctttaagtctttatactatttggaagaaccaaatggactcagttttttctggtatggaaacattttcagttaatgtagcatgactgaagcattttactctgtcagttgattaagtttcaaagctatatagtgccatagttttttatccaaacttgtaaaatcatgcttaataatattattttcttatgtctccacatttacgttataagttttaatcactttaaaatttttagatttttcagattagaacatattgctattattattaaagtagtactccatattgtcttttcataaatactaaattttggtcagggccagtaagatgccacaattatgctatctatgaattcacacacataaataaatgcacatacatatacacacatacatattatatatacaatatatgtaaattttcatctgtagacattcacataatgtggacatattcacatagtagctaaaacatagctaaaacaataacgtaaagacattctttagaaaagttattaaaataaagtctaacaattaaattatttcaataattaggcttttgccatagtatggactaatgccaaaaaataggtaagtccagtctgctggttactgcattaagtatctggaatttcagaataaactctgtgtgtgtgtgtgtgtgtgtgtgtgtgtgtgtgtgtgtgtgtgtgtgtgttgcagaaataataaaactactgaaatagattttgtcactctcaaacttgggaactttgatgagagatttttcttcattttgctggaaaaataaagaagttaatttgtaggcagacaccattgtcctaattgactggtaagagttttagctatcattaactaattcagcaacatttttctcatagtactaaagaagactacaatggccaaagtttccttgttccagctaccttccctatctttgcaatgactattatatatacccccacacacatacatacaccccaacatgttagtatatctctaatagctagcttcctccggtacctggcatctttacagtgacatgaaaagaaaaatgtgtaaagtagtagcagaaaagatataaataaattatggtactttctttgactattggaaacttaaccttcaactcagaagtgcttataccaaatgtgatcattattgtgtatggtatggggagagtctaggtcctagattctgctaggcaccacccttattaaatacattcctacctaagttcagtatcttgaattcactttttaaagtagattgcatataaagttcaaaagtagaattaaattccaaactctgttttagaaaacacatgagcaaattgtaataattatcctattgggtaaatactaaatctaaaaatgtttgccagatgtgggtatagaaggttctgactgagtacatcccttaaattctgtcttttctttactataacaagtgattcatagtcaagctcagttatgtataagaacagttctctaatggaaaatcattctaaattaagaatgtccttttattcccttggttttttttcttttctttctttttttgctccaatgggaaagcttaactttgagatttttacagtggcacagtttagactatcattgtctcatcattttaaaaagttgcttcttaaagaaaaaattaatcatattaaacagcatgaggaaactgttctttaatctggtaattttatgtgtgttatctctttgaagaactgactgatcatctatttattttttcctttggaggcagactttaaaagtacatgttctatgtactagtgattgtttaacaaaatgcttgacagagtttaaagtactatgattatctaacaaaaacaatgatgttgatatattagcaacatgattatcttcagtttaaaaattaagattgcttagacagaaaaatttaacgaggcattttaagattttccttcgctatacagatcttctgtttggtttgaaaacatctgttatgattttaaaaagaatctccagactaaatgcaaattaaatttacactcagtaggctatgtttgctctttccattcttacaaatctcccaacagaaccaataagaattgtgtacctaaatcaagagtaagctattattttgtggtacaaaatgcattatgttattttcacagtgttaggggggatcatataatataggaggaaatgacacaaaatatgatcacaaatgggctgcctcatatatcttaaaaaatgaaaaggtatgataaattctgtcgtttataatagcatgcttttaccctatgtaaggaaattttgttttgttaaatgacatttcaaaggaaaatatcatttgcataaaaaatgatctgctttaatgtttaaaatatttcagaaaagcatgcatgtcaatagactgatacatgctgagttacagaagcttaatttaatgaataacctttatggcacaatttctctcagtctctgtatagtaaccactttgtctctgactgatgatgccacttgttttgaccaaaaactctccccttttacccttttattacttattatatagtattatatattttattacattatccaccattaagggaggtatgtacacatatgatgcttccaaaattctgcctctcatggtttacagttagtcagcagatagtctcccattgatgcacaatttatttggattcagagatttgctgagcacctaattccagagatttactgagatgattacaagggatactgtgcattgtggatatagtgatgatgaaaacaaaagtcttatcctggaagaacatcttttttttttcacttttctctttttcttactccaactcttgatcagttacttcaagagcaacttcctctaacccgcttgcattcatgagccaaaacaaaaagcaaaattactaggctagggatgtgtagtgttatgaagaaaagtaacacacaattttaagtttgaacataaaataaaatcagagtcatttacctatagaactttttgataatacttaaaagtcccctttagaacttcttcagttattttcatttaccttttccttgttaaatctgcttttctttaaataccactagttctatagaaaactttaaaatatgtttcattctgctaaattgctaatgccaacagtattgtcatatactattcttcatttcacagacaatgatttagtgtgcaaaataggttaaataggcttatttgagccattctcagagataaaataacaatttataccattattttaattcaattcaatctaactttttttgagacacagtgtcattctatcacccaggctagagtgcagtggcatgaacacagctaacttcgcctcaacctcctgggctcaagtgatccttctgcctcagcctcccatgtagctgggaccataggcatgtgctaccatacctggctaactttttgattttttgtagagacagggtctcactttgttgctgtattcatccactcttgcatttctgtaaagaaatacctgagactgggtaatttctaaataaaagaaacttaattggctcacggttcttcaggctgtacagaaagcatgatgctggcatctgcttggcttctggggaggcctccaggaacttaaaatcgtggaggaaggcaaaggggaagtgaggtatctcgcatggcgggagcaggagcaagagagagagggaggaggtgccacacacttttaaaagaccagatctcacaagaactcactcactgtcccaaagacagtaccaagtgggggtggtaccaaactgcctccatgatccagtcacctcccaacacaccccacctgcaacactggggattacaatttgacatgaaatctgagcagggacacagatccaaaccatatcagttgcccaggctggtctggaattcatggactcaagtgatcctcccacctcagtctcccagagtgctgggattataggcatgagtcacggtgcccagctataccattatttttagagcaaattttttcagggttccaagaatgagcttcaaaacttgagaaccaaatcaatttacaaagccaagtctgctgtcttgtgtagttaatctgagaggagaaatcagttgccaaattgtagaacaaagtattctgtatatattcgggtatgtatatttaactatatagaaactttcttttaaaatattctgtgtgtgtgtgtgtgtgtgtgtgtgtattataacaggggtccccaaccatggcctgttaggaactgggccgcacagtgggaagtcagctgcaggtaagcaagggaagcttcatttgtatttacagctgccccctttgccccctccccacccccccactgccacattgcccacattactgcctgagctccacctcctgtcagatcaacagggattacattctcataggagcgagagcccttttgtgaacttcttatgcgagggttcttaattgcccactctttctgagaatctaatgcctgatgatctgtcactgtctcccatcacccctagatgggactgtctaaatgcaggaaaacaagctcagagctcctactgattctacattgtagtgagttgtataattaattcattatatcttacaatgtaataataatagaaataaagtgcacaataaatgcaatgtgcttcaatcaccctgaaaccaccacccccccgccaccaaccccaccctggtctgtggaaaagttgtcttcccatgaaactggtccctggtgccaaaaaggatggggaccactgttatatcacacatccatgtgtccaccattcagatttaacaaacattaatattgtcccgttgctgttttggggcttttattgttgttccttgaaaaggttgccaatatcatattgcttttaattaccatagttttataataggtattgaagttctcccctccttcttcaaaatgattttggccctttctgactctttactttcctatattaattttggaatcttagtgtcagtttctatttaaaaaactgatagaattttaattaagctgcttattcattcagccttgatgatgggtttgcaggaaatttacatgattcctaagtgttttctcatgcactgaatgaagacctgttcttatataaggtaatgtaaaaacctaggtagggccatccagggagagttatgctccagagaagagagaaacctttggataggacaggtgatgagataaggccaaataaatagaatgtctttttttcccttatagtggaatagctgcaattcttaagatcctatgttatttaaaattatgtttaaaagtattacttgcatatgaaaaaaattgattaccagccagtttccagttcacaattttatagttagttttcctacagaaattaaatgattaaaggtttcgatcaaacctaacagaacaaacataattgcatcattttttccttataagtcacactccgctagcactgtcttctctatttctttggccttgacctggcatttttacatggagcacaatgcataggcaccagtagttcttaacaaaagcacacataaccaaataacactccagtgaagtacctagactaaagcaaccatgtgttcctatgctacagacataggctttttatttttttcttcgaagttggtctagttcccagtaccccctgctgtataaccaacaggggtctagttaaagcaaattatgttaactaatgaactaagcacattatatccaattcacattatgagaactttactagtttggtctggcatcagagcttagataaagattcagtcaggaaattgtcaacatcatggaagtcctgtggattgctgtaagtgtatgtcccagaggttggagaacaagggaggctgcgactttaataccccaaagtcaaatgggatccttgcttaaaaagaaatgaagtactggccaggacctcagagtctcaggagcaagggaactagacaagtggtttagtttctcagactgggatataaaagagtgtcttgttcacaagaaacaggaccagagcctaactactagaattcacttgaaaactggaatagaactggaccgacaacatgccatattttaatgctgctctacaaagctaatgacctccatccctttaaattctctctaacaatgaatgaaattggtccctgatcccatgagcagagtggagccttgctgtatatgtgaattgtataacttcagtatggtaattgcaggaacaaacgggcagaaaaaagggcaaagttcatcatagtgaaaatggaattcatggcagatcctctggatcctacgttttataagagactgttgattaggtctgcattttaacctcgtgagtctcctcagtttatccaaatgaaataaatcgacctccactgagattcagttcacttcactaaacctctaagccttcatcaccaattgttagactgtttatatgctaggtacagtgaataaaatgaaatataaaacatactttttgctcagtgggatgactagtaaaaatggaattcagtgtcaagctatacacataggcttaaaaatttattattaacagccactttggaagacactttggcagtttcttataaaactaagcatacttgtaacataggatccagcaatacttaaatgtggaaatcaaactattaacgatttcagaagataatatggaagtaaatccccatgaccttagggtaaagaaggattttttaaataagacataaggaacatgaaatgtgtaattaaccagttcaaccacattaaaatgaagagtttaatcaaaagataccataaaacaaacagcacagtggaggaaaagatatttgctactgtgttacagtcaaacacatttaactgacacagtccagtttcaagaatatataaagaactacaaattaataaaatcaaatactccaatagaaaatatgcaaatagttgaacactttacaaaagaaggcatctgagatgtcaataagcgtataaaaagatgttcaacctaattaatattcagataaaggcaaattatacctactatgtttggcacaaattaagaaatctgaaaatactaaatattggtgaagatgtggtgcagataggattcttacacactacaggtgagaatgtaaattggtgcaatcactttgacaagctgtttggcattgtctagtaaatttgaaatgttacacaacttatgacccaaaaatctattttgcacatctatcctagagcagtgatccctgggatgtctgaggcattttcagatcaaagctagtttcacaatagtactaacacctcatttgccttaaaaaaaaattatattgatatttgcactgattgtgcaaaagcaattgcgggaataaatgctgacaccttagcatgaatcaagacagccatgccagtattcagtgtgtttgtaactcccatacactcacaataaaacccatgccattttcacttaagagtgtccttgatgaagcagcaaaattattagttttattaaatcacaacctttgagttcatgtcttcttaatagtctatgttactcattactgctgcatgaatgctggctacatgatatttctgggtcagaggcaaaagatgttattacagtacagcaagcatcataagcatcaacatatttacattggttccccttggccccaaattccacaagggtgacacaatatgggccatataaatgctgcacacgcagtgagtttgcattgcaactgagaaacacagagcttaaggaatctaccacttttatggcaagtaataagttaacctgttcgttgtccaagaggagagatgttacctcatctctgaaaattacccggacaaatggcctgagtaaaagaacaagtgatcaggcacctgcagcaagatgtggaggatcacaaaaggcccaaggacgactgtctctcccaatatgtatctgtctccatgtgtgcctgtgtgtgtgtgtgtccatgtgtgcatatgtgtgtgtctgtctccatgtgtgcatatgtgtgtgtgtgtccctctgactttttctctgtctctgtgttcgtgttcctaaaaccctccacaaatgagaatcattaactcaaggtaatctgaaatgtttactaaacacataaaactggcaatgaagatattctcttgttacccactgttcatccattggggtgggcccgaggtttgccaacactcctttgttcttgtttttgttcttctttttttaaattattatttttgaaactcaacagcagagagttgaattagttttcttttctctctatttatctatacttagttcaaggcacagcatcattatcagtatcagttcaagcagggacccttcttgtttaatacctgttattagtttttatatttctatagtcccacttatcccctctcatagacagctactcagataaatttgatatgtatatttgaatccctatgtatcctcgtaaaatattgcaggttgttttgcatgtgtgtttactttttactttttaagtttgaaatgatttcacatttacagaaatattgctatagtagaaagattaaccatgtgttcattacccagattcaaaaatagtaaagattttgcaacccttgttttatctttctctatttatatgtccataatatttttctgatctctttgagagtaagttgtagacattatatcctttattcctaaacatttcagcatgtatttcctaagaacaaaatatattgtcttatatagctgtcatacaatggtctaattagaaagtttgacattgatacactactgttatctagtatacagttcatactccaatttcatttattgtccccagcaatgtttgttttctgtagcattttttttctccctaatccagtttccattgcatttacttgttatcttttgagtatttaatctggaataattcttcagacttttttgttattcaagattctgtatgtaacttttgtttacttatgtggtgtagtgctaaagatcttgttccctttcttaatttttttttgctgtttttaagatccactcatataggccagatatgggggctcacgcctgcaattccagcactttgggaggccaagatgggaggatcacttgagcccagagtttgagatcagcctgggtaacatagagagatcccgtctttatgaaaatttaaaaattttccaggtttggtgttgcagacctgtggtcccagcgacttgggagaatgaagtgggaggactgcttgagcacaggaggtcgaggctgcagtgagccatgattgcgccactgcactccagccttggtgacagagccagaccctggcccccttgcaccaaaaaagatccactcatattaatgtgtagacatctatcttgtttgttgcttctaacttctgcttagtattccacagtatacatctgccaaaaaagaaatgtattttatactccagcctgaacgtcctattacagggatcttttgaagctgatgtcatgaatgtcagttgtaaacttaacattgtactttgtgtcactgtaagtgaactatttgacattgccagatcatttctgggatttcttatgtttgaaatgtagattacagaagtatatattctcttagatgactaaaacctaaatccttgagacaactatctgcatctaaatccttgagataactatctgcatctgacacctaaactataaagattgttaattgaaataaaactcaggattttctccttcagtacttgagttcattggttttaaaatctgttggcttacatacatctgattttttaaaaatcatgtaccttattgtgtatttttcagttgatgtccaaaatttttctttttatgactaagtaattgcaaaggatagaatttccagtgttgcagatattgttatttaaaaatagaattgatatatccctctcttaagtatatgcagtttaatctaaatgccatagcaattaggtaactaccattatgcatttaaaaaatacatgaactggctctatagtcaaaatttatatcattttcccctcttttaattcaatgtgctcattcccctttagaactttatcttaatgtatattttaatatatcctaatatattttaaaagatattttatgcttaagagtatttttaaattatatactgtattatatatctctacagcaaaaacatgtatatgaaagtttattaatttgtttctatgatcagaaagaaaattttcttctggatttaatgttcgttacattacaataattattagtttcagtgactgattggaagaatatatacatattacaaattttgataaataaatacataagtaaagtttttattagaagacatatcattaattggatgtattttttcaattattgcatttatctctgtattgctataatgaggcaggatttcagcatcaattcaatttctatagatgtgaatgctgagaaaatttgttcacataagaagtagacagggataaaaggagtttattatagaaataccactcaactctttgaactccttttgaattatttgtcaaaatataaccatgggaatctatcatcaaagaatagttttaaccattgatcagctggttatttgattatatgctcctgcaaacctggtaaaagtgaggaactggaaactacctgatatggtttaattaaaatcaaccatcaaaagttattctcttaacattgacacaaatgttcaattgcctcttttcttggcaccatgtttttatattccaaggcaatgcactattataaaattatagatgggtgaaagatatgcctttctttgtaagacaggagataggattttaaaagtagaagcttgattttttttagaaaagagtgcataaggagtcgagaatctcaaaattgattctcttaaagccatctgagcctgtctacacacctatcttaacatgaaacagggatacgtataaaattgccactaaaaggaaatagtatttttaaagctatcgttacttgaaaagaatcatagtgttaacacagtagcatcaacctttcagagaaataagaaacattacacatttacactactgaggtctttatgtgaatccatagttgattattttgacagaatatatgtttgatttgacacacttgaaacttcaccttcacattccttgaagaccattcaaagagacttactccactgtgttgaggtcagactagaataccaaatattggtgttcttggaaggttatttgatgttttaatttagggctctggatactctcatacatttctctttctttgcttatttttgttcctccacctgaattactagctcttcctaatatgtgtatatgcacatatatggggctgggagaaaaatatatatatttatgtataatatatatttacatataacatataatacacatattatatgtatataatatatacatgtatatgtatataataattatatattatatattaatattttatatataatttagatattaatatataataatgtatatgtatataataattatatgtataagtatataatatatgtataatatcatataaatatataatatatgtataatatcatataaatatatattatatgtaaatatatattatatgtgcatatatatatatatatatatattttttttttttttttggagacagagccttgctctgttaccctagctatagtatagtggtatggtctcagcttactgcaacttctgcctcctgagttcaagtgattctcatgtctcagcctcctgagtagctggaactacaggagcacaccaccacccccggctaattttttctgtatctttagtagagacagggtttcaccatgttggctaggctagtctcgagctcctgacctcaggtgatcctcccgccccagcctcgcaaagcgctgggattacaggtgtgagccacccggcccggcctatgaggacatattatatgtctttattatagctctttttatattgtacttatgaaagtcagttcattgtgcttcctaagcatgtctcaaatctaattctacctgtttatccggcaccctcgttcagaccaatatcagttctcagttggtaatgattttctgactactcccctggttccattctcttcctacttcaggatctccaccatggagttactataattacttgtctaatagacagatcaattccatattccctgactcagaaatcttccattgctcttacttacaagtcttccctgtttctatgctgccaagaggactcatattaatatttacttttattaattatcttgtacttacctattcccaactacctttccagactttttctccagcaactatcctcatctattttacactctagtgacattttcttgaacacgtatcatggtgcacttattagaatatatgtcgtaacagacacataaatttattttcttagtaatattcaaccaaaacttctggttacttgtgaagaaacgttaaaatgtatatgtaatctgtttatacacatacattgtataaacacatacacatatatatggtatgtagtgggtatatccttttcagaaaaacatttttattgttaaaatgtttttttagatcacattgttagcactaagcatggctatataacacaggaaaaaaatgacaaacaaaatattttaaaaatgaaggaggctacgataaaaaccaaaatccttaagtatatcaatggttttcaaaaggtgttttgaaacacacatacaaacgaccacaaattacatgtgtgttaaattctcttttattaatattaatgagaaaaaggacttacggccgggcgcggtggctcccgcctttaatcccagcactttgggaggctgaggcaggcagatcacgaggtcaggagatcgagaccatcctggctaacatggtgaaaccccgtctctactaaaaatacaaaaaattagccaggcggggtgacaggtgcctgtagtcccagctactcgggaggatgaggcaggacaatggcgtgaacccgggaggctgagcttgcagtgagccgagttcgcgccactgcactccagcctggacgacagagcaagactgcgtctcaaaaaaaaaaagaaagaaaaagaaaaaggacttatgtatttggcctatatcctaaaactcaactgatcatagctatcttcttgtagttctcttttggattcagcatagtgaggtaggatgaacactaacatgttaaaaggcaggttctgctaacaattccaacactgacaaactgtgtgatctttagcaggtcgtttatctttgctaaatctgttttctaatttataaagtaaggactgatatacaatatattcggctcaaagagaaattgaaacgtgcgataacaggtgagagtatgtgattacatttaaagagatttagacatgtattgtatcactgaagtattccttattccttagtctctttaattttaatcctaaatttctttagaggatctggcctatcctgatggaaggcatatgttgataaggctaataaatggccaaataaggaaataagggatgtgttggggtttttttcttatttatttattctatgtttcttcctcattaaaacagttttggtatgaaccatgatggaattggaaattcttgtgggacgaaaggtcatgaagcagcaaaacttatggcagctcacattactgcgaataccaatcctttttcctggtctgcttgcagtcgagactacatcaccagctttctagagtaagtaatctctggagagtgatgataaatagctccagaagtaagccactggtagaagcctaacatgtagtgctttcaactttgcataatgagtaagttttatagggcctactgatgtttcaactttttcctaaatactttaatatatcattgtggcaatttttttttcttcatatagaatttatagaatagaggaagtggagtaaggatgtaagtgggactgatggtgtgagtgttacaattgtttaataaatgggagacaatttcagaaagcattcagatttgcatgatttaatagcacataggccaaatttgagttcagtgattacatattttattttgtcagtgaaaaaactgagttctataggaaagccaaagtatctaatagtaacaaacaacaacaacaacaaaaaaaaaccaaacaccaaggaaatgaacactttgagaaaaagatttgtttttgaaagtgtattaagcgatccatttttctacagtttgagaactttttggtcctttaatgtatattccaagagtctggttatttaaatgtgaagaatacaaattagctcaggtataactatgttaagaaaatcagatgttcttccacatctcacttgcatagggcttcaggattgtactttggaaactgatagacttgggtctcactttctaagtgcgtgttccttaacttttctaatcttcagtgtcctaagttgttaaatgaatttaagtcatactgtttatgtcatcaggtgttatatatgtgattatatgtcatgctataatgtatataaaatacataacagacattctttaaatggtaaatattattttaaataatatcaagatttcagtgctttattgctttaccattatttttaactgttttgtgccatttttttctttagggaggagaaattaaatactctgtgaaaaagtaaggtatacataaagcacaggccagcaatggaaattcttcttaaaaattggctctgttcaaagtttatattaaaatgattatattgtaaaattttaaaaattcaaacaagttacatagggtaacattatttattaaaatttccttcatatctactaatagccagagcatatattttgaaaactatgattagatatttttaaaaggtcacaaacaagagactttaaattacctagcacaatgctttattaaaaaacaaatcaaaagataaatgtttaaaatgagctcttttaatgtaataataaagttgaaggaatttgaaatttatttcagaaggtagttcttctgataaccatattataacctaataatttttaatcttagtaacagaaaattataagattatacttgcctacagtgaaaactgattgaagtgctataaaggtagaccacagagcatttgtaagatatcttttggtcgttcttaatacaaagcactagcaatatcattttctaagatggttttaatgagatcatttacctaaattttaaacatttttgaagatccgctctccctagacatcaagtcagatctggaatttctcccttgacttggcttatgtttttataatggagtcttaatgtccatcaccagaaagacaaactgtataacatgctcaagattcctgtgcatttctgatggttgctcttatcttttttgtttgtttgtttttttgttttgttttgtttttgtaccattttcttttctcttttatcttgtgtctgtcccattggctatattgcacagctcatttgctagtaccatctctgtatactaaatacaaggaccagttgtgatcttctaccagatcttgtctacttgaaagcatactgaggctaagacactccaaaagggaatccctaaattgctggtaaaatgcagtttaaaaatcacccactggtttggtgagggacataaaagtattactagtttcaataaagtgttccattgaattaattaaaataattgatccaaaaagcattatttaagctttatagcatgtatgtgtaagcatgattagtgttgacagtgttctaatgggcttatttgtcctgtattttataaaaatatttctcatgtgcatcctcatgggaatgctcacaaagttaaaactattaatgaaagatagatgtgaagcacaatgggtagagacttggggaaaacttggctttccctcctctttaataataaaactaaacaaatctgattataatctgaccaagcaataaagggtttttaaacacaaagctctttaaaaaggtcagttcaccggagcacaaagacataacagtaactttcttgaatttctttgttcctttttattaatgcagtgaacttaattgctttaacagctatgcgtgatattttttaaaatccagtgctattttgatcagggattgaggttacatttatgttttatagttggctagaaaaggctcataacattttattttagcttctcttctcaagaaaaagaatcttgaaagatgaattgtttaggaactgcagcccagccaacaaaacgcatacctttctctacttagtagctgtataggccaaagatgatggtggattttaacaatgagctttctatgatttatagagattcacaattcactatgttcaactgaaaactattccatggccaatagaatacaaagtctctcgtgtcattctaaaacactagatgctattgatcaatcaggagatggtgtttaccaactcccaatattttttttcagatttcttaaactcggtgattcaataagtggttcatgaatcgcccagaagccgtcctgattaaataataaagaacccatttccgttaaaatggacgtgttatgccagcttctgatgttttccggcgacggctttgcaggtagtgtctttcctatctgcctgcgggactgatttatttatttatttagactatagagaaaggtgaacctggtattatggctcacactcattgatgactatggaccaatttaccaggcagtggaagacagccagaagtaatttaagccagtttttcatacattttccaccacttagcaataatacagaataatttcataaaggtttcaaaaattatgggggctctgtgaatcaactcttgctctgttaaaattaaagtctgttaacttttttgaactgtcaaagatccatagcaaaatttcctacagttccaaattaaatacagagtagacattttcacagaaagaatggaagctgaacgtattaagagaagcaatgttacagtcggagttgacctaggaagaaaggtgattgtagatctacaagagaactgatataagatgagcaagatgaccaaagcacttacatttcctctctagcaatgaccttcaaaggtcaacatcagactattatataaaaaacaatctttatagatgggacctttttaaaaaaatgtagaatctaagagcttggcaaaacaggtttctcctccttctgtttatctgatacatttgggtaaccttactctaaccataataactttgataagtcataattacatatagggggaaaagggtaaaccattctcaatacagtatttgtgtcttgaaagcttcaagctcagttatattaagggtgagagaaaaagatttgccttagaaggcagtacattgttagcttcattgagaagactgacaaagcagtttatgagactatagtacgtaagacagttgacttactgtagatgatatcaacccaattctattttgcttaatttatgtgaatcagcccaacttagtggaataaaaataggaggtggcattaagtgttaactttttgttgttgttgttaagagactgttaagatatatacagggttatatagaaagatttcttttttagattgacccactgtattgtagactaaaattcatattttatggtataactgttatagtgaaaatacatctaaaatcacaattaagagtatatcctaatgtgttctggaaacaaagccatgagtgcatattttacatagggatctgtaaatttttgctgatgaccgaactgtaactcatattcctatattcaaggctaatttttggattatgtaaataagacctctctaaattagaagtagaattcataaaatatgactttctcatcatactgcaaacattttgagaaatgtaaatatactttgatttactgtgaatttcataatcaagggagaagtatattctaaaactaatgtatttttttgcttagtcttagaagcgtaaacaaaaatagagtctaggaattcaataattatctgtgttgctgtcgatattaactagggtttgggtttttagttgtgattatatgctgctagggaaataatcacaggtctactttttatatgtacaattttgatctgacaagtatatgtttaataataaattgtaactacataacatagatggagactaacactattctacatttaataatgagtgaggttcatgttttctgagtggacaaatttgcgtattacaccaacatacaaaccatctatgtttaaaattattatttgatgagaagatttgtatataatatcactacagtgctattataattttgatagtagcataaataacactggacatgtaagaattgtatagttttatctcaattagctataagacaacttatatctaatattttatgaaaggaaatattaggttggcacaaaggtaattgtggtttttgccattaaagtaattgcaaacacacaattacttttgcaccgacctaatagatttacacatttataccaggagacatacaaaaagtgttcatatcagcataatttgcaattcttagaaattggaaataatccagatgtttattagtagaggaattataaataactgtgacatacttataaatggaatattaaagaacaataaaaatgaacaggctacaattagatttacacacatcaacatagaagtagctcatattcacaatgttgagcaaaagaataaagttacaaaagactacccacagtatgactacttttatataaagtctcaaaactggcagatgaataattagacagtaaaattattaagcaaaacaaggaaattattattataaaaagttaggatagtagttacctttgggggtggggggaaatgagggatattactggaataaagcacttgagaattttcatagaaaaaaagtaaggaaaagcactcccagggttaaatatacattgctcacatttatgtcttctacctctgtatctatatctgtaatatttcataatggtaattgatgactcagaggcatgaaaatatccagaattattttaagaattaattagtaactaataattatcatctataggctttagttacttgaacatagcaggaaagtagcagacaaattttggttaacatagttcaaaaagcatttttcttgcttaacccttagttaagaattaaaatataggccagatgcagtggttcatgcctataatcccagcactttgggaggccaaggcaggaagatctcttgagaccaggagttctagaccagcctgggcaagatggtgagactcagtatctacaaaagatacaaaaattagccaggcatgcctctggtcccagctcctccggaggctgaggtgggaggatcacttgagcccagtagttcaaggctgcggttagctgtgatcatgccacttcactccagcctgggtgacaaagcgagatcccatcttaaaacaaaaacaaaagaattaaaacaggaaaactatcccatccctcaaatatttaaatcaaggttttactgtatataccagatatggttactagaaggaaaatgtactacacatgtagtaaacgtgtagaaatgtacaaccaatttaaatccaccttgcagatacatccccacatttgctttactggaagacacttgacttgtaagccttgctaatttgtacaaatatagccaaatccatttcaaaagtcctttgtttattccatgtttctaaatgctggttcatttttaaagatccatatggttttcctttatattttatttcatatggtgttttattcttctgtaaaaatgtactggaaaaggagaacaagacttgtctagactacattaatacaaagcaataggtgcttccagagaactaaaacaaaaatacacttttgggataaactttcttagaagagttttgaccacaggtgcctgcagttcatggcattcttggtggggtgaaggccattgcagttgtcctctggtttggtattttttaaagaacatgaaccatgattagaaaaccactaatattaatatattgaaacaataattttagatgaagcaattattcttgcttccttctgggttaagtcagtttccaatttgccatcagaaaagaattttttcctcaggatatctattcttaaattcttctttgggatctacacagttcttcctctgattctgggttaattttatgtattactaaaagtaattattttaaaatttaaataaaataagttggtgtcaccaaaagctggtgtcacttaggtgaatatatcctgcacttttttggttatgccattgtaaatattttttgcctattggatacctacttcagtacacaatttaaaataaatattttccataaaaaagatttatagtagtacttaacttgttattttatttttattacatatttaattcctttcataaagatatttataattttattgtcagtagaaatgaaacagatattttagaagaaaattggggaattaaactactaattcagttatctcaccaatatcctaatcaaaatggttctttttccattgtactattcaaatatgacctctttgtcattaaccttaatatataatttaagatttactagtagcattacatttgcctaaagtttgcatatccttataaattaaagatattttacgtaataaagccaaaaaagcattatttaaaaaattcatctagaggtaatttttcttgctgaggtacatgtcaatttctaaaagtataataaaaaggaaataaaaaagtgttctgttatgaaaactggatagctgggtgaaaaaagtttgttctttgttagttagttagttagttagataccttgagcagtgacaaatgaaatgattgtagtagccagtggtaaaatccatctgtattagtaccatacttaatattccttttaaatatttcttattgattaaaaaatcaggagggcatgaaagaaaggagaaggatataaagaagacagtagtctgtctctttggtctttaactctatatcaccgtaggaatagtatggttcagtttttaaaaggtattaatttgctgctgtgtgtgaacatacctttttatagaacacattgactttgacatgttaagaatatgagaaacttttaagtgaatagcaaagtcattgttatgcatagttctttcttagttatctataaatgaaaaattgtactgtcctaaataacagttgaggaacttctacttgtgaaattattttcctttggcaaagtggatggaaaagatttggaaaaaaaaaaaaaaaacacaagtgctggcacaatggacaggaatgttggaaaaaatttttaaatgttggcataggaattctttaaaaattctaacttactcacatgtgaaatgaaagtaaaaaagcatctgtcctattttatgcacactgactaaataaaaatgaacaattatatttagcaaagtttaaagctctttaaactaaggtattttgtctgggttttggcgacctttatgttatttgttctactgaattaaaatattatgtttgagtgcaggcatagcttgaaacgcagaaattatacaaagaagagaacattctcttttccaattctgatgattctagatgaaatatgaaatttttgagagactaaacacttctaatatatttgagaggaaaactttggtcgttggcctcatctgtcattcaacccatttattagtgaaatatttcaagaacctatggacatgccttaacacaacatctattgttctgcccaaggtggaactatataaattaggtctttaaggattataaccataattattttttttttaattttctgcatttcatgtttttaattctactaccagatgtggttatattttcaataaaaacaaacaagaagcttagagcaatatgaaattctgttttgattccttgagaaattagcttaaatcaaggccaacgtgacattttcatattgttgtctgaaatgattttattgtgtcttggtgctaaaatgaattatttggagctcttattcaggtttcagtaaagctattctgttctgccatgtgattatttattgggagaatgtattgtttttcatgcgtcaagttattaaaacaaagctcaacacgtggtttcataattgtgactaaaatagcccatagaatacctaatttcctttgatcctttatgttgaacagttcaggccgtggtacttgccttgataatgagcctcccaagcgtgactttctttatccagctgtggccccaggtcaggtgtatgatgctgatgagcaatgtcgtttccagtatggagcaacctcccgccaatgtaaatatggggtaagaagtcttcatccttatgtttcgtcatttatacgtgttcttccatgacacagatgttaagatggaattacgatgaatgtcggttccctctagtaatatctttaatttaaatatggcttttgacactgcagtttttctgacatcatatgtacaatattttttctaaatgtttcaataatcctaagttaagcacattacagatttcttgtgagggatgcaggtagaattttagtaattcttaatatattttttctttaaatcttgaatttatgatgccaactttatttcgtcttttgaaatgttatggctttaaaatccctctgccacttttctgatactcttataattgagctaaagggcatttttacattagctagacagctttacttttattcctacttgatagtgctaagtcacttcatgttgcttcatccactgcccacattccagcaccacaaccaagcaggaacaagatgacattagctcaagtagtgaaacaaggaaaattgctatgaaagaaaaaaaaatgtaggcatcataatttattctgcatgtctgccttaaaaaaaagtcacagtgtctacatcagaaaatgaataaaattctttttaagtttcatagagcaagattttagtggacatgttcttattaagaacacaatataagcatagtgaatgaaaaaattggtttttaatatgtcaaattgcttaccaaaaaaattcagatttaaaaaataagttgagagccttgatttttttttctttttcttttttttgagacagagtctcgctctgtcgcccaggctggagtgcagtggtgcaatcttggctcactgcaacctctgtctcctgggttcaagcaattctcctgcctcagtctcctgagtagctgggaatacaggcgtgcaccatcatgcccggctgatttttgtatttttagtagagacggggttttgccatgttggccaggctggtctcgaactcctggcctcaagtgatctgcccaccttggcctcccaaagagctaggattacaggtgtgagccactgcgcctggcctgatttctatttctatgcaaatagtcttttaaatcctcttttagaaataataataattaagggttaaggtagtattgtactgtatcattgcactgtatgtatcctctttaggtacagaataaaaggaagtgttttcttaaatatctctttggtgacaagtatattattattattcttgttaggctttagcagcacatttgtgcactagcttgaaagattgtgtgtgattatatgatatgtagaaccttgtgtaaaactttggcttatccttaatcttattttgtatggttctagtttcttttgttcttaggttgtttatgtttcaataaaagtcagtcgaactttaatcatagtctttctatatatacttacggattaatacattgaaattcatgatcaaatgaacttagaaaatttctgttagattattcatatctatgtctctcatttctttgttagcaagtgaaataatctatatttttgttttctattggaaactggattttaactctacatgcaaatttctacattagataatttattcagttttatagaatctatggctacacgatatagtctttttctctctcaaataaattaataaaaatttgacttaattcttcttgctatatctatatatctaattcagttcagactaattgatttgaaatgagataaagaatacaaaattatatatttttactttatgttcctgatattctgcttttatattctttttatttgagatggagttttgctctgtcacccaggctggagtgcagtggcacagttttggctcactacaacctccacctcctaggttattctctcacctcagcctctgagtagctgggattacaggcgctcaccaccacatctggctgttttgtatttttggtagagatggggtttcaccatgttggccaagctggtcttgaactcctgacctcaagtgatcagcccgcctcggcctcccaaagtgttgggattacaggtgtgagccaccatgcgtggcttgcctttatattcttaatatgttttgtttataaagacttctgtaatagatacaaactaaaattggaaaactttgagaaagacattagtatcttacagacctacacagttttaagtattttatcgtgaatccttttcactttgatttgtagcaaaataatggtttccctagattcatatactatatgaaaatgcttgtgttatttgtttaagtgcaatatgttactaacaaagtgtattgagtcataattgattctttacaatcactcccacctctgaacttgtgtcggtttacacaaatctacgctggtttatatctggtgaatccctaaggttttaaacaattctaaatactactttggaaaacaatagtggcttcaaaggtcagagtccagtgggtaagcaaatcatacttcagatggcagctgaagggaaaaacaaaccagccctgatttaggtagctgtctaagtgtagcatgctgaaatgaacactaaatacagttgctgtagacttaggagaatattttagaatttttgagaggagatacatctggtgttgaaaaatcatgaaatgattcctctttcaactagcaggtctctcatgatgtcaggaaagattttaaagaactacagaatgggccaggtgtggtggctcacgcctgtaatcccaccactttgggaggccgaggtgggtggatcaagaggttaggagatcaagaccatcctggctaacatggtgaaacctcatctctactaaaaatacaaaaattagctgggcgtggtggtgcacgcctgtagtcccagctactcaggagtctgaggcaggagaatcacttgaacccgggaagcggaggttgcagtgagccgagatagtgccactgcactccagtccagcctgggctacagagggagactccatcttaaaaaaaaaaaaaagaaaagaaaagaaaaaaagaaaaaagaaaaaaaaagaactaccgaaggatctatactgcagaagtgatcagctttccatctcttccacttggccataaagtagtcattgctgggttaccaatgattacatctgtagttatgaaaaatcttgcctgaattcttagtgagtaggttcattaatatacatgttagttatgtttggaaatttacatgaaaatttttctgttttattttactcagggcaacatttttcactattattcttgcatatcatcttttcttatttttcaagtgttcttaaattcctatagaagttgtgaggaggttgtaatggctgtaaatacaaagaacaaaacagtacagtacaatatacagagtaatatagttgtataatgcagtattctataaatgatatatagtttctggtatttatgtagtgactttttttctgagctacttcagattgagttgataaaaatcataattattggccaggcacggtggctcacgcctgtaatcccagcactttgggaacccaaggcaggtggatcacctgaggttgggagttcgagaccagcctgaccaacgtggagaaaccctgtctctactgaaaatacaaaattagccaggcgtggtggcacatgcctgtaatcccagctactcgggaggctgaggctggaaaatggcttgaacccaggaggcgggggttgcagtgagctgagattgtgccactgcactccagcctgggcaacaagagcaaaactccatctcaaaaaacaaacaaacaaatcataattattatataatattttataggtgaggaaactaaaaatacagaatgtgatatacctactccaaagtaaataaataaataaataaagtcctaattgatgtcagttctgttttctattaggaatagtaattatgttaatgaaacacaggtagcagatgtattttgttttacaagacacttgttattaaatttttatcaggtaatgtctgttactaaaaatcttctctaaagtcctgtccccgtcttttttgggggagaggtggtcgggggaccttctctaaagtcattttttagggtcataagttatcagatgtctgaaactcttgagtcctggatttaagtgaatttcttttcttttaccttatataaaaagataggacgtcttcaaggtacctgcaaagctagattcttaccagatcatctaaaaatatctgctagctctgttgtaggtttctaaggggccttggatgattcctggatgaaaatacattgcaaataaaacagcagtatcagtatgtccaagaaatgtttctttggctttttagagtaataagctctttcctgtaaaactctggagaatctgttgtctcttccattttccattaatctcttttttattagaaaagaattacaaaaactgaattatcaaaaagcatactgcagtaataacaataagtttaaacgtaggaaggaagtcactaatgagcctatataatgtaggggctgtgggtaatcttttgactgcttcccaaaaagcatagattaattcaaggctcagcctcagctttagctctttatttctttattctgtcacttaaatcaaatctcaattattgttttccagtacacttaatggttcagtataggttaacaatatccagtacataatttactgttaattattaagagctgattgttcatctacaggtagatttaagaccacaaaatcaaagaaattttatagacatcatagctttgtttatttatgggaaatttttattgtctatgaagtttgtcactgtttacatagacttaaatgttagcacataaatgcataatagtgtgttgtacatgttactgcttattttaaatgtagaactgaagaatgttttatcagtaggccatatatcctgaaccataaatgggaacacatgagctaatacatggtgtcatgatggatggaacagcatatttttatcagaatattttaaataaaaaaaaatctgttcaccataaactattactatgacctaaaattgaccattaatagattttactcagttttgggcacttttttcagcgaacagcagccaggttgttcttgtaaacttcagacagcaaaaaggtatgacaagcatgcaaattgtcttttatttacctggcacatgacattcaataaatgttttcatttcctctatgaacctctgtcatccgtgataacatttcggtatagctgataatgctggtactgctttaggagaatctgaaccttttgtactttggggagcatgttaagatattccaaggcgcacatactgactcaatttcactcttcagtctcagctcaaatgccagtttctcttccgacaggccttctgtctgatcattcgctattaaaaaggctttcctcagttactctgtttcacattatactgtttattactttcatagcacttttagaaatccataatcatgttgcttatttggttacttattaagtgtgatcatgtaaatgaggccttttctaacaacattacttaatattgtacatccacgtgcacacacagacacatacacacacacttcctatcattttccttaacatttatcatttcctgacatactatctattttacttgtttatcttgcttattactactttcccccctagaaagtattttccttgggggcagatattttgtctgattcacagctgtatccccagtggctagaacagtgcctggctcatggtaggtgctcaattaatatttgttgaatgaatgagctgataattataatgggagtgtaactgccatgaggggaaggattccacctgacttgtttatggctatttgtgtagtgactagttcaatgcctggcatatgggaactcaataaatatttgacaaatagatgagtgagaagagttatctggtgaagagagtggagagaggacctttgggaagaccgagagcctgtgtatttgaagaggtgagagaaagccactgtgcccagtgctctcaaataaacaccacacaaaagaaacaggagaaaaaggtagaagccaagtgtaactgcaccttataggccacgttaagtttctatcttaaaagcagcaagatgccagaaaataacataatgtctaaggcatattatgtcttaggaaacaaatgtaattctgtaatctggaaaacccatgttagaaaattaaaggcttttataaagtgatctgtggtgtcctcttttcccttttctcttgccctccaaacacagcctacgcagagtactaaaacagctctgccactaatgattctccagtgtagcaatgtccttacttttataggtaaatatagaatttattctttttatactagagggtgcttataactctgaaatgagatgaatggaggtgtttgtgtgtaaaggtgtgtgggctccataattttgatttaagattgcagaatcccagtgtgttgtagtggaaacataacttataaaaggagaatatgacataactttaagacttcacattaatttttactctttccagtggaaatacatttgtgaccattgttatattttacttacagatcaccaaacttgaaagttttctcttctacttacctcaattagatgattaatgatagaataatctacaagtggttgagtgccatatttgttccaaactttaagtgataagagacttttaggatttaatattagaaatgaagatcaagagagtaaatatagatataaatttggatttattaatttatagtaagaaatctagccacatagtttatattcattcaattccattgaaatctgcatattttctcactgaaacaaacctacccagtaggccaatttattattgaaaaattattcagtaagccttgaataaaaatatggggtagtgcatagattattttcttaatatattaattaataactataataataatgccatcaagctgtgcctacctgaatatagctctttgatgtcagggtaactgctagagacaagatagttgagttctctgatcaaggtatcctttccctggagagtatttaataaaaactgacatgctttgtctctcagactcatgcttattcccttttgtttattttattattttatcaccaccaattaaaaaagattcagttattattgcattgttattgagaatcattctttcatataattgtatgttagttgtacgagtcttttggggatatcactggccacctatacaacttttttaagagatacagacaacttgggagaggatagcagggaaatactgagaagtacatataagggaatgagaaaatgagtttgagtagcctgtaaaaaagaaagctaaatgttggcctcaaaaaccattttctggttttggaacacttattacagtttgattgctggtaacaaattgttctgcttccctaccaagagcataaaatatcccacagttgtcttaatttttacagctggaaggttgtagattaggtattaggaagaatttcaagttattaaatattggaatgttaaactgagaaagattatagaatcacactttccttgaagattttaaggtggtataaatattctacagtgttgttttatacaggtttagggaataaaaggtgtgtaattattttagcacctcaatattcttttgaaatccaaacatatatttatcaggcatatacttgacaagaagtttatttgatttttttcttaaattctaagctaaaatcataagtccatgatcacttgtatctttaaagattactagtttttaccctgcatttgcttcttagaggttttttcttttcttttcttttttttaaccatttagtcagttttgaatacttttaagttggtgattagttatataaatgggatttgtggattaagggtttttttagtttagtttttggttttttgccattctaggatctgttgtacttaaatttcccattacccgtaacataacaggattaaactatttaaggcaaaaataagggtacattatcctctttcttcagatggctactaaacacctgaaactaggccataaggtcaccatatgttggttttcaattttcctttgtgtgatcaaatgataagtaacctttctaagcactgatgccccttcctgacctttagggctctgctctccctctttaccttcaggatcctttattgcaagcagctgttgagaggtgttactgataggctaatgtggacaaagaggatgtttcatatttagaatcaaggacccaacatgcctagaatttagagtttcccaagggccaaaagtgtgcgcatgtctcttttttagtctttaaacttcattttaaaaaaattttaaagccagccagcagctgtaaaccaacaataaaatcctaagctcctcaaccgttagaccccaccttccttcttggccaaggttattccaaagtaaacctgaaaatctagttgaggccacgatgggaaggtggggtcagacatacctcattataccgtcctctctttggaaggtacagctgaccaacattatcattaaaacagagatcttaagattgatgaaacagactctttgtagcaataagataccaaattccaacctgactctcgtatagcatcacatgacggatagcaggccccgaaagaaatggaaaaattttaccctaaaatctatttatttggcatatgttgaagcggccctgtagagctgtctcttgtagggagaagacacattctgctgagaatccccttccctttccaggtcttttccctgatccagcagagaattaactgggagtctggcacctttttaagtctaataagaaacatttacaaactattctctctgggaagcctgctacctggaggcttcatctgcataataagaaccttgattttcacaattccttatcctaacccagacattctcttctattgattccaggtctttagataataactctttcaaccaactgccaatcagaaaatcttctactccatctatgacctggaactccccaccccttaaaatgtataaaaccaagctgtagcctgaccaccttgggcatatgttcttaggatctcctggggccatgtcatgggccattgatgactcatatttgacctagaataaatctcttcaaatattttacagagtttgacacttttttgccgacacaataaagacaccattttctcttcacatactgctttccttaatgatataataattgtaaaatgattttattctttcatgatgtcacctcctccccttgtgtaagctgctaattttaattttcctcggtaaatagaagagtttctcttcccattttttagtctggtttaacgtatatagtttcttaaaaataatgaaaacattagaaaaggtaattctaacaatttttagaaattatactctttgtgaaacaatcattccattctgatcaaaaaagccctattttagttctttacaaggttattttctgcatattaggtaagttattttacattagatgattaccataaaactgttttctaaatatatttttattacccacttatatttgttaatattttaaattattgttaatatttacaaatagtgttgttcatttcaaaactcatgtaaaccaaaaatctgtgaattgatactaaaattttaaataagtaggagtatttttaaatgtcttgtttcttggaagaccttgaaacacttttgtgaaatatgttaacagtatctttttaaaatccacacccaagtgttgatattacatttggaagttcagtaataataatgcataagttgattcctaaactcatatattgagtgaagatgttataaattagtatataatagttataatttggagatattgtccgttaaaatcaaagtaaaaaataggagggtattaagtttagtgaggttttatattttattggaatacaaaagtaaaccattactaatcagccttaattggccagtgacatttttcagttctgatacatttaagagaaatgggaaagtagcttaggtgtgtggtgattatctgggacattgatatcgaacagagctgattcaaatctacatctagttagaactgaaacaaattgctaaattattctgaacctaaagtttctcacattttctaaagagattaccatgatgaataaatgagatacaaatatgaatatgcctggcatagttgttgatagtataccctgaaaaaaaattagttcctttcttttattcctgcctacaacatccctacatgatccctaagtgatcatgaaatatgtgctgaagtatctacagtgatggggattcagttttagttcatcatggttcactctgacttttggaagattcttctgtatatagaactgaaatctgcttttacgcattgattgaactgacttctcctctaggttgtcctgcatattttttccccagtcatttataaaattgactttctaaactctaggaaaatagttccagtttcaacaacaggacaaatagtaaacacaatcattccttcaggtatgaaaacaagaatgctagataaaataaaactaataaactcaactaaatttagttcatttagctacaacatgtacttatgtgatcagaaaggacataggaacagttgaggaatgatgccagtataatgcacaagccttgtttttttcatgtgtgaatgtttcctagtatattaatgatttgaagctatcgggcaagctttctcatatttaaagatatagtctatagcattaaagactcttagaaaggcctaaagaaaggtctttttataattcaacatggtggttggcttagtggctttatttccaaaacactaagctctttattgcagccatgagggcagatgatgaagctgtgaagatacacatcttttgtatcatttgtgttatagtttaaaagttgattgataaagctaaagtctggatccaattcttaatttttatgaaagaggtttctattggaggcaaatgtcctcaaaagccaatgtctctaagaaggaagcattacaaaccacagagattaaggctgcaaaggatcagctgattgggatgctgggaacaaatgccagcagagatttaactgtgcaaatgctttaatgaggcaaaaaatggctcccataagaaactgaagccccaggcttgtgcctcacataagaacaaagtaaaaccatatacagcctacatggtgctgaccaaataaatcaacatgacaaattggttcagtgaaaaccttgggatgtgtgatagaaataaatgaaggtgcacttctacaattcaagaggcacagaatacgcaaagaaaaaataatattcactgaagataagcttgaatacaaaataacaaacaacacgaggaaacaatccaccatgaagttgacagataggaagattaatgatccaagagaaaaagatagggaaatatctaagagaggttaagaaataggtggttgaaatgagaaggtctaacttaagttaaataggagctttagaagaaagaataggaaagatacacattaaaagagataataactaatagttttttagaatcaaagaaagacatagaaatcagagcatgaatctcaagtagataaataaaaagaacacttagatatagtaatgaagcccaggcagagtggctcatgcctgtaatcccagcactttgggaggccgaggcaggcagatcacttgaggtcaggagctcaagaacagcctggccaatgtggtgaaaccctgtctctaccaaaaatacaaaaattagccaggcatggtggcaggcgcctgtaatcccagctactcaggaggctgaggcaggagatttgcttgaacccgggaggcggaggttgcagtgagcctagatggcaccattgcactctagcccgggtgacagaacgagactatgtctcacaaaaaaataaataaataaaagatacagtgatgaaattgtcccaaagcagatagagaaaaaaattggaagcaacaagaaagactacaaaggtcgggtacggtggctcatgcctgtaatcccagtgctttgagagaccaaggcaggaggattccttgagctcaggagttcaagaccagcttgagcaacatggtgaaactctgtgtctaccaaaaaatacaaaaactagctgagcgtggtggcatgtgcttgtagtcccagctactttgggggatgaggtgggaggatcacttgagcctgggaagtcaaggctgcagtgagccatgttcacaccactacacttcagcctgggctacagagtgagaccctgcctcaaaaaaaaaaaaaaaaaagactgtaaagaagaaacagcagttagactgacaagtgacttttcatcagcctccacagaagtcaaatgacgatgaattttaacaccttcaaatgctaaggtaagataaatgtcagcctagtatattcaatttaaatatcattaaaaaatgagaatacaattaagatattttcagaaaaatatgaaaaagtgtcccttgctaaattaactgctaatggatgtatgtcaaaaagaaagaaattggattcagaagatagtggtaagatataagaagaaattggcattaaaagcactggtaaacacagatacaactaaacaaacattgactatcaagtcttgggcaatggaaaaaatgctcaacatcactaatcatcagggaaatgcaaattaaaaccacagtgagataccaccttactcctgcaagaattgacattattaaaaagtcaaaaaacaatagatgttgtcatggatgtgagggaaagggaacacttacacattgctgatggacatgtaaattagtacctcaatggaaagcataaaggagattccttaaagagttaaaagtaggtctgccttttgatctagcaatcccactactgggtatctacccaaaggaaaagaagtcattatatggaaaagactcttgcacacgtatatgtatatttatagcagcacaattcacaattgcaaagatgtggaaccaatctaagtgcccatcgactaatgagtgaacaaagaaactggtatatacaccttgtggaatactactcagccataaagggatcaaagtatgtcttgcagcagcttgaatggagctggaggccattattctaagtgaagtaacacaagagtggaaaaccaaacattgtatgttctcacttataagtgggagctaagctatgagtataccgaggcatacagagtgatataatggactttagagactcaagggggagggtgggaggggtctagaggtaaactacatattagttacagtgtacactactcaggtgagaggtgcactaaaatctcaaaattcaccacggtataattcatccatgtaacaaaaaaccacttgtaccccaaacgttattgaaataaaaaatttaaaaaaaagtcttgggcagcgggtcattcagaaacttttagacttttgtaggcaaggaaaattcccttctaaaaactagcagacaaggatagagatttcaattcttaattttgccagaaaggaacattttgcaaagcgtgccataagcatacagaccctgcccttgggaattttacagtctactgtaacaccaataaagtaaaaaattacaacttaacaaataaggacagtccattaaaataaaaagcattagttttatggaaaaaaaaaaaactgtccagtcttggtatggtggctaacacctgtaatcccaacactttggaaggccgaggcaggaggatctcttgagcccaggagttcaaggttgcagtgagacctcaaaacgaaataaagcaagcacctgttcacattgacatcatccttctaattttgtcaaagaacattaaaaactttatcatagagcaataccaatccatgccatttgggctacatgtctgactataacctacattttcctctgaagtgcccatgaattctaagtgattattatttttttataaaaccaacataatgcctggtgcatagcagattcttgataaatattctagaatgagttgggaaaaagctattacttttgtattgccaggcattcctcctaactgattggaagttgaccccataacattagagattccaattcaaatttacagtgtcatataacagaaatgtcctttagtggggactgtggataacttctctctccttccttaaactcaagagcaagcacaaagacccaaatttcccttacagagccttcccaaaacaaaatttaggattatcaaggggattctaacacacaggtgctgatttattaattcacagaggttatgaaactaatcttaataaatcttaacttctatcaggattcatgagtatgtgaaagagagctagagctaagctggtggatagtaaaaagaaaaaaagaaaatcattctttctcactatacttcagcacctcctatattttatttagggaaatctgcctactatgatggttgccatgcaaattccccaagaggcaaacaatttcagcatccatttaactttattagagcctggaacctatgttaggctgcttattcagcaactaatatgcatgtgcaaatgaaactgacatacctatgcaaatatatcatccatgttctaggatttagcagtttagagaaagaagtgtatttctgaaagtgtggaattgatctcaagttcatttaggaagtctacttcttgtttacttggtatgaaatgaaattttctttttatctttcaagagagtatcctttaaaagaaaaaaaagtcttgggaaacattccgaaattggataccagtatctttcttattcaagttgagattcaaattgcaagatctatctgaaaactcttcagagccttctccatgactagttctacattttgggagtgttcctcaacatagaattccactcccatactttaaacagtgattttactgtaaaagagaagttaatatggtaacaaaatttgaatccccaggagcccaccaaggtaacaaaatgcattagaagtggagatctagttttcaaaatgcatcattctctaaaaggtaagagggctctattgtgaatcttcagattaaggttttgaaaaaagtatcttaagcacctgctactttgggtagagattttcaaggcacttttggaaaataaagtttctgtaacctgactaaatagtgtgttttcctgatagatgcaataagtatcgtctttttcaataatagaactttcatcgcttagttttgtctaaagtaaactttaggcttcttttacctttgtctaaagtaagaatgcaacctaataaagatcacaaaagatcaggagtatcatccaggactatggatgaaaatttttcataatctttatattaatctctattaatggtcctctgtttttatgaacacatttttccttgaatttggatagatttttgatacatggagcaatatttcaaagcccttaaatgttactcttactgctttttaaatattaaactacaagaatatattaaggaatataaactaaaaaaccatctttttatttattttatttttattttacttatttatttgtttttattttactttaagttctgggatacatgtgcagaacctgcaggtttaaaaaccttcttctatagaaaaagagtaaagtagtataaataacctcttaaaacataaactaaagctttgaaagaaaagtgaatttgtaatattggatcgtaaacatgagaacgttttatgtttatgttatgatccacagtacatgatccctttctttctctttctttctttctttctctttcttttttcttttctttctttctttcttttctttctttctttctttctttctttctttctttctttctttctttctttctttctttctttctcttctttctttcttcatttctctctgtctctctctctttctttccatcccttccctcctaacttccttccttcctttccctccctccctacctctctctctctttctttcctttttttttttttttttttttttttttttgacacagagcctcattctgtcatccaggctggagtgcaatggtgcagttcactgcaacttctaactcttgggctcaagcgatcttcccacctcgacctcctaaactgtgggattacaggcatcagccactgcgcctggcccatgctcttcttttctaatattttgtctctctaggccactagttctccaaatggagtttaaacatttttaggtatttaaaagcctaataggaccaggcacggtggctcacgcctgtaatctcagcactttgggaggccaagtgggggcagatcacgaggtcaggagttcaagaccagcctggccaacatcgtgaaaccctgtctctactgaaaatacaaaaattagctgggcatggtggcgggtgcctgtagtcccagctacttgggaggctgaggcaagagagtcgcttgaacccaggaggtggaggttgcagtgagctgagattgtgccaccgcactccagcctaggtgacacagtgagactctgtctcagaaaacaaacaaacaaacaaacaaaaaccttaatagacactatatatctcctctctgcctggtaggaggcaccctaaagaggaacccaaagagatcccctcaattttttatactctgtggggcacttccatttgtaggaccagttaaccagtgacatcgatatttcattgccttaattctgattgtgtttgtaatgtgagttcttatgttttgggagttaaaagatcagttgaggaataaaagcaaaaggattaaatgtgatgttagtttacttttgcatttcagataatcatttttattataaatatatattatactaagttctagcttaagttaaaaacttgtaacattggtaatgatgctagttggtgattatatataaaaataaactgaaaatttgactattttcttcaaaaggaagctttttgggggcggttgaaaccctttatgtaggaataatattgaacggcttattttaaaatctgatatgttaatatagtattaacaaaaaagtattttatattgtcaatattagaataagtgttgtaattttcctatgctgaggtaggataatggaaaatcataggaaaggagacaactccacacaacatacccaaagcattctataaacagcagcatttgttcaaaaccaagtttcctttcatggaggtaggctaaattgatgtactgaaaataacgttgttagattgtgcctaggcgtatatgaatgttaaaaattactccaaaatatacttcaaaatttaaaaaattcatacattaaattcttatccattccatggtctattttcctgttttaaaattgtcttcatttgaatattatggtagatctaagaagtcattttcctggcatctctttattagtaattggtaagtttgtattattgtatattcttgagtgtaataaacatatatttcctttctacatagtcatttttttctccctattcatctatattaatgaaatttctatacactattgtaaaaagatcctaactaatattaaaagctaagatatactttatctgctaaaataagaattgcaaagacaaatagttaaatgatactgcaagatgtttcataaaaacctcctccaaaatcctcaactgcgatgcttcagcagcaaaaggtacccagggtctcttgaaagtaatgcagagtgactgtaagtgtattttatggaagaattggacatgactctatttctgatcaacttgcttttgccttctttcctaggaagtgtgtagagagctctggtgtctcagcaaaagcaaccgctgtgtcaccaacagtattccagcagctgaggggacactgtgtcaaactgggaatattgaaaaaggggtaagctcaatgatttactacctgtttgacatgtatacaaaagtgataaattgctggtactgatattcaaccaccaggaagtcttatatattcatttaaaatctacttgaaaataattaattcctagaacaataggttaattgtcataccttggtagctgcaaatatgcattatttaggaaattacagttggtaagtctattttaggtcagtttcacctttattttggtatatgtatgttatatttgtaccaaaagtaatgcaacaacaatctttttgttatgtaatgtagtctgtttactcatataacatagtctagtttttctggtaaataattccccggaaaattatgcaacccagaagtagactttataactatagtattactaaagtcacttttttttttttttttgagacagggtctcatggtctcattttgttgctcaggctgtagtgcaggggtacgatcttggctcactgcaacctccacctctggggctcaagcaatcctcccacctcagcctcctaagtagctgggactacaggtacacaccaccacgcccagctaatttttgtatttttcggtagagacggggtttcaccatgttgcccgggctggtctcgaactcctgagctcaagtgatctgcccacctcagcctcccaaagtgctgggactataggcatgagctaccacaccccatctaaagtcacttttagattgcagtatgagagaagggactagtagaaaaataataattaaataatttattgaacatagaaattagagcaaataattttagattcatcaatctagctttcaaaaatataattattaagacttatttaaacatgcttggcacagtggcccgcccctgtagtcccagctaagtgggaagctcgagtgggaggatcactcaagcctagaaattcgagtccatcctatgcaacaaagtgagagactctgtctctaaaaaaaggaaaaacaacaacaattgttgaaacagatagtagcagtttgtgtactactcttaaaattttataggaattgctatttatgtaaatttaaattctagaatttatttctatagactgaatttgcaataactattactgtcatctgttctcagttctgacttcttccatgttagctgggctagtttcaacaaggattatgctgagtttcagcttgcaatctgatgtttaagtaaaaaagaatgaaagcttttgggcagctgtcacagtttattaatccttgctgacggcttcattcaggacccatgacctagtgccatgttgatggcttttccatgctaagtttggaaatgttggtaaattatgctaaatatatgaactgatagggtaattgaaaaaggatttagaatctttttttttaagatattgtaagtagccaataaaaatacaaagaaattcatgcactaccaaaaattccttctattttttttcactaaagtaatagaaaatattaggaattgcattcttgaaacaacaatccatatttactttggaaccaataattcttgtcaatttacctcagtctctacttagaagaaatacacaaccataaagagggagagtcacagggagaatctgtttctttatttgccattgatttattattattctcatgatcaagttcatggtccacagtaaaccactagtagtggctatctgagaacacatagctcagctccaccagtaaattatattgtaaatacgtatttaatactgatcatttgtgcttaaagcagggccatcaaatgtcatatcttatagcatatatgtgcgtatatatgatagagatgataaatttcttggaaattacaatttgagggataactagaaatactctcagacaattttaaagctaatggtattgaatttaaatttcaataagcaaatagagaggaaatgtaatttgtgttttttttttttttttttttttagacggagtatagctctgtcaccaggctggagtgcagtggcactatctcggctcactgcaaccttcacctcctggatttaagcaattctgctgcctgagtagctgggattacaggcacataccaccatgcccagctaatttttgtatttttagtagagatggggtttcaccactttggccaggctggtctccatctcctgaccttgtgatccgcccacctcggcctcccaaagtgctgggattataggtgtgagccaccgtgcccagccaaatataattacttctaagcacaaataagaatgatcacagacaagagaaagtgataaaatggggcaaaatatatttgatttctaaagattcaccttcttaatctaggttaatcatcaactttttgatccataaaccctttctttaaatgaagtctatagaattctaatatatatacatttgaaaaaaatggaaatgctctggtttaaaaagcctcttgcctgccctttaccctgtctttggacctttgccagcttctgacatacctccaaaggcctccatgaaaaactatttaaaaaccttgtaaatatggcaaagtttatatgtcaaggggtcatttatattcacaacataagagtgtactatcataaggccaatatagcggatatcactgtctaaaacttatctacaaaacaaatctttgttgtttttccagagacctggaagatagataaagttttaggaatgacactaataagtcttaaaaagaatgaataaatgaatgaaaaaaatacaaatgcagattcctagaaaggaaaaggatagagcagtagatggtcctcagaataaccttattaactttgaacttatgaagaagctttcagaaaactaaatcagcctgcatttttaagaaaaaacaaacaaaaagaactagacacgtgagcaaaacacttctttattttttatcttttactaactgtattgaccatgttacctcttgtatgaatttttgttgttaatttttgttatttttttctccttaagaaggaagaatatttactgttgccaaatggagattttgcccttagggctataatatttggaaagtaaaccagacctcagaattttgacccagagcaaaacagccctgcaaagagctattgacaaaattaaagtggaattttcaattaatctggtcaactttctgtggttagtttgtatacttgccatctaaaaataattgacatcccagtaacaataatgacaaagatgatgaatatttaagaagtacttacggccgggcctggtggcttatgcctacaatcccagcactttgggaagcctaggtgggctgatcaccttaggtcaggagttcaagactagcctggccaacatggtgaaaccctgtctctactaaaaatacaaaaattagccgggcatggtggcaggcacctgtagtcccagctactcaggagcctgagacaggaggatcacttgaacccaggaggcggaggttgcagtgagacaagattgcacgccattgccctccagcctgggcaacagagcaagactccatctcaaaaaaaaaaaaaaaaaaagtacttacactatgcccatcacatgttgctaagtactttacaatcattcttatgtttaatattaagagaaatcatatgaggtaggtacagttttaactccattttacagaagagaaaaataagacttactagccctaaattgaacagtaatttaatggcatagctgacatttcagcccaggtctttctaatttcagagttgaaatctttgcctctctatgctgactctaattttactttatcttcacatgagaaattttgcaaagtaaaaaagcaatttttcattgtcacgggaatcaagtgggtcactaagcctaatctaggtggtgacagtgtatttcgccctttagtactaaacagatttttcatttttctacctgtaaacagtgtttccttttaggaatcacaataagaaagcaatgtgagtagaacattgagctaagcatatatgattgtgtgacaattggtaaaataatgaatctctaaaatgggagacaaccaatttctatatatttcgtagagataatataaggatagaattagataatatttcagtgagctttttgcgggcctcctcagagggaaagtgctaacatattactagagtatcatcaatacttttcattgttatttgccaaccttaaatgatggtgggcagaaaattctttggcagactgccttagctggcagtagagagtataagcatgagtttgtgtgtctccgagaaatggatgaaatattcacaacctctggtcttaactctgagtttcaaaactactctcaccagaaggaacaggaaagaacctatacactgtctagccagcagaataaaaccaaagctgctcatagttttctgaataaatctttttttaaaagggagggggtagaaatactgctcgagtgatagcatagacatatccagaggattgaatccatgatgatctcgtcaaactctggctgcaaaagatatgggatccctgcccaggggcgcagttccacaaatgttccatgtaagtatgggaactgttccatgcacatttaacagatggagtaagaaatatggccaaaaaattaaaaactgatctttgcgtgagtcctggggggtctgacatcgctattacagccattggatgttcgcctgaataagccattcaaggattgaataagaaccatatggtctgaatggatgtgctcagggacagtagcattaaccaaaggaggaaatttgatgagcccagacggtgcgctggtactgtgtgtctatgggtcagtctcctacaaatcaattaatataactttcagccagagagctttccttggatacagcatcagcaatagccctttggacaggaatcagagcaatgccataattgacgaaatagtaaataaggatttagattgtaaaaactttgatagtagtgttggcattgttactgaacaggatattaaggataatcaaaacccaatccttgtaatccctgttggtgaccacaaagaaggcttcaaatactggcttatagccaatagattgatttaatgactctacaagacccaattagagatatagcccagtatttgggtttacatgtaagtgacattgattcctaatatctttccataggaaacacagggctggattagaatagtattattaaatgcccttctaaagcactggatatataataggacgtttgcagccttagttcttaatttacttagggtagaatacagtatgttttgactggttcccaaactataaacacaggaagtgaagaaagaatagttcttccaattgctgtagaaatctaaatagtatgggatgacaacttctgatttagaatttgggctgaaatgtagctttagcattcctgcacctgcacagtggaaagataaggcttttaatagtgctgtgctccaacactcagctcttctgacttgggaagaatgttctgtattgaatcactaatattacttcctgcaaaatcttagaatttccttagaggtctcttattccaaatgctgcctggacccagtactggatattaaaaggtataccataatcacatctagaaaaaaattttttttaaatactgcatatactcatcttgaagttttccttcatggaaatgtgacaaattttcaaagttaaattatttgatttataatgtatctttcttaaagtcccttgatgtagatcataatatttagtagtataatagcaagagatgttgtttaataataagtagtgtttctaaagaaggctcttaaagcctgactggaatataccatctttctagattgtgttgaaaacatttatttaatttagaagaaatgtgaaaagcaataatgaacaatataagattttattcttggaaaaaaatatgatggcttcacttctttaacctttatgaatgtggttaaacataccccaattagcaagaagaaggccaaatttatccaatttatccggataatttagactaaagtaacatgactgttatttagaatagtccaaaatcactagattggataacctttgaaaataaagattagaaacttgtttgcatctacatatttaacttttctagtttaaaacgtaaagtaaaattctatctctctgtaaatagagcttttacaggtttggtaacttcaggtaaaagaaagagtaaaaacagatggcacaacactcagaatctcattattatgtggttataagatttatatattccaagttgctttatttggtgtaatctaattattctactcattatttacacacattaaactcttaatttatattgattaatgcaatcagctagaagagtcattcaaatcacttgatccacatgaagtccccatgggcttcttaaagcccttttgttaattaaataagtttcttctcttaaaatcatatactacattgatgtttactactaccaaaggagaaaagtagccataattataaagagatccatttttataaataacaaaggaggaaaacaaaacacgaacacttctgcagagatcaaaatcaaacaagttgttccgtaggtttttaacttttttgaaggtatgtatgcgttgaactattttaaaagtttccctaatctaaaccatattggaatcaagaactaaaattagtttccattttatagttaaggaaacaaaagagaagaaagaaaagtgacttgctttggatcaaagatattgctagaactgaagtttgtaacataaagtcctacacagaccaaagttgttaacttgttagctagttaactaagttgttaactagtattaaattagagactacactcttgtcaactgctaggtgactgatacttatattacaaattatttacccattaatgtttgttacttaactttctgataaaattacctattatgatatagctccatggaatagatataaccaaagcatgaatttatgcagtataaggccttttagcaaaccatttatgaaatactactgttgtgtagactttagtgatgaacactgagcagcattttacgaagtgaatattgtatttatcatttacctaaagaatgactttagttcatgtgacttttctcactgccctacattttgtgagcattctagaaatgtgtaataatattaataaatactttggaacctacatctttaagtattcttgtagctctcacaattcttttgtcacctgacaaatgaaaaaacctgactattttttctctacaaatcataggtatatacaaagaggtctgaaataacgtgtatctacagctgtgtttaaaaaaaaaactctagtattattttgtattttatgtagttataaaaatccagtaaagcatgttattctttaatgtcttcaaatacataatcatacacctccaatggatttttttttaccactaatttttttacgtattttagacagataatcccttttctactagtatgtgatcttgggcaagtcaattcctttaggttctggtgtcctcatctgaaaaactgaagtgcttaggccttatgaattctgaagttcctttgagctttagattcaactctgtgattatataaaataaatgtaaaatcaagctttaatgttatttgaaatcaataatgctaagtttccaatttgaaaaaataggcatgttttaagatttgaagtttctgaaagtgtcagttctcattaattgcagacagggaaaaaaaaaagcagttaattgctggccaggactatactgctcagttatttgcataggaaaactgggtgcaaacataaatatttttacacacagttacttgtagtaagaaaaccacaaaactggagattatttggccagatgttgtgacttttgtataggtgcagatctgatgcaattaacatatcactataaaaattgttcttcaagaccaactagctaagtcgtaagttttcaagtggaacattttctccttctcaagtatacattatcagtaaccctgatcacagggttgatactatattattggtttagccagctgcctcttcttcatcattctgaacagatgatctttttttcttcatgataatttttattgctcaaaactcaataatctttcttaatatcctgttttaatatatatcagacttagggtcagatattcttccctacagccaaggaaatgttaacttcctcttgcctaattttttatagacaaataattgctcagcactgctctaaaaagtccgttatgctgttacaactagcacagctcattgattgtcaatttggtaccatctactaggaaacaaatatgaatttggtttctttaccctccagtatctccagttccttcctgccatgtgataaccaaaataggacacaattccttaatttaactacttattaattaatctaattaatttttgttgcatacatactatgtgccaattaattaatctaataaatttttgttacatacacactacatgccaagtgctattctaggcattcattgtttccaataaaacgttttgtggtgatgcaaatgttctgcatctgctctgtccaacatagtagccactagctacctgtggctagtgggtctgaggaactgaattcttcaattaatttaaatttaaatagccacaagtgactcttgaggcttttacattacaaagaagtaatttgataagtaaacagggcaatttaaagtagtggtaagtggtaagagggaactaaagcagtaggacagaattactgttacatggtctgggagcaggaaagggtattgaggtatcattttagaatgaggatggtcaaggaaagatctctctgttgaaatgacacttgacctgagactgaaagatgagaagacagcagtagaaggaattgggaacaaagcattactagaaggaccagtaaattcagatgctctaaggaggaacaagattagtgtatgaaggtggaaatccaatgtgtctggagtaatctgtgtaagagagagaatggggctgaggaaggaggcaggggctagatcactaaatctactgttgatcagtgttatggaaataggaaaccactgagtttttttaagcaaaaaggtggcataatgtgatagcatgtttttaaaagatctttctaaatgctctctggaaaatagattctaggagaaaaaagtagaagcacaatgatcaggtaagaagctactccatttgccagtttgatctagagtatagcgatgaagaaggtgaaaagtaaaagaattccagggatattctggagataaaaccaacaaagcttggtgatagaattagtataataaactgatcactttctaagtaccacatcatgatcccttttcattttaatataaggttgaatttttattaaacaacctaacattgatgacatttgttcaactttgctgataaccatgttccttattgttattcatataaacaaatgactttcatagtagcattattttggtgtgtcaaagtttgataatttgaaaaatgcatcaacaaaagtctacaaatgcttggtttaaaaaagactttcattttgccatattctgcaaataagatttatcatgctagagttatgagttgattttgtgatgtctgtgtctcaataaattattcctggctttctacttaggtgcagtatgtgtggtttattacggagagtagagctgagcagaattccagtacatatgttcatgtgggggccatacacatggctagtcagtgtatacaagggtttttttgtacccagtccctaatgtcttggcattacttttattatgtctgcagtgctcatgtagatgaaatgccacaacacattcttttactattgtagcctcaaccggcttttttttttttttttttaagaaagagcaattaccatcataaaaattccttactggggaaccttccatattgcgttatcattccatgagtctaataatagtgaaatataaagaaaaattttaaataaaatactaaaatatctaaaaaagactttgaggtctatagctagctctataatgagaaacactaaaagtcaagaggaatagaaacaagggaaaagaagcaatgtgacttttttttagaactcccaatacaggttagaggcttataaatcatggtctagctaagataattcgcaagtcacatgcacattcaccagtgtctaaacacagttagagaactatctgtctgttatcaattgggagaatgctaatgcctatagttggtcagtacctgacccttatgtatttctatcctgatagctctatctgcctaaaagctaattctgtgttttctgtgaaatcttgcagtggtgttatcagggagattgtgttccttttggcacttggccccagagcatagatgggggctggggtccctggtcactatggggagagtgcagcaggacctgcgggggaggcgtctcctcatccctaagacactgtgacagtccagcgtaagtagctaaagtaagccggagccaacaaaaagacacagttggaaatgattcaaagctgtggtttcacatgttatctgtaaaaacgtttcgctagtgagccaagtacttgtcttcagaacaagccataggcacaggaaagtggaggagctttgttagacagactttcttcttcttcctttccccttattgtgtaaccaaaaataaaatgtaaaaaatagaaagtattgtgtatctgtcccagataagccagacttttaatctaataataatcagatttcctcctccaaaaactactgaattatggatgaatccagatctggtcttagctacattactattattcccaggaaacctaaggtcttttcacatgtcacataaaattattactgctacatcagtattaaaaggaccaatgagagcacttcaagggttgaaatgccttgattcgcatcacaaatcacaatgaaaagaatactgcccatgtgttaaaatagtttccattcatatgcccccattaatcatcttccggagctgccaccacttttctccccatgactgttttatgcaggtcagactgcacctcttccaccactgttttctccagccagagtccccctggcacaaggccagcaccatcagtattctttgctagctctgttgcttctccctcctaccagtgctccatgcccattacaggtgaacggttcctctagttgtactttcttgtcctccctgagactaaactgttctttggctgccgcatgtcaagtgcccatttttgtctagaacgctggttgaggaccttctttcccagctagtatttgatggagaatgatgttatgataacggcttttccttttttttttctcattctgaaataaaagatggtctatttttattttttagtttttctccatttttaactcaggatccctctctttggttcctgtctccaactgtcttttttcttttcttttactctttttagcttgttttgctttatgttagttctgtgtttccattctcccacttcctatcaattattcctctcttgctaaacagagcttcctgttacccattcataaaccagtcatgctaccaccatccccactatcttgtttttgtctgaccaacccatttctctcaagctggttcaagctgagccatttcccttccttacttagagtcagcattcactggcattcaaaatatattcaaaatgtagctttaatgatcccattgataccagtgagccaaaattataatttagacttgatctttttaaaaaaattacagaataactaacgtaagttcaactgaaagctgctataaattaatcaaagtataaaaaaccctgtgataaataatatacccagatacttaagggaaaaaactggacctcttttaaaagaagaaattagttgtttttatcactcaatggtagtatgcccaaataatagcaatggttttccctaatgttaaatcctttaaagattaacttatattagtcaaatatttgacgtcttactgtttcattaattttggtgaaatataaaatatttagtatttatataatgcaaagccatctgatttttagatttaaatttttaaacttcatggactattttgaaataagatggaaatttgtttttgcattattcactttgaatgaaagctatttccaaggagttatttcatgtctccttgcttcctgtctggagtaaaaacaaactttccatttcctagttggtgaacatatagcatcagattatggattttgttgaatatgatttaaatggcttttcattataaataagtgatttttactatgataattagaaaatatattgattcaattgattttcttgagaatgtaaatcatgacaattaagaatcttataaattactagtaaattaatacaaaattaatagtactattaataaaattaataataaactgccttaatttttatgttcaacaaccataattattgctaacaatcaccagcatgattactttaataattaaaacatgtcaaatgatatattttttgaaagtaaactttagtatgttttcatcaagtaatatatatactctttgtatggacagatgtattagtattcacattttaaacacaatgttttttcagaccttcaggaggtggaaaatattgccttggggaaaggaaacggtatcgctcctgtaacacagatgtaagtaaaaccaaactctgttatgaaaaattagcttactctttccctagagtagggaaatttttttaattttaaactatttgataagaaatacatgtgtgtgaaggtcacattaattttctaaattgttaataatgaatggagctggcctcagctccatcaattccattaataagggtcaagggggagctccagtactgggaacaagtatattcttccccaacagatatcaagagaggcacacacaccctgaactgccctgccccacacactcacaacttcaacaccactatctttcttgactccacagaattaatcttattatgccctttattccattttatgtttgccactgcaagaagccccagactcctacattatccctcatccaatagataagatgctgtatatttcctcctctgttctgttttgtatccctgcccaactactgaaacttcttctgtactttcaggaattcaaaacccctaatactcacttctctgaattttccttcctttcaccttcttactttaatggaaactagctcttcctctgaagatattgcttctcctatagtcttcaaactgggtaggcttttgttttctctcttagcccttgaatgactgagcctcaaagtggattgacaatgtttatatctcattactcctccagatcactcttcctccccctatctaaaaaccacagcttttaattaatgtcattagactgttaacattttcatgctttccacctctactactgtcttaattcttggtgattttataaatatgcagatgattgttcacttctgaatttttttcataaacatacaaacattctcctatctgtaaacaaacaaaccaaaaaaccatgctagttattttcccattgccttgtttcccattgaaacaaaatttctcaaaagacttgtctgtacttactgaatccatttcctctcttcacattattttttctagaattgctcctatcaggtttttgccttgatcattctatggaaatactcttgttaagtcacaggtgatttccatgctgttaaatctaatagtcaattctaagtcttcagcttactacttcactttcaataggcttccgggaaactacaacattttagttgttcttttacattaatgcttactcctcttcctccttcattggctcctactctttttgtttgtttgtttgtttgtttgtttgtttgtttgagacagagccttgttctgttggccaggccaggctggagtgcagtggcgccatcttggctcactgtaacctctgtctcctggattcaagcaattctcctgccttggcctcccgagtagctgtattacaggtgtgtgccaccacacctggctaattttatatatatatatatatacactttttagtagagactggggtttcaccacattggccagactggtctcgaactcctgacctcaggtgatccacccgcctcggcctcccaaagtgctgggattacaggtgtgagccatcatgcccggccagctcctactactctttactctgacctcaatgttagagtacccaagagttagtcagtggcctgtgtctctgctctaccaatactcctttctttggtgatcttatctggttccattgcttttgtaccatttatttgccatttgacccaaaatttatatcttcagcctgtacttctttcatgaattccaggttcatatcttatatttaaatagacttttaatggacatctaatgtttaacatgtccaactgttatccccaaaacattttctctactcgttcttccagcagtttttcccatctcagatgtaactccatttggcttacaccaaaaatcctggagtctttcttgacacctttttctgtctcatagcttatatccaattcctcaggaaatcccattagttttgccttcaaagtatatggtaggtgctgcctaacttcactactgctgctctggtctaagttaccattatctttcacaggattactctaatagccttttatgaggattcccctttgctatccagtcctcgatataggaggcagagtgaatcagattatcttttactcaaaacccctcaatggctccccattttacttaaatccaaagtcgttacaatggcctgcaaggtctacacaatctggctttcattacttctctgaactcatctcttactattttctttctcgttatctctgctccagcaacataggtccccttccttaaacatgcctgacatgctcctaccttcgggcttttgcagtgactattccctttgccttgtgtactcttctcccaaaatatctgtgtggttaactctctcgcctcacctttactcaactgtcaccttttcaatgagaccattctgagtactgaacttaaaattgcaaccctctccactccctacaactctaggactcctaatcttccttaccctactctattttctgcccttctatcacctatatagttgatttgtcatatttaattctattaaaattgtattttggagtattttggaataattacatgtagcttcaattatgatgatcttttagagttaccagtattatttattcatttgtttaaaaaataattgaatgcctattgtatattagaccatgcttgggtgagaaagacaatctctgccctcaaagagcttataaatttattgggaaatcacttaggtacagacaattataatacagagtggtaagtgatatgatgggattcagtatgggatgctatagaagtgcatagaatggcacctaacctaattagggacttaaggactttgtcccacaggaagctagagacatgaagggcaaatctaaggagaccagaaaaaagtgaaaatgagagcatcttagaaggaaaattaagtgcaaggcctagaggctaagaagtgtgatctttatcttgggacatttgaaaccattgaaagagcctcagattgatgctttagatgagaatggattggtgaaagacaagattacaacagaacaataaatcaagaaaaacgtaaggatattggtaagaatgattgaagtgctgagccatgggctctgcgctaggaataacagtggagtccaaagagggctaacagggaataaattaaggacctaacttaaaaagccataaaaatcaaagaaccagaatagtaggaaatacagggtgagagagatagaaggtgaggagatcagagaatgaaatgtatttgaattaaagatatgacaagtgagaatattctcaatgatgacaaatctggagtgtggccatgggagtgtgtgcctaacttgactggaggtaaaggagttcaaagaacttaagtcttgagagggggacctttaacatatggatattaaagtcactcaggatgctactggaacttaaaatatagggtaatactgtgaacaggctatcaaactccttaataaatgagaaagcaaggcacagtggctcaggcctgtaatccctgcactttgggaggctgaggcaggcagatctcttgagtccaggagttcaagaccatcctgggcaacatggtgaaaacttgtcttaagcaaaaaaaaaaaaaaaaaaaaaaaagagagagagagagagagagagagaaaaagtgacccttatttattaaaccagataggggtgaagccagatagtgatttggatgaacggtgtgaatctcagaagaatggaagttttatataagggtagaagaactgaatacctatctacaatatatcacacttttaggtagaagtgagaaaaaatcaaacccacctctcaattcccaactcattccattattatataattgcagggttgggcgtacatttagaccctaatgatatatgtattatatactgtaatgtgaataatggtaacaggaaaaaaatgccaaacatctcagcttgttgcattttattcatgagttatatgttagatgttcagattgtagaacttactattggtgggttgagatttctattactgtctttgtcttctgtttcatctttcagcagattataaggagatacagttaacataactatattatggatacatatatatttatgttttcttcattaatattgactctactagctcagaacttgaggcaattctgctgtcatactaaaatgtattttcatgctatccaagttaataaagttgtctgaatgtaattttgtttaagctggggcttgctttaatgtaatctaatatataaaaatttaccaaatacctaatctacactagcactgtctaatagaactttcttcagtgatgaaaatattgtatgtgtgcactgtccagcccgatagccactagccaaattagctattaaggacttgaaatgttgctagtgcagctgaagaacagaaattctaagtttaattagttttaatttgaacagccccatgtggctggtggcaaccatataggacggtacagagctcgacagtctagctatgcaacagaaaaattctcgttataaagaagattgtaaattttatgtgtaaaattctcaaaacaaatcactgttagctcataaagggttcacacctgtaataccaattactcaggaggttgaggtgggagtatcacttgaacccaggagtctgaggctgcagtgagctatgatcacaccaccacactacagcctgggtgacagtgagaccctgactcaaaataaataaatttttaaaattaaattaaaaaatgaataaatacataaataaatgtagagagacttccatttttggtcatgatagactaggttattctgacaaaattttttttaattgctcagtaagattttttttttaatcatttaaaaattagcaaagaactgacaaaataatgaaggggatgccaggaggtcaaattctatgagagaggggaacataaaaagataagtagagcatccaagcacctaaggtacttctgccctgatgatattgagaggaagagaaaagataaactgttccagtgttgtttctgaagtattacgaaagttgtccccggatctcctcccctgctcctcagcaaatttttttcaggttttcaaacatcacatgctctcagccataagtgggagctaagctatgaggatgcaaaggcataagaatgatgcaatggactttgagggcttgggggaaagggtggaaggggagtgagggataaaatactacacactgggtgcagtgtccgctgcagaatctcagaaatcatcactaaagaacttaggcatgtaaccaaacagcacctgttcaccaaaaacctattgaaataaaaaaattaaaattaaaaaaaaatttcttcaagttttatttgccaggaggtcactgtggccacccttaaagcagccattgacaaaaggaatgagattaccagaattggtttagattaatagtgatttgccctaaaatggggttagggtcacccctcctgagaggtagattcgtaagcaaaatatcgaacttctattagcaagaaagcagagagtaatggatagtgggtacgccacaggtgtctacctcagagctattttaatttctatctttactagtagaagtagtagccacagatgtagtggtagtagtaggagcaactgctgctgacatttactgagcactactatgtaccaaacatattattgtaatcatattctcttcccatactgagagaagttctcctccttcttgtcagtagtgagttggtttggtggagtattttatatttccattctttcaacataaatctagaaaaactatgataatataaagttttggtatagtttgctctgttacaaacttgcttctgcaacacaaattatcttctatttgattgttattttgtgatattaaataatatagcagtgggagtcaaacaacatcagcatagctgaggagcaaaggaaaattggactgcacatgatgaccgttcaccccacattctattttttgctcagtttggccacgtgcagcatcataggagcccttattatgtgtttctgcctgttcttcctacactggcctcctgtttctctaactcaacagtctcaactgataagctttccttattttttcaagtttttaaaaagataaaatcttacatttactccagtatttctttgctaggaatttgccatgtgtttaaaatattgtgctagcattttattagaattttttctttttgttttaatgccctgtctttgaatcgtctgcctctaacccaatttttcccatatgcctgctatttttagtgtgcaattttgcggaaagagatttttcatgaatgcgtgtgtcatattagagcagaagcgtctacattttaaaaatctattctaacagcttctattatataacctatggaatttaataataaatcataaaaggtgaggtgattggagttaagactgagtaatgtggccgggcgtggtggctcgctcctgtaatcccagcactttgggagtccaaggtgagcagatcacttgaggtcaggagttcgagaccagcctgggcaacatggtgaaaccccttctctacaaaaaatacaaaaattagctgggcatggtggtgcgtgcctgtagtcctagctacttgggaggctgaggtgggaggattgcttgagtgggaggatcacttgagcccaggaagcggaggttgcagtgagccgagatcgcatcactgcaccccaggctggatgacagagtgagatcctgtctcaaaaaaaaaaaaaaaaaaaaaaaaaaaaaaaaagattgaatattgtaagcaagactttagtattttccagttaacaaagaataggtgttactattggaacagtatggtattatgtctgtgttctttaaattaactttgatgctttttctaaatgtgtaatagtttaaatgttcttttttccagtgatgcccaggtgtctgttatgtgtgagccaccccaatttaaaggatttaaaagaatatacctttcttttatcaaaccagcttcctgccttagtatatattttacataatttaatactatgcatatcatgcatattgaatggtcttataaataagatttgaaagaaaactttccaactagttaaaattaatttgacagtcaaggactagataacaatccataagcgtttttggcttggtcatttgcgatcccaaaacttttcttgaaacttaattagaagtaatacagtgaataagttcaaatgatcctggaagaattttctaatcagtgctcaaaaaaataagataatgtcagatagccaaacaagctggagaacgagagttctttatttattgccatgaatctttgagacttgctgtgtgttttctaatgtatgctcaaagtgtaagttacaatagaaaatagaaaattggctgggtaccatggctcacagctgtaatcaatcccagcactttgggaggcggaggcgggtggatcgcttgagcccgggagtttgagacaagcctgggcaacatggcaagagaccatctctacaaaaaatacagaaagtagctgggcatgatggtgcatgcctgtagtcccagctacttgggaggctgaaatgggaggatcacctgagcccgggaggttgaggctacagtaagctgagaggctcactaccctccagcctgggtgacagagaccctgtctcaacaaataaaaaatagaaaaaaagaaacagaaaagaaaatagaaaatccagaatattaggctgattcaactgtgtttaatagattttacccgaattcctttaggaccttgcaacccagtctacatagcccatgtaatatagtagtcttgatcctctcatttctgtggttgagaagttggtgctatggattactgcatggttctcatggttttacatataataataataattgttattagttataactctctggttagagttgttagcttatagcactatattaaaatcaaaactaaaaaatataataaattagaagatcagaggaaaaggaaaataatataaatatatataatttaaaatatatataaaattgccaggcacaatggctcatgcctgtaatcccagcactttgggaggccaaggcaggtggatcatgaggtcaggagttcaagaccagcctggccaagatggtgggacaccgtctctactaaaaatacaaaaaattagccgggcgtggttgcgggcgcctgtgatcccagctactcgggaggctgaggcaacagagcgcgactccatctcaaaaaaagaaaaaaaaaagattggtcacaaattttgctccgagcggaattcctagtaacccaagtaaagagacaaatgttatcagttctaagattcataatgtcttgtggtcatgagaaaaggagatacatccgcaaccaaaaaggaatactttattattttgaagctttgatattcctcctatgtggatccctacactggtgaatcagattgaaacatacaaggcttataggactcttttttgcttaggttaatggagaaattaggacctagagtcaacataggccaagtagtcttaaaaagtagcaagcacaaaaacagtatatctgcagtttctttctaatgctgatttaatttctaccccaaacacttaagaggtatagaaatggtaggaagagaagagagctctttggtggaaagggaacagggttgccattaactcctatccctcttaacccgatttcaaagaaaagatccacagagatagaagaagcaacttatgaagacaaaactttcattctaagaatttaagaatagatcagaaaaggatgtcaagctgtaaaattgtcctgcccactctcaacagcaacataattagcctagatgccgaaggtattcagttactagactctgaggctgattagttgcatcaggatgtgttggatgggcagttggtttcctgcatcactgtttttcaccctagaaagtcttcaaaagcagctacacaaggaccctttctttgatatacacattatggtctccaggctggaataacaggtaaagacaatagctgcagtaggaacaaattaatacacttttcatcttgaagctactgagaaaccaggagcatttattaaagatatataggagaactggataaaatttggtccttctattaagccaggaactacaatagagtttttggcatcatgagctaatctaatagacatggccttctggaacctgggtttggagggcagaattttatggaactcataatgcttgagagttcattgactgacacagttctcgtttttgcacatagagataaatggttgattaggtcctgacagtttttataaatatgcaaaggtagaaactaacatgattttctggcagagccattatgaaaagtgaagaccccagatctgtgctcaatcttctgaaaaatgtttgcttaggagctgctcaaaaatatacttttaattattatgtatatggaatcttctttttactggcctaaagaacactgactactaatcaggcatttctgtttttctgaacaatttttcattcaaatgacctaaaactatcatgcagaatgttctaagaggatacaaattgatgtacatattgtaactattttaagtagcagaagttaaaggttagtgttgtgaatactagaaaacttactttttgtaaagagtaaaaatatggctatataaaggttataaaccaaatttcatatcaaagcctaaagaagaaatattagctactatgaaaaggacttttccatatttctaaaaggagtttcctggtgcttagttgttttccaaaaacaaaatgatctttgtatttttcttattccatattacttgtgatttggtgtttacttgataatatgattatgatagaacttctggtgaaacatataagctccactttggctgggatggaaaggcacattattcttgcatattaaacatttgatttcccttctttatgcataaaagctataaaaatatatggaggaaaagggttttccaggtcatctgtggtctgttctaagatttaagtataggttatgtagtacttgggtgtgttctcagtcagctctgctagaggagtatattattcagcaatttttttccttttcaatgcattgcctaagatcattaaacagtgtttttgctttggttgtggcagacaggaaaattatatatttggaagtaggattgtggtgaaaataaaagcatgcagttggaagttaaattaacttgagtgtgaatcctgactgtgacacatgttgctatttgaccttggcaaatcacctaacctctctaaatttctgttgactcttatataaataggctgtatgaaacttgcagagttgtttgacaattaaaagaagtaacatacataaaacatctagtgctattcctagtacctaactggtattcaatacctcatcaaatcttcaaatcacttttctgaagaggaaagacaagtatttttaaaaagaggaaactaaagcttagcaacaggctaatgctgtgaaagagatccagtaaagcatggaatttctatctagtgctcttaaaagagatgaagcccttgggaggtgggtgtggcaaggtaagcttttctgaaagaattgggtcaccttagacattgtcttacttccagtctaacctcaccagatagctagctgagaaccagatagctgagaacattctgaaactacacatcttgccctcagggagagttgcagggtaagtgaagacaaggtacagagttgatccattgatgaacagtgttataatcatgtcttaaattataattagaaaacaaatatgtgtcaaccactttattcttataaacatactttatatatgttactggtagaaggtatgcgagttaccagtggtgaattcctatgggtctgcagcaacctcaattcttgcctcctcagaagaaagaatacaactgaggggcataaggcagaaaaagagactgaggcaagtttcagagctggagcagaagtttatttagtttatttaaaaggctttagaacaggaaagaaaggaaacgatgcttggaagagactgcaccaaggtcaagtgcagtgtttaaccttcatcctagaacttaataggctggcccctttctcatgattcttcccttagggtgggctgcccacatatgcagtacactcctgcccttgggaggtgagcattcccaatgtgtttaggaagttgtacgcattttcatctgaagcttttcttcctttttctggtggagtgaccctggaaggtcatactccaccattttgtctcttaatgtgcatgcccaggaagttgcttctccccagcacgtgcattcagttaacactttagtgcaacaggtgtggaccatcaggaaatggcctctccctggcaccagctgccagtttatcacttttagagaggcaatataataattgccaaactgtcacctgacattcctagtgggtggaggagagccctttcctaccctgctcatgcctatctaactacctgtaacatacacacagacagacatgcgcgcacacacacacacacggcaaaaaacaggaacaatatcttggtaatctttcttaatatgaattttatggtgtatttatatatttatgatgtattgtatatatatttatggtatattgtatttattatgttttgagaaataaggactaggtttttagcacaaaatagagcttgtttgtttattttgtgctttaaaaatacttttaaaaattacaaagtaaaactttgtttcttaacctttttttggagacagtcaggctctgttgcccaggctggagtgcagtggtatgatctggactcactgcaacctctgccacccaggctcaagcaatcctctcacctcaacctcccaagtagctggaactacaggcatgcaccaccataatttttgtattttttgtagggttttgccatgttgtccaggctggtctcaaactcctgaactcgagcgatccaccctgccttggcttctcaaagtgctgggattacaggagtgagccattatgcctgacctgttttttaatgtgtttataagctcagggaaagagttttgctgtaggtagatggcattttaattaaattcagactatttaaggcatatacaagtaactttaatttttaaaacctgcatagaagattatagtatcaagcatgacactacattcaagtttgtctggacaatgtgggttatctgcccttgttttcttttgctttaaaagtaaatatatagtgaaaaaaaatcagaaactatttgggagaaaaaagagaagaaagttgaataaaaactgaggttgagatgcttcactacaggcattgaccactaaatttaactgtatttgaatgccctagtatgaattactttatcagtactatctgataactagggagtcaggaaatttgtttgcaacttttaaaagagggtatagaagcaaggcttttgttagcgcatatggtacctttgtgtaatttataaaaagatgcccatctgggtgaacacataaaaatgtatcctttcacagtgccttgtcaagtgcatgacttgctaagcatggcaggggttggatttcaaactccctcaacaaacagggggcaatctactaagaatatgttgttttcctgtagaggaagaagaaaatgaaattttggaagtgttgaaggttgatctagtgtaacagggatgacgcaagagtgaatttggtatgaaagcaaaaggaagaagcagaaggtgcaaaaggagtagagaaaggaagcagatgaacagaagaccagttttgctcagtttgcaattttccctgaggccataggagtcattctatccttccagcctgcatatcttcctttagaggaggagaggaaaggaaagggaaagggacaaaggcgttttcattcttggctgtcttatcatattaccaataagaaatgatacatcattttcagaattttcctcattttcaagacattttgatgtgtatttctcttgaaggtaagagttttgggggtatattttgcaaatgaaaaaaaggcacaaaaaggattggggacttgccaacgtcaccctattctttgggacaaaaccaggattagaaccccagtaatagaaatgccactaaaaagtttgtaagcagaagctagatttctttctgtagcaacttttaggcctcaatgaattattcctttttttagatttgtctaccagtacaaagtattgagtttagtcagaaggagatacttctaaacaagatagttggaagactattgttaacttatacagatctctgggaaagagagtggtgataaagatgctattattaatttatttctttgaaaatactaagatctaaagatgctgagacctgcagctttgctctccagatttatgtggggccctgctagtttgttttttaaaggagaagacgcttggtgagtgttagcactagaaggctgaaaatctgtcaggcttttactttaaatatctgttgcttatgcccactgctttctgttatggtttctgcatagtgtcagcatttattatccttaagtaatttaaaaagcattattctttaaaccctctactattcctaaacaaaacaaaaatgtgttttacgtaatttttccttaaggaattcctctttcactctcattttttcaaaccagcatatataattccaactgagtctatttttaatcaacgcaaattcagagcattccctgatggaatgaaatcaggaaagcagaatattggctgatgtattctagaaacaatggcgtggaatcaagtccccaagtctacttcaattccctgaagcctttccattctctatactattctgtgaacaccctgaatacactcctgcctcagggcctttggatttactgtgttctggaagattcttttcacagatatgtacataaatcattccttcagttccttttcactctccacttgaatgccaccttatcagagaggatttctttgatcatactgtttaaaaaaacttccctcccacctcactgtcaatctccttatcttgctttatttttcttctttctcatctccaactagagtaaactccacgaaagcagaactctaatctatttgggttttgtttttctgtaaccctgcagcctagattatatctgccagctattaagcattgtattaatacttgctaaaatgagaagatacttaaggcctgtccttgctgccttgttttaagaggactaacagtaagttatgatgtgcccgtaggaaagccatcaaggtccagatacctttcagtttagggtaagatttgttcagtgtggatccagaagaaaggagaaggataattgggttataggacagcaggttttgactgaaagtaaggaagaacctgcgaataattgcagctgtttgaaaagtgtttgatctttttttctgtagatgtttatatagattgtatgaccgctttggagataattatagaggaaatccaagcatcttatgcaaattagattatgtcacttctaacctgaattcttaaaaggtatgattctatattgactgagaaattaataattgagtttggttctgtgaaatgctgccaaacaaatatatctatattatgttaacaccctataccggggttgacaaattgtacctctcaggccaaatcttattggttaactctttttgtaagtatttttattggaacacaaccatggccatttatttacatattgtctgtggcttctctcacactataatgcacagttgagtagttgcaacagagacacatggcctgcaaagcctaaaatatttactatgtggacctttagaggtaaagtttgacaacttctgccctaaagcgaaaaaatattatgtggaaacctatctttattcagttttccaagtagttcatgatgatgatgatgatgataactgttgtatcaattaaaatttagctataatataatagaccactctgactattaaaatagagggaatttaatgcaggaaattgattacatggatgatgagagtctgactagttccttccaggaagatacataagaggtagttttgtcagagcccagaggctagaatcacacagcagaagctggaatcatagggtagaagggtagggaggatggaactgttacctgaagatggagctacaaaaaagattcttcttctgcctgagttgctgcccaaggcacagaggaaaggagaaaaataccctggcttctccaactagtgcctcccattacctgaacccaaccataagtcagctgacaaaaaagcctgggaagtggagctttcagggtttgttcccctaaaatatagagcagagtagaagagtaaggaatgagtgtaaggacacctgcgtagctgctaataattattaagtgctaccttaggccaggtacagagctaaacagtttgtgtgaatatgttgcctaggaagtaaatacgagtattacccccagtttatagatgaggcttagacaagtaaatttctcaaggccgtgaattaaattaatgaccaaattagacataatccaggtctgccttactccgaaactcttgcttttatccctctcattttacaagtgagaaaaaacgtaatttggaaagataagaaagttgcatctggttaatgacagggccaagtctagaacccaaattgttcctattaggtttttgtacattttaaggaagctaaaacctgtaatgctattattgtagcatttggagagtgtccagaggagactcccacacttatcgtgaaagtatccttgtacgctgaaactattactaagcaacctttctgtaccccagtttacttcattgtaaaatgagattattaattatatctacctcaaaagagtgttgagaaggagtatatagataatatatctaaagatcccggaacagtgtgccacataataagtacttagtaaatactagctcgctattgttattgttaatctttttattatgctcaccctgagagtggttatcacaggaaaaaagtggatcaaaaatgtcatgaaatgttatcaagtgcttcattaaatagtaatatccccatattggacattttatttttcttccatttaggagaattgttagaagatactgaaaaattgcatttttgtttcgtttgcctttaagcgaacggccttcatgatgtcttagttttttaattcaaggtctttttaatgtaccagtgcttatgcatgtgaaatatcatttcctcttatgcttctatatagttcatctctttcatctagcttggcctttttccaaccattcccaatatgtgaacttttccttcctattcccatggcttttcttggcttcattcttaatagtctcccactccctgacgagtcctttttctttcttaactagaacaatttctataatactttggtacctgctgaagatgtttttcttaactgatatatccctagctaatcataggacacatttatatttcacttgtatccagcacatatagacaatctgtaacatgctgtcatatgctatatatattgcttgagatggttcttttttcatggtcgtttttccatttgtgtcttgtttttccaacaaagttgaaagccatgcttggatgaactttaggtgactggtgctttataaatacttaagtgctgtgtgaaaacttatagctagagttcaaattatttgtttgttttttttgtttgtttttgaaatcgttatttgcttttaaaagtagtctgctgcatgacaaaagtcactaacaactttagtccttgtgtgggattcactaaaaatagcttgaaaagtcaaggattcctttaacctagagcactctgaagatccaaagattagcagaccaggaaaaaaaagaccctgaaaacatatccttccagcctgatacacctactagcctatggtaaatatttttcattttttttaaaggcaagcaagaaggtaatttaacaagattaatcactagatttggcattggaatgtcatattttaatgtgctaaaaacattttaaaatgcagggctcataacagagtgtgaacctgctgccactattttcagaatctgaggctttggacttgatgtggtgaaaattgaaccgtattatatacgaagtaatgatgaccatgcaaatatttgcacattgtggtctattgttactgcatattcttcaaagtgaccatttacaatgtactgtcctcagaaaactatataaagcaaacacagagatctaagggagggtagtaaaaagcctcaaaacaatctctgagtgtgcctgtaacatacttgttatttattcccaattcagaattttctctagtgacatattctttttttccatattttaggagaatattttctgtcagtctttcaaaatcaatatttttagtttttaagtactacagctgttgaacttcacaagataagtcaaattaagtcacatcactcaaacactatgagctttataattctttgtgaacttaaaggttgagtttaggatgaccctgtggtatatagaatctagagctagctggattggcaggatttttctctttaaaaaacttcagaagcatttctgaatagaaggaacatttccaacttttaaaaacagataatccttttttcaccctcttaacatccctctccacacctcaaacaaatgtacatgttttgggccattttgtattttattttctgtgatgttaataaattaaatgtaaatcataataagtccaaatccctttaatttcaagatgtttatacttgaggtctagcattttgcctactttattcctcatttaaagtatggtttttgtcaaggctaaacagtaaatagctatagtagtaggagtccaaaccacaattaatagtgctgaatgttgttacaaacctgcttcttgattttttaaaataaagatcagggagtagctatggcaactggacctcaaaaactgttaacacaaaggattttgtgttttaatttcttcatctaggttttatgtgtctttataaggagatacctgatggactacaaagaggattatgacatgtatccaactgtaaatttatagggaaattgtgtaacgctttgtttaaattacttcagttatatcttctatagttaagattataattcacacacttcaatctgaatacggattgtaaaacagtaaagcaaatgccagaattatagccacagaataaggtagtgagttaatttgatggagttcattttagggacattgtcccttgcttttggtattttccaacaatggtaccatttatgattttattttattttagccatgccctttgggttcccgagattttcgagagaaacagtgtgcagactttgacaatatgcctttccgaggaaagtattataactggaaaccctatactggaggtaatgtataacctgacagagcattcatgcttgagcactttgcaaatatcaaagaatatacaaatatatacaaacacatgcatacattcatgtacatactagttaaaattagtgtttgccaacaaaagcagggaaatgcttatagtactataaaggcttcatggtttatttgccctgtaataaggtttatatattagtacaaatgatcagaaatcatttcttaaaacctaattatgtttaacaaggtataaaattccttgaaaggatatctagacatcaaaaccatgtagtattttttgagttctgcttgaggcttccttagggtatatgtaagttacattataatctttaaatgtttgcaattatcaccctaaaacaagttataagaatataaatcaggaaactctgtgtcgttgcttagtcaaaggccaagattattgttattctttttcagagttagaaaacatttttgctctttaatttgggcatgtatcaggcactgattgttcaataagtagaagtattttacactcccaaaatataaattacattttgctgaaaatttctcttggaggccaggcatagtggcttattcctgtaatcccagcactttgggaggccgaggcaggtggatcacctgaggtcaggagttcgagactagcctggccagcatggcaaaacaccgtctctactaaaaatacaaaaattagccgggcatggtggcatgtgcctgtagtcccagctacttgggagactaaggcaggagaatcacttgaacccaggaggcggaggttgcagagagccaagatcacgccactgcactccaacctaggcgacagagtgagactccatctcaaaaaaaaaaaaaaaaaaaaaggaaatatactcttaagataagtttactgtttgcttgcttttccagtatcttatattaacagaattttatagtgacaactttatatttaccaccaagattctaccattaacgttttactatactttcttcatacatgtctgttcttctccctatccatttattaatccatcgtactttttgatgtatttcaaagtaaattgcagtcattaatgtactttcctctaagtacttcagcatggtaacattatccacagttcaattatttgtttacttttttctgttaaggcaagattatgtacagtgacatgcaaaattttaactatgctttctctggtttttgaccaatgcacatacttaaaaaatcctattgagatacagaacattggctttacctccaaaattcctctaatctttgccttagtcagtttggactgtaattacaagttaccatagactggagatcttaaaatagaaatttatttctcggtactgggggctggaaatccaagatcaaagtgtcagcatggttagagtctggtgagggccctcttctgggttgtgaactgttgttttctcattgtatcctcatgtggcagaaagcgtggggaaaagagctctctgggatccttcttataaggctactattcccattcggagggctccactgtcatgacctagttaccttccaaaggcctcatcttcaaattggggattaagatttcaacatacgggttttggggggacacaaacattcagtccataaaagtcattatagtcctttgcagtcaatagttgcctctccctactcctcctaagagacaaccatcattctgactttttttctcaccatagtttagttttgcctgttccagaacttcatattctattgtaaatcttctttaagcctaatgtttttgagatctatctacattgctgtatatagaagtggttcactctagccaagcgcagtagcagacacctgtaagcccagctacttgggaggctgaggcgggagaatcacttgggtctaggagttctcttaaaaaaaaaaaagtttattcttttttattgctgagcagtattccatcataataaccagtttttccattctgctgtgatggacacctgggttgtttctagtttttagctgttatgagtaaactgctatgaacatttgtgtactatcattttgtgagcatatgttttcattttccttgagtaaatacttaggagtagaattgctgggcaatagattacatgtgaatttagtttagttttaaaagaaactgccagatgtttttccaaagtgattgtagcgtatttcactctcaccgacaatgtctgagggttctatttgttgtgcatccttgtcaatatttggtcttttcagtcttcttctggtgggagtagagtggtatttcagtgaaatttccgtttccattttctcatgataatgttaagcacgttttcatatatttattggccattatatatctccttttgtactgtctattcaaatcttttgcctatttttaattgggttgttttaccttctcaagtggtagtcatttataagttttacaaatgttttgtcacattctgtggctttcccattgctttttaaatggtgtttttatccatataagcttttaatttttctgtttttaattccaatttttaaataatttttctttctggtcattgtgttttgtgtcctaaggaatctttgcctacctcaacttaagaaaatattttcatatgttttcttccaaaagtcttattgtttagtccttacatttacatctatgatctatctcaaaataatttttggtatgatttgtatctgtagtatatttatggattttctgttttgttttgttgatctgtcagtcctgtgccagtactacactgacttgattactataactagagtatagtcatgaacacagttttttttttttttatacattaagttctagggtgcatgtgcacaatgtacaggtttgttacatatgtatacgtgtgccatgttggtgtgctgcacccattgactcgccatttacattaggtatatctcctaatgctatctctcccccctccccctaccccacaacagtctccggtgtgtgatgttcccctccctgtgtccaagtgttctcattgttcaattcccacctatgagtgagaatatgcgggaacacaggtagtttaagttccattaactttgatgttttttataagagttcttccaatatgctaactgatttgcattttcatgtaaatttttgcatcagttgttaatgtccgcagaaaaacctgctggacttatgaatggtgttatgttgaatctatagatcaattgagggaaaaactgagtattaaaccctattgaattttacaatttttgaacatggtatatccctcaatttatttatgtctttaatttctcccagctatgtttttcctttaagtgtaaggtcctgcatgtactttactaaatcgattcctgagtgatttatggttttgacactattgttaataaaacttttgaaaattccattgacatttgtatattaactttgtattctgtgacctttctaaattcccatattcctttttttttttttgagacagggtctggttctgttgtccaggctggagagcagtggcgcaatctcggctcactgaaacctccacctcctgggctcaagcgatccttccacctcagcctcctgagtagctgagactacaggcgcacactgtcatgtccagctagttgtattttttgtagacacagggtttcaccatgttgcccaggttggtctccaactcctggactcaagtgatccacatgactcgacctcccaaagtgttggaattacacatccagcctaaattcccatattctaattgttttacagatgctcagaatttttttgttaaacagtcatgttgtcctgaaatagagacaatctatttgaatctttatgccttttattacattttcttgccttaatgcactggattgggcctagagtataatttgtacatgtattgattgtattttttattctttatcctattaatatgctgagtgacctgatagatttgacaatctcaaaccaagatttttttttttttgagagagagtcttgctctgttgccaaggctggagtgcagtggtgtgatcacagcacactgcagcctcaacctcctgggctcaagcatcctcccacctcagcctcctgagtagctgggactgcaggtgtgtgccaccatgcctggctaatttttgtattttttgtagagatggggttttgtcatgttgcccaggctggtctccaatgcctggggtcaagcaatccacccatctcagcctcccaaagtgctgggattacaggcgtgagccaacaggcccaacctcaaaccaagcttatatttctaggataaaccccatgtgatcatgatgtatttttttatgtgttattgtatttaacttaattgataatgttttattgtggatatttgcatctgtgtttaaatttgtaaatatttttcttgtaatttgtaaatattcttcttatgatgtctttgctaagttttggtatcagatgcattctggtttcccaaaatagaatctttatttatttttaaaagaattttaggattggtgttatctcttccttagaatagatttcactagtaaaaccagccaggcttgatattttctttgtgaaaacctgttattaaaaatttaactcccttaagagaaaagggctatatggttgttttattttattttattttcttgtggagttttcttttttttttttttttttgagacaaggtctccctctgtcgcccaggctgcactgcagtggcccaatcatatctcactgcaggctcaatctcctgagctcaagagatcctccctcctcagcctcctgagtagctaggcaccacgctgggcaaattaatttttaatttttatttttattagagactacatcttcctatgttgtctaggctgttctcaaactcctaagctcaagggattcttcaatctcagcctgccaaagtactgggattataggtgtgagccaccatgcctggccttatttcagttttttattttgtgtctttaagaaatttatgttatatccatgtggtccagtttattgacataaaattgatcataacattctcttgttatgccgtttaatattaatatttataaaatatgtagtgatgtatgctttcatttctggtattgataatttgtgttttcactgtttttcttggtcagtcttgtttgggatttatcaattttattaatattttcaaagaaccaaattttggctttggtactcttttctgtaatttgtcttttttctagcttattaatttttgctcttatagttattattttcttatctattttcagtttctttcgctcttttacatttccaaaatttgatgttatattttatagcttttagttcaaactattttatttacattgtgagttctttgacctctgggttacttagaactgttttgttttaatttccaaatatttgaaattttctagaatttcttgttgttcatatataatttaattgcattaagattagagaatgggccaggtgtggtggctcatgcctgtaatctcagcactttgggaggccaagttgggaggatttcctgagcccaggagttggagaccaccctgggcaacatagtgagaccttgtctatacgaaaaataaaaaattagctgggtgtggtaccacatgcctgtagtctcagctactcaggaggttgaggtgggaggatcacttgagctcgagaagtggaggctacagtgagctatgatcacaccactgtagagtgagatcctgtcttagaaaaaaagaaagaaaaagattagagaatactcttttcttggtgaatgttctgtgtatacttggaaagtaatgttttctgcagttattggctacatagtgttctatagatatctatgagatcaacttggttgagaatgttgttttcaatcttttatattctttctgatttttttctactctcattctatcaattattgagagtgctgtgttaaaatctccaactattatatggctttgctttcatttttaaaaagattttgcttcatgtatttgaatcttttttattaggtgcatatacctttgggattgttttgccatagtataggagaagaagaagtgtctgaaataatttacagacttaataattgccatctacataatttcatgcaaagtgaattaatcctaaattcatactaagcattaacttaaggtaattggttaatatgacctttcatttagaaaatcattttaaattctttctggaattaacaactgtattagtcagggttctctagagggacagaactgatggaatatatataaagggaagtttattaagtattagttcacacgatcacaaggtcccacaataggccatctacaggctgaggagcaaggagagccagtctgagtttcaaaattgaagaatttggagtcaaatgttcgagggcaggaagcatccagcatgggagaaagatagtctgggaggctaggccagtctctcttttcacatttttctgcctgcttatattctagcctagctagcagctgattagattgtgcccaaccagattaagggtgggtctgcctttcccaggccactgactcaaatgttaatctcctttagcaataccctcacagacacgcccaggatctacactttgtatccttcaatccaatcaagttgacactctgtattaaccatcacaacagccttacctttctttccccagtttcactgagatataattgacaaataaaaattgtatatagttaaggtgtacaatgtaatgttttgatatacatatatgctgtgaaatgattaccataatcaagctaattaatgtatccgtcacctcacatatttaccttttttgtgtgtatgatgtgaatacctaagatctactctcttaacaaatttaaagtatactatacattattcttaactatactatattagatctctagaactgatccctcttataactgaaagcttgtaccctttgagcaacatctccctatttccacccaatccctgataagctctctctgtttctatgagtttgacttttttagattccacatataagtgagatcatacagtatttgtatctggcttatttcacttagcattatgtgccccaggatttctttatttctttcttatttaagatggaatgatatttcattacatatgtctatataaaacaattttcttatccattcatctgttgacagacacttgggttgtttccatatcttgactaatgtgaataatgcttcaatgaacatgggagtgtaggtatctcttcaagatagtgatttcatgtcctttggatatatacccagaagtgggattgctggatcatatggttattctatttttaatttttggagaaggctgcatactgttttccataatggcactgccagtttacattcccaccaataatgtatataagagttttcttttctccacatccttacctacacttgtgatcttgtgacttttttgtaatagccatcctaacatgtgtgaggtaatatctcatggtggtttttatttgcatttccctgatgattagtgattttgcacaccttttcatgtacctgttgccatttgtatctcttctttgggaaaaaaaaaagtctattcacattatttgcctattttttaattagattttttttttttttactattgagttgtatgagttccttatatgttttgggtattttctcctattctgtggattgccttttcattttgttgattgtttcctttgctgtccagaaactttttagtttgacatagtctcgcttgtttattttggcattttttgtctgtgcttttggtgtcatatccaaaaaatcgttgccaagaccattgtgctggagctttgcccttatgttttcttctagtagtcttacgtttaattctttaatcccatttcagttgatttttgtgtatggtataagtatccaatttctttttctttctttattctttttttttttttttgcacgtgaccatctattttccccagcatcacttattgaagagactgccctctcctcactctattttcttggtacctttgtcaaagattagttgactatatatgcatgggcttattttcaggcttaatatttgtcccattgctctacttatctgttttaataaagtactatactgttctgattgctacaggttagtaatatagttcaaaatcaggaagtgtgatgcctctagttttgttgttcttgctcaagattgctgtggctatctggagtcctttttagtttcatatgaattttaggattgctttttctatttttgtgaaaaacgtcattggaattttcatagagattgcatcaaatccatggatcactttgggaagtatggacattttgacaatattgatctttccaatccatgaacacgtgacatctttccattatttgtgtcttcttcaatttttttcatcagtgttatacctaagtatttttaggctattgtaaataagattgttttcttaatttctatcttatgtaattaattgttagtgtatagaaatggactgatttttgtatgttgatttttgtatccgtatttactgaatttttgtattagttttaacagttttttggtggagcctttagggttttctatgtataagaatatgttgtcagcaaacagagacaatttttcttcttccattccatcttgcatgccttttatttctttttcttgcttacttcctgtgactaggacttcagtactatgttgaatagaagtagtgagaatgggcatcgttaccttgttcctgatcttagaggaaaaaatgtcagcctttcatcactgagtatgatgttagctgtgggcttgttgtatgggacatttattgtgttgaggtatattctttctgtacttaatttttataatgaaaacatgttgaattttgtcagatgctgtttttgcatctattgcaatgatcatttggattttgtccttcattttgttaatatggtgtattacagtgcctgatttgtgtatgttgaaccatccttgcatcctcaggataaaccctacttgatcatgatgaatgatccttttaatttttgccatttaattaatttgctagtattttgttgaaaacttttgcatccatgttcatcagggatattggcttataattttcttttctgttagtatctttgtctggcttgttattagggtaatgctgccctcataaaatgtatttggagtattcccttctctgcaatgtttttgaaaaagtgtgagaaaaattggtattaattcttctttaaatgtttggtataattcactggtgaagtataaggtatcgcacttttatttgatgagaggttttttttttttttactgtttcaacctctcttcttattattgttctgttcagattttctatttgttcatgattcagtctttgttttatgtctctagaactttattcatttcttctagtttatctaacttgttgacatataagtgttcatagcagtctcatggtcctttgcatttctgtggtgtctgttgtaatgtctcctcttccatttctgatttttatttgaggcttttctctttctctcctagtatagctaaaggtatgtcaattttgtttatcttaaaaaaaatcaactcaattttgtttatcttttcaatttattttattttctctatctatttctgccctgagctttgttatttccttccttcttctaactttggggttaggttgttcttccttttctagttccttgagatgtaaagttaagttgtttgaaatctttctccttttttcatgttagacatttattgctataatcctttttccttgaagtgcatctccagcatctcataagttttggaatgctgtgtttctatttttatttgtcataaggtttcttgttggtttgttttgttgttgttgtttgtttgtttgtttttcagacagaatctcatttagtcatccaggctggagggcagtggtgcaatcttggctgactgcaacctccacttcccagggtcaagtgattctcctgcctcagcctcccgagtagctgggattacagacatgtaccaccatgaccagctaactttttgtagttttagtagagactaggtttcaacatgttggcctggctggtctcgaactcctgacctcaagtgatccacctacctcagcctcccaaagtggtgagattacaggtgtgagccactgcacctggccacaggtcataagatacttttagatttaattttttatttcttctttggcccattgatggttcaggagcatgttctttaatttccacatatttgtgaattttccagttttctttttgtaactgatttgtagttttataccattgtggtcagaaaaatacttgatatgatttcaatcttaaatgtgttaagacttgttttgtggcctaacatgtatgtatcttggaaaattttctgtgtgggcttgaaaagacagtatgttttgatgcttctggatggaattttttgtatgtctatttattctatttgctctaaagtataattcaagtgcatctttttcttattggtaccctgtctggatgatctatccattgttgaaagtagactactgaagtatcttcctattgaattgctttctatttctctcattgtattttaatattgctttatatatttaggtattccaatgttgggtgcatatttacaatggtaaattgtactgaattcatgaattgactcctttatcattatataatgactttctttgtctcttattacagtttttgactaatagcctattttgtctgatataagtatagctctcccagctctcttttggtttctgtttccatggaatatattttcccatcacttaacttttagactatgtgtgttattaaatctgaagtgagtcacttgtaggcaatatagagttgtcttgtttttttttaaaaaaaattcattttgtttttcattgtagaatttaatccatttacatttaaagtaattatttttcaataattacttactagttatatcttgtcaattgtttttggcagttttgtagactttttttgttcctttatttttctttgctgtcttcctttgtaatttgatgattttctgtagtagtatgctttgatttcatatatatatgtattttatatatatttcatatatatgtattatatatatttcatatatatgtattatatatatatttatacatatgtattatatatatatttcatacatatgtgttatatatatatttcatacatatgtgttatatatatatttcatacatatgtgttatatatatatttcatacatatgtgttatatatatttcatacatatgtgttatatatatttcatacatatgtgttatatatatttcatacatatgtgttatatatatttcatacatatgtgttatatatatttcatatatatcatgtattatatatttcatatatatcatgtattatatatatttcatatatatcatgtattatatatatttcatatatatcatgtattatatatatttcatatatatcatgtattatatatatttcatatatatcatgtattatatatatttcatatatatcatgtattatatatatttcatatatatcatgtattatatatatttcatatatatcatgtattatatatatttcatatataatgtattatatatatttcatatatataatgtattatatatatttcatatatatatatatatatatatatgctttaggtattttgctttgtgattaccatgaggcttatataaaaatctatagttataatagtctgttttaagctattagcaacttaccttcaatcatatacaaaaatttgacacttttactcttctattttatatttttcatgttacagtctacatctttttatatcgtagtccattcacaaattagtgtagctatcagcctcttctggccagcagggattctgctgagaaatctgctgatagacctatggagttcccttgtatgttatgaatcttttttctcttgccttcaaaattctttgtccttgatttttgacagtttaattataatgtgtgtgtgaagtcttcattgggttcagccttattagagatctttgagcttcatgtatttgaatgtccatattgctctctagatttgggaatttttcagccattatttctttaaataagcctattccactttcttttccacctaagattcctataatgtgaaaatgtagttatcttggtgatgtcccataaatcctttttgttcttttttgcctgactggagatttttaaatgacccctcttcaagttcataaattctttcttctgctggatcaagtctactgttgatgctattacatttttcattttattcattgttttctttacctccagaatctgtttttattaatgatttctatctattgaacttctcactttgttcatgtattgtttttctgatttcattaagttgtctgtgttctcttatagctccctcaccttccttaaaacaattattttggattctttttcatgccattcatagagctccatgtctttggggttggttattggaatattaccatgtttctttggtggtatcatgttttcttgatttttcttctggtttcttgaagtactgtgttgctgtctttgcatgtggagaacgcagtctttactaactggcttccagagaaaaatgtctttaccaaacagcccagttaaagattctgaggctctctcagaccttttctatggatgtccctactccacacctcttattctctcttggggaggaattcttaagaatgtatccctctctgaattccacaaagctggaccaggtgctgagagctgcctgtttgttttttctagggtggttccctaaatgctcaagttgtatgacttctcccaatcctgcaaagttgtgttggctgtctgcataaaatgcttactttcagtccataggagcatgcttgggctgctggcctacagcagttgggggagaatggggcatgcagagtttttgaggcaactgttgactagttatgaggtggcccataggcaaaacatctcaaatggctcatgagttggcttcccaacagagtccatggagtggttacttgggcctatggcctctcttctctgctcccagcctcttccaaccactcagccatgctgatcacctcagtattctggatgaggcaagaaaacagtaggactcttgggcagcgtcccacacagctagggaagcttggtgcttactctctatactctcactttcccctgtgggagaatcaaaggctggggagggtggcagggagtctctcttttcactgagctgtgctgccttgagggaggtgtgatacaggtgaaattaaactggtcttaaacctcttcgatttgtctgtttggggaatttttttttttctccaatggcatgctggaacttttctgctggagtcccataaaggtacacttgtctataagtagctgtcaaaattgatccttctgcagggagatgatagtagaaagctcctcttccaccatcttgctgatgtcactctagtggtaccttttctgaaagctcattgtatcagaagaagctgaacacatcttcagcagtaaacaagaaacttattcccattttcatcacttagtatagtgggctaaggaatataaccatagtatttatatgtcctgcctatcaaatattacgttgcataattaatgttaaaattgaataaacagaagactcagcttctctttttaaagcctaatgcacaaaatgctatattaaattccaaagcattatgataaaaaaatgagagaagaactgtattgggtaataatgaaaaaatttccagtaagattcatggacattttgggtaatttaattcatgagaatcatataaaaataaatacaagtagttttattatcagtttgggaagaaattattttatttattacttgttatttctatgctcagtatggcaaaattaatcattaacctaacgctaaaaatcacattataagttagatagaagttctatagcctagaaacattgaaaatggaagaaaacatagactcaggccagaggtcgtaagttggcaatttagggaccaatttttatctacatacatattttagcctcccacagtattttttgtaacaaaactttgaatcaattgttacatttaaaaacaagaagagtttagatggaaaaaaaaattaagttttcatcttctcttgaaaaaacagactgacaatattggactatcttcttgcataacaacattcaactgtagcagtcatctcctatactggaatgtgctgtctctaatttatcattgactctaccacccagtcgattttctttttctttgcttaccgtcaacctgcagaaacatgatttctaagaacttcactgagatgtagccatgtcatttcatctttctgctttatttcctttattagaagtagtcttctttatttcaaatagaagttttagcagcataattagatatggtcaaagtgatgaagtagaattacaaaagaaaatattttaagtcatgatttcagtcaataattacatacttacaaatagtagctttatcttgtgctgcttttaatacaacaagtccacatttattgctatttttccaatatactgtagttatgatatgtactctgttttttaaaattgcagttacctaagcctatttttaacttcagccttaaaaaacacaaatttcaatgacaaaatgaaaatgctcaaattgctgtgtgtatttattcacaaacaaaattagtgttttaattattcaaatataatactatattttatatttatccttggctaatttcataagaattaatcaaatttaaagctataattaattttagttttgatttgctaatctcataaaaatttatatccatgctaaagccaagttcacagactatgatatgcttaaggcaggtacaaatttagttttattttataactaccatatccttgcttgatgtggcagagtttttgtatcagcttcagtaacatatgtagcagaaacttctgtttgttagacaaggttattttattttcttaggtttttttaaaaaattgtttttcttggccaggcacggtggctcacgcctgtaatcccagcactttgggaggccaaagcaggtggatcacctgaggtcaggagttcaaggccagcctgactaacatggtgaaaccctgtctctactaaaaatacaaaaattagatgggcatagtggcaggtgcctgtaatcccagctactcaggaggctgaggcaggagaatctctactcaggaggcagaggttgcagtgagctgacatggcaccattgcactccaggctgggtgacagagcaagactccatctcaaaaaaaaaattgtttttctttcatttatttttttaaaaaacattcaattaccttcactatgatccctttttaccaaaattgtaaatatataatggaatatagaaatataaaatacattataaatatataattatgttataaataaataatggaaatacctgaaatttttaaacctgaaaactgctgagcaagtccccctttaagttgcaccaccaattaaaataaaggtgaaattttagaaaagggggaaagaaacctacacaatcaggcatataagcagggaatgatgtctacgtgaattataaatttgccatagataatactgaatcactgttcattaggacaaccactccacttatttctcttctactgtatttgtccaggtggggtaaaaccttgtgcattaaactgcttggctgaaggttataatttctacactgaacgtgctcctgcggtgatcgatgggacccagtgcaatgcggattcactggatatctgcatcaatggagaatgcaaggttgctcagattttactcctttctgttggggtttttgagacttttatctttttctcattaactcctatttaatactatgtttaattttttaaaaaaaggggaccacattttagagaaattcaatttccattaagagtaataaaatatgtaaaggtaaaatgacccattcatattcaagcaccatacaaatgtactttattctggtattctagttatttttacagtgattgccagaagtatgaaaatattttggattttaatttccgttattcttctgttctgtttacaaacaagatgatagaaaaagagagagaatgaggattcagctcttattcatatttctaccatatgttctttttggaagattatttgatacatttcatagcataaattttcctcaaagtgtgaaacagccatgctcctcctactttatctccttttgaagcatttacaatggttttcattgtggaattagtctttatcttattaaagcatttactttagggaattagtcagactagttgggaattgtaggagcaaatccatgctattttcctagacctgtgtatgattgtaacataataagaaaagccacaaaaaccactattttcataaatttttttacttgtctggttttgttttactttaaagagaaggacaaattaagtgcttcaaactgagaaagacaagataaaaagcaccattttacttagtctcataatttcttggaaaagtttctatccttctggctacttgtctgcaaatatatctgatgattcagtttgtgtatgatatttgtgtgtgtttatgtatctgtgggcaaggggtagtttattttcttgaagaaaaagttatttttgtagtagtattcaagtttttcaaataacaaagacccaagtatggtttttattcacggattaccttatttttcttttctttactggaaaaacaagcaaataaataagttatatgtatttcattagttatgattccaagaatttctctcttgacacactgaatattcctctctgttttcagcacgtaggctgtgataatattttgggatctgatgctagggaagatagatgtcgagtctgtggaggggacggaagcacatgtgatgccattgaagggttcttcaatgattcactgcccaggggaggtgagtatgtagagagaactcttcctcacacctctggtgtacttggaggagccaaaaccctcgcttcgcctccccctgtttttcagatttctttatttaggcagacaatgttttcttccccaaattgctttcagtcattttagtgttaaatgtggcttcaagtaaaatattttaaggaaatattctctctctctacttaacttcatttagccatgtttcttaaaggtgtacattctcacagaggattgatatgaggggcatgtgctgaggaagaaaaggaaccattattcgtgttgaggcttttaaaatatcttgagataattttagagaaaaagactgttaaatactgtttctctaaaatgtattcatgaacccaaagggtaatttgcccatatttcataattcataaaatgcaaagtcaaagagagaatggaataataaggaaactattactattgaatggttaccaaatactcatttcctgaccaaggctgcttaatactggctatcttctgtgttccaggctacatggaagtggtgcagataccaagaggctctgttcacattgaagttagagaagttgccatgtcaaagaactatattggtatgttagactggtatgctagtttgctggattttaaaagtaaatgaggaaaagtagcacagtatcatgaaggaaaaggcatgcttctttgaggtagatcactttcatgctaaaatgaagtaagctctaagttttatagaacacatatacaatgctaaagagaaaaattagagtttatagcttactcttcaccgggttattttatatatttaaaaaatcaggccaggcgctgtggctcacacctgtaatcccagcactttgggaggccgaggcgggtggatcacaaggtcaggagatcgagaccatcttggctaacacagtgaaaccccatctctaataaaaatacagaaaaattagctgggtgtggtggtgggcgcctgtagtcccagctactcgggaggctgaggcaggaaaatgacgtgaacccaggaggcagagcttgcagtgagtggagatcctgccactgcactccagcctgggggactgagcgagactccgtctcaaaaaaaaaaaaaaaatcactatctcaaagagatatctacactcacatgatcattgcagcattattcacaatagctaagatatagaaacaacataaacgtctgtcaacagatgaatggattaaaaaacttattttatctgtatgcaatagaatattattcagccttaaaaaaacaaggaaactattcatttgcaacaatatggatgaacctggagaacgtcatgctaagctaaataagccagacacagaaaggcaaatactgcatgatctcatttatacgtggattctaaaaaagtcaaacagagagtgtaagagtatttaccagggggcagggaggaggtggaatgggaagatgttggtcaaatagtacaaactttcagttataagaggaataagttctgcacatctaatatactttagttaataaaatgtatcgtatacttgaaatttgttaagagaatagatcttattgtcaccacatacaaaaaaggcaactgtaggaagttatggatatgtaaattagcttgattgtggtattcatttcacaatgtttatgtatgttgaatcatcagattgtacaccttaaacttaatattttatttgtgagttatacctcaacaaagctggaaaaaaaagaaagtatgaaaatatttcccaaaatggatgtattattttatatttctatcagtaatatagaagagttccagctgctctacatccttgtcaatacttggtattgtcagtctttttaattttatccatatggatttttttgtagtgaagtgtctacacaaatattttacccatttaaaatttttttttcctttttttgagttatgagttctttatatattctggatataagtctttgtcagatatattttatggatattttctcctagtttctgcttgcgtcttcattttttgaagtgccttttaattttgatgaaattcaatttattaattttttaatggtttgtgctttcatgtcctatcttagaaattttacctgctccaatattgcaaagatagttttcagtatgtaagaagttatagtctttatttttatgtttaaatatatggtctacaaaatataaaatatatttattaaatgtaaaatacaaatgcaaaatatagtcattaaagacgtgtattgtgcatactacgactgatacctatgagggggagagacaaccaggcaaatctatttggggaagaacaattatttatttacttgaataacaccctatcctttgatttaacacttagagtaatgacttaagacttaaaactatgataagaaatgtaagatacatgaaattcaaaaataaaattgaaaaacacatacagtcaattttaagttaatttttatataaggtataaagtaagggttgatgttccattttttcatatgaatattcaattgctctaacactacttgttgaaaagactatcacttcttccattgaattaccctgacacatttgtgagagatcaattaagcatacatggatgagtctatttctgttctcacccattgatctaggtttctgtccttaaaccaacaccacactgtgttgagtaatcgagcttcccagcgggtcttgaaatccagaagcattagtccctgaatgtgttctttttcaacattatttttgcttttctaggtcctttatatttctatatacatattagcatgaacttgtcaattgagacaaatctttttatacagaaagagagtatatggaatctataggttaatttgtggagaattgacatcttaaaaatactgaattttctaatacatgaaaagatttacctctacatttatttaggtctttttaaaattttttcaccaatgtttcattttcagtatataggtcttgcacacatgttctgttaaatctaatcatgctttttggtgctattgtaaatattattgtattttaatttaatttccagttttttgttgttagggaataatatagtttatttctttttatattgccctcatgtcctgagacctggttcactcacatattacttctaacagttgttttgtaaattcatttggattttctctatagattatcatgtcatcctcgaacaaaggcacttttacttctatctttccaatctttatgccctttatttcttttttcttgccttataacagagttcatgacctttagtacaatgctgaataaatgaggagactaggcagccttttgttttcaaccaatcataagggcaaatcattccttgttgttattgtttttaaccattaaatataatgttagctagaagatttatgtaatgacctttgtcagtttgaggatgttcccttctatttctagtttttattagagttttagtcatgaatgggtattgaagatgtctgaatctattgacatgattaggtggggtttgccctccctttccctgttaatatagtaaataaattgattgattttcaaatgtaaaatccatgtagtattcttgggatataaaccactttttcatgatctattattactcttatatattgctggaattgatttgctaatattttattaagaatatttggacctatgttcatgagagatatttttctagagtctttcttgtgatttctttgctggtttttgtatcaggttaagcctggcttcatgaaatggctttagaagtgttcctttctcctctgttttctggaagtctggagagaattgtttcttaatgcttgatagaattcaactgtgaagctatctagaatggagttgtctttgtggaaagtttttaatgaaaaattcaatttttataacaaagttttcaaatttattggcataaaattatgcataatattttcttattatctttttaatatctgtaggatctgtaacaatggctcttcttttcattttccgtactgaaaatttgtctctttaccttgataatcctaatgagggctttattgtattgatctttttaaagaacaagcttacagtttaaatgattttctctattgtttgtctattttgcattacattgattcccactcttcttttttttttgagacggagtctcgctctgttgcccaggctggagtgcagtggcgcaatctcggctcactgcaagcaccgcctcccaggttcatgccattctcctgcctcagcctcccgagtagctgggactacaggcacccacgttgacgcccggctaatttttttgtaattttagtagaaacggggtttcaccgtgttagccaggattacctcgatctcctgacctcatgatgcacccgcccttcggcctcccaaagtgctgggattacaggcgtgagccactgcgcccggctaattcccactcttctgtttgtttctttttttctattcactttgttttaatttgttcttattttttctagcttctcaagatacaaacttaaattactgattaaaaatcttttttctgctataaaacaagcattttttttaccataaattttgtcagacatatgatacattttattttccttatgaagttttaaatatttccttatttatcttgtgactcatgacttagaaggtattatttaatttccaaatattttggtgtttcacaaatacttttctgatactgatttctagtttaattgtattttggacagaaaacacaccttatatgattttagttttttgttaaggtttttttatagtctagcacatgtgcacttgagaagaatgcatattctgctattttggggttagtattccattaatgttcatgaaattaaaggacacaactatcctttggttggatagttttttcacattttttatattcttatttgctgccttcttgttgaagaattactgaaagaattacgtcgatatctcccattagaattgtggatttgtttactgttcttattaatggcaaaagctgcgattacttttgcaccaacccaatagtttgtaagatttttgcttcatttattttgaaactatgttttaggtgtatagacatttatgattgttacatcttcttgatatattgagcattttatgattttcaaatgttcctctgtattcctgataatattctatgaccagtctggcatggtggcacatgcctgtaattccaaccactcaggaggcagaggcaggagaatcattgagcttaggagtttgagatcagcctgggcaacatagtgagatacccatctcttaaaaatattctttgatgcaaagtctgttttatctgatactaatctagctaccccagctgtcttctgatcagtgtttgcatggtaaatctttttctatctattcacttttcatatgtaggtacgtctgtctttaaaatctgtttcttgtagaacacatgtagtttaatcttgatttcttataatgtctaacaatcattgcatttttaaattctaatctttagtttggtgggggggttgggggtcggcaactatcgctgttaagggtcagacagtaaatcttacagtctgtgttacaactattcacttctaccattgtagtgtgaaagcagacataggtaataaataaatgggtgtgactgtgttccaatagaactttatctactaacacaggaggtgggtcataagtttggtgacttcttgtttagatcatttatatttaatgtaattatcaatatcgttgggtttaagcctaccatcttgctgtttttctgtttgtcctgtgtgttttttttccgtttaatcctcctttcatgccttcttttagaataaccatgggttttattgtattccacttaatctctaataaatagcttattagctatacttctttgctctgtttaattagtggttgctttatgatttacaaaatgcgtttttaatttatcataatacattgccaaataatattgcaccattttatgtataatgtaagacccttacaacagtttacctccattgtcccattccattctttgtgctgttttttttaatactttctacttctttatatgttataaatcccacaatatatggttattatttttgtttcaaagagccaattatctttttaaaaaattttaaaacaagcaaaattattttgtatttacccacatatttaccattatctggcatacttcctttctttgtatagatctcagtttccatctattataaatatgtgtgtatatacatgtaatgtcatcatgtttcttctcattatgttttcctttaaagttcttgcatatatttataatagctacttgaaaattattttctgctaattccataatttttgttatttctgggtctgtttctttggctttgccttcctcctgtttgaatcacattctcctccttttccacattggtagtaatttctcattggatgttgtacactgtgaatgtttctttgttgagagcctggattttgatttatttttttaaagggtgtcaagtaacttgtagatctgcttgatccttttgatgtttgcttttgagctttgtttgggtaaatccagaatattctttattctagagcttgctcagccctcctgcaaaagcatgattcttcttgggtctctactgaatggcctggtgattgaaatgcagtagttctgcttacagctccacagtagattttttgcctggctttatgtaattttatcctatacatatgcagatcaatattcagcaacagatttcctccttcctctcttgttctctggtcctgcatattccagctatgtcagccttcccagtttctgatctctcttcttcacttggtgagaccactgtgttctgcttgggttctccacctaaagaaagtgtctccaagcagaaagttgtggagatcatggtctctgcacagttctggtcaatgcatgagaaaagctgattcatatattttatgagttttctgattatttacaatgggagggcaattctaataccagttatttcagcatgaaagtgaggagaagttctatttatttgatgtttaatcctttgagatagttttagtctctccagaaacccttagtgagacctaaatgagtttttattttagttaaaatatcattccatttctcttaaagcttttaaaaataagggtacatccagagtgtgtcttcaggcagaatatcagtatcatcaggctcttcttttatttaagaagactcctttatttttacaccataattttgaattattttctccatcaataatactcaaaacaaaaagatttctagcctcagctttttccccctttggtaattctcttttcataatgcacttcatcttcctttagtcattcttccttaatgcctcttaaatggttggtgtttttctgagctacattatggcaccattagttatatattcctagcagccaagaggtgttagaattccttcatttagtagttgtaaaaaaaaaaaaaggaagtgagagctcaaactgaaggagaatttaaagccacatagttgtttttatctttatttttactatttcatatatgacagtctcagatgtccttataaaaccaaatgttttaaactagacagaaaaccactgcaagtgagagttgaaaataaaaaattttaagtacacaaaaagttcaaggccaggtatttcttctatttgcttgttcctatctcaaaaggttaattagatttattttgaagattaaatgaatcttcaaaacatgtctgaagttaagaaactacaaatatttttgccaggcaaatgggggtcgggagatgacaatggtctgtagtatgaaggacaagagctggaggtctagggagtcagagactctgcaccatgaccctttagtccttttgggctacttgtttatcaggtctgacgaatcaaagtttttgcagtcagctagcatactaacaaaatattaagctgacatgtttatttgtttcctgtttgtttataggagtttttgtacggtagtactaaaaatactttttcagctacatgtgcttttaaactgtgtgtgtgtgtgtgtgtgtgtgtgtgtatttcttgtaagagatttttttaaagtatgcatgtttatctatcaatattttttctgagttttttgtcatgcttagaaatttttcacaacacaatattatgagaaaaaaagttcttttatattttctcctgacattttaagatttaactatttttatatttaaatatttacccatctggcatttatcctttctctttttttaactttgtttttattgaggtgaaattaacattacataaaattaaccatttgaagtgaacaattaagtggcgtttgaaacattccaaacatttacatcaccccagaaaaaaacccatatccattaagcaggtgaatccccattctccccattccccatcccctggcaactacccatctgctttctgtctctgtggctttttacctactctggacattttatatagatggaagcatactatatgtgatctttcctgtctggtctcttccatttaatgtttttgagtttcatcacattatagcttgttatcaatacttcattacttgttatggctgcataacattctgttacattataataccacaatttgtttatttattcatccactgatgaacatttgtgttgttttgatttggtgctactggaaatagtgctactatgaatatgtgtgtccaagtatttgtttgagtacctgttttcaattcttttggatatgtgcctaggagttgaattgtggcatttattcttatataaagaaagaaatataaattcagcatttttttgccaaaagaatagtcttttgccttagccccatttcttgttctttcctttactaatttaagatacttcctttatcataaacagaattcccatatgaacttgggtctatttcttaaatctctttgattcgtgttctgtcgatcagtctgtgtccaagtgcaacaggttgtccccaccccatatccatttaattactatttcagtatttggaaaggaaagcctgctccccaccctcatgttaagtctcatccctagttattccttttctcataattttccttgttacttccacatgtttattcctccaggttaacctttcgttgctttctattagtgacattataaatacttaagtaatatcttcttaccattcacatgaaaaataccattttaatttgtacttaagaatatggtcaagagtcacatctctaaatggaaatcggtattcattgtatactttattgcagtaattaatcagtgacactttggtaaatgaaatttcacatttttaggtgaattgtgatttgttttctagctttaaaatctgaaggagatgattactatattaatggtgcctggactattgactggcctaggaaatttgatgttgctgggacagcttttcattacaagagaccaactgatgaaccagaatccttggaagctctaggtcctacctcagaaaatctcatcgtcatggtaaatgcgtctttgccattgtatttcttctgtttttaattcccccttgtgaggtaggaaggggcaggttttattatctctgctttacaggtgatgaaattaaggtaaataaagataaaatgatttacccaagggtgttagagctgtgcagagttaaggccatagtgctcttgcttgaatagtatttttataaccaaacaagacagatgaaagcaatggctccaaaatacccatgaaaatgggaggagaaaatttgatataaatgcatgtgttttatattaagtttcctgtaagacttgttttgacattttcttcttcaaaaggaataataaatatctgaatgaaggctcattgtattttaattgtcttcaccagttgttttcaatggcaggttctgcttcaagaacagaatttgggaattaggtataagttcaatgttcccatcactcgaactggcagtggagataatgaagttggctttacatggaatcatcagccttggtcagaatgctcagctacttgtgctggaggtaagatgcccactaggcagcccacccagagggcaagatggagaacaaaacacattctgagctatgctttgtgtttgttaaaaaagctaattggaaacatttcttgcaggtttgcttcaagctgtaatttagcaaaagaaactttgctttaattatattatattccatttgttttcaacctcatgtaatttgtgcagatttgttggtaaaatacatcttggcacaatgagtgtctctgctggtgcttctcccaagactatcttgaaggtgggctgtttgcctttcgtgaacacattcttggtaaagaacatcaaaagttttaaaaaagaaaatgagcaagaatcagacatcacagatgcaacttcttgtaatgggagatgagaatgtacggctgtgtgcttgttgtgtgtgtttgtgtgcctgtgtgtttgccacaatcctattcaaactcccttctcctgccatcaaagttaaggggctgtatactgggatgctacaataattactggtatctgggttctgggttaatggtgtatactgaccccattacagtccctcagaggtagctgctaggcggtggttggtgatgtgttggttgtcccatgtgcgtttttcatgggtgccttttccctacaatttactctattcctaatcctcctccctctagtggccaccaatgcaattctttacctctggctgggagagcaggacagttggcttccttcaaagccaacacccttgctgctgcatggactggtgagtagaagtgctgtgcaagcagcatcttccttctctctggagactaaatgcatcgcctccaccgtacaccttgatcctaacaggcaaggaaacaaacctgtccttcaggcctaggctggactagatcacctcaccattccagaagcaaagattaaattttaaatagtgatatttattttgggaaaaattaaaataaagtaaatcatccaatacattacctatactccttttttaaactatgcagaaatatatgatttttatatagacttcatcctgtcttgtatttgcatcttctgattttcaagtcttaaatcagagaggttatttttagagaaataattaacatataatctattcagtatttttattttattttattacttattacttttttttttttgagacaggtttttgctctgttgcccaagctggagtgcagtgacacgatcatggctcactgcagcctcaacctcctgggctcaagtgatcctcccacctcaaccttctgagtagctagggagcacgccaccacacctggctaattttaaaaatttttgtaaagacaggatctcactgtgttgcctaggcttgtctggaactcctggcctcaagcattcctcctgcctcagtctcccaaaatgctgggattatgggcatgggccatcacgcccagcctaattcagtatttttagtctcatacagaattaaagcaatgattaactacaactccaatttcaatataaagtctatacaacatgaaaaaaacaaaaaagatgaataataatatattaatgtactctactgtgtaaagtatcatgaaacatggttatgtataattcgtgacatattttaaaagatctctagttcccatccattttatgtgtaaaatggctggtgatttgtaatgtaaagtttttaaagccataggacattaccatttttaaataaagaaatatttgcaactaattgatcaagtatatgccattgcattatttttagtggcatttatacatatatctatcttttatccaattcaattctttttattctataaattaacttttccctttgcatattccaacaaaaagtcttctagaacaatacatacataattcaggccctgaggcaaggtgggataaacttattaaagaataatttaaataatttgaagtttaggaaatctaataaggatagtctaaagttaaagtggattagcttggagaaaagaaagctaaggggatgcatattagcatacgacagaaggttgaatgggaaattcttagagccgcttcatctttgtactgaaattgctatatttggggatggtttagatacagtcttgtctgagaccaagaaaggattaaatgaattcttaatgttccttcaatcctatgattctatttgttcagaaaggagataatccaacaaaaaagcaaagaagaagaagaggaaaaaggccatgagaactgaatttggaagaaaaaaatataattttgttgaagtcagaaagtaaaaagtctaaatgagtgttatttttttccataacacttgcattgagaaatagaagtgatttcttgtggtagggggtaaaaaaaaaaaaaaaaaaaaaaagagagagaaaagcctctggaagggagagctttctcttccttgttatttattcttctttctgtgatctggagctactggtcttagatactggaggtggttctgggaactcacattagggttggttgtgggtgattatgagcattcttgaggctattgccttcttcaaatgagggatatagagggcatggtgtaaagagctgccatttgtttcggtaagtggttcttaaagtctggtcccgccagcagcatcaacatcatttagaaacttgttagaaatgctaatttgagcaccccattacagacctactgaacagaaactcttcgagtggggcgcattaatctgcgtttcaacaagccctgcaggtgattttgttgctcgctcaagtttgtgtaccactggtcttggctgacagagaaaccaaacccagcactctagacacgtggaatccgtgtcttcatcactgaagtctgtgcatctttgtaaactcattttgcccctagaacaatatccgaaacatagtaggggcccaataagtgcaccttattgagcaccttaatgaggccaatggtggcctcccaaaatgctagatgagtgaatgagtaaaaggaattaattttggcaattatatatttgtgcttgtcctttctaatgtgggagatgaaagtttagagttgctacttttcttatagagtggggcaaagctttgccaaggaaaaacagtatcattttaattagcataggtaggtaaaaccaagctcctctcttttttactttgttttttttgtttattttttgttttgttttgggtttttttgtgttttgagacagagtctcaccctgtcacccaggctggagcacagtggtgtgatctcggctcactgcaacctctgcctcccgggtttaagtgactattccacctcagcctcccaagtagctcagactacaggcgcccaccaacacgcctggctaatttttgtatttttagtagagacggagtttcaccatgttggccaggctggtcttgaactcctgacctcaagtgacccacctgcgtcagcctcccagagtgctaggattacaggcgtgagccactgcacccagccatcttgcttactttgaataggtggaaaatatttcctaggatatagagtgcaggaatcaattgttgaagttgctcttcttacacttttaaccccaggttcttaagaagcttacttttaaccctcacttttaaccccaggttcttaagaagcttatgattgagggaagtaaagtccctttagagtttaggaactttgacccaagaaaaagccagagtcatcttctccttaatgaaacttcattttatcgttaagaaacccttcaagaagtcatttctacttacctttcactcagaaactaaggatgaattctaaagtcagttctttttttgttggttttttgtttttgtttttgtttttgctgtcattaagtctattgtctttataagggacattttgggatggttccacctcatcattttaacttctttcttgggcttctcatagactggattctctcctgtggcagcaagagctttcttatacatcttccccatcatgtctggagttacactgttctttatgtgttgagagaactgtttcttgtaagcatcttcatcttcctccattaagtagcacatgtaatctgaaacattctggcccatgatgtgcttctggtgtacttccacattaaattatttgctttcagaatcataaccagggaattgtttggtactgtgagggatagacaagcctccatccatagcttcctttggggtgccaaaaactttattgccagtggtagttctggcaaggcctgcatccagatagcagataaagacacctggttgaacatcaatgctttccacattatattcatctccaatcaactccgcttggccttcatagatcttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggccttccaaagtgctgggattacaggcgtgagccaccgcgcccggccggccttcatagatcttatccatgccaaacctattgaaaagcctgtgggccagcagcaggccaatatagtacgctgcagcatcatttgtcaggccaatcttcacaccatattttggcagttcatgtgcgtatgctgtgcaaactatcatatccccttacatatgggcataagcaatctgacaaatggtatctctgtttgttatgtgagctatcaacctgtatttgggtgtgtgttttttatttatttattgtctgccacttgacagagacctgcaggcccagcagtgctaggtgggaaaaagggataaagtcagttcttaactgagatactccatgttcatctctccaaggaggtgctgggtgtcttgaggctgtcaaaattcttttaagtggcaaagagaaaacaagaaagatctcaaagaactttcggtggcagtctcacaagatccttcagtgttctcacttgttattttcctgcatatgttttattaatatccagacctttgggctttaattgagtttgggagcaataatgatagctttctcttatgagatcttttaagataagaagcttgagactttttctgttgcttagcagatccagtgacaaatctaatgctacaggaaacattggtgattcagtccaagtaatggtcttttctctgagtcagtaatgaaacacttcctttgcctcataaggaacattgagatgctatggggtgttgtcttcagtatatgtgtgatttttgagatactgctgtaactcttcctcagagagaaatccaagcccaaaaacatggctatttccagaaccattgctactagaatttgtttctgtattccttacccaaacatatttatactttataatttactgactcccgaatttatatgctaccattggattagtgattataatcagttgctaattaatgaatcttgtctgggtagggaaagttgtattgttttaaaatacaaagctgtaggagatttttaaaagtggtaatttatgccagtatacctatgcactgtgacttctaaagtttcaaataacaaatactgtatattcatcctttgattttattcatacatattctctttttacgatgtttggctagatatgtggttctcaaatttaagcacacatcagagttacctgaagggcttgttaagacacagattgcaatgttctaccaacaatttctgattcagtagtctaggggaggctttaagaatttacatttctaagtttccaggtgttgctggtgccactggctcaggaactgtacttcggggctctggggtagacacttagatttcctaaagtaaatgcccactaaacagagtgacaagtcttttaggtaataatctatattatagttgtaaccatagtatcactaatctttttggtgacaggtggttctactgctcagctatgcaataataaaattgtaaagtttaaaacattttctggtactatatttcatttgatcatcttcagtagctccataagataggcaatgaaattactagtcataatttataggtagaattcaagtaatttgctgaaatcaagacctagcaacttagtctctagtgacctttttaatttagtaatgaggtgttcttttgtaataaaaagagctttttcaccagttggctgcctcagtagggaaacatgatatatccccacccataaagatctccttcactagcttgaaatttcattttttcaaatgccttccatagagcaatggttcttaactttggctgcacaatagaatacccaaggagaactttaaacaatgatgatactttgtccccacccccagagagtcttctttaattggctgggggtgtggcctggacatcaggctttgaaaagttccataggtaattctaacatacagccccggttgagaagtactgcttttgaaactgattaaaagttttagtcttcaaaaaattaacattcagatgcaagtacctctgggagcattactaacacagatctctgtttttaagtggctactagttgaattctaaggttatgagacttaggaatgagtatctgggatgggaaagtagagaggagcatcagagaagggaatgaaagaaggaatagcatgccacttaatttcataattttgtttaatatggccattggccttgggcatgcctatatatttacagttttccttcacttggtggatcatttataaacatccaattaatgtaataaatgcttttaaaactgactgaaattgtgctaaacagatttcccaaagctctttattctgatttcaagtttatctgatacagagctaaaatgagtagatggtcgggtattcaaccaactttaatttagatgcacaagtcagaacagaagaggcatatggcccctgtttgaactcagttattatgaacactgatacaatttgttttcttttaaattacagttctaatcagagaagaccttcattttttaggaagttactttctttaagagaatgaatctttgcagaatgcagcaatattcatgataattttctaccctacttttctgggtgtgttctcatttccctctgttcataccattctcatttcactcccatcccctcctcttatttaatattatacaatgcttaggctttaaagtgaaaccttccaaagcccattaactgataattgatgctatagtgttgtatttaactttgtacctgttctgttagaaaataaaccttaagaatagtttatttgcagtacaaagaaatgtcagaaatacatacgatattttatatttattataattttatatttatgctctaaatatacagtctgtcctgccattggctctattgacactcctgataactttctccaattttttttcctagatttttctttcttcttctttgaatagaagtgcaaaattgtgtaccaaagtttctgctaatacacaaaagcatctctctgccaaacattgctttgcagttctttgggggaagagataaagctatgcttagattactgaggagttaggaaggagacagtttactgttagagatattttttgttttgtttgaagatcaaagagcacagattttattttacatatactaaatgattatacaggaatgtttctgatcaatcatcattgactatttaaaatgctatcattacttttacatttacatttacatagtctaattttatttgtatgtttgatgcttcttttattatactttttcttccctgaatgtcattttaagcctaatgtatgagtctgtgtgtgtgtgtatttgtgtgtgtgtgtgtgtgtgtgtgtgtgtgagagagagagagagagagaaaaaaaacagcatataaacatagaagatatttatgtctttcttttttttgagctaggacaaattctttttattttactttttgagtctttacctgattctttttttttttttttttttttgagatggagtctggctctgttgcccaggctggagtgcagtggcacgatcatggctcactgcaacttccaccttcctggttcaagcaattcccctgcctcagactcccgagtagctggaattacaggcgcatgccaccatgcccggctgatttttttgtatttttagtagagacggggtttcacatgttggccagactggtctcgaactcctgacccaggcaatccacctgcctcagcctcccaaaatcatctggattcttatacatgttgtggctggtttctactctttgagatttttaagaccatttatatgatttccaactactattttgaattttcctgatgtgggaccacgtttttcaaactgtacaaaggtgcccaagggcactgcagaacattgtacattttcaggggaaacatagcgatattgatcttacagcatacaaatcattacaaagaagttatttggaactaactacaagtaaaattcttagtctttttttttctgtcttggggatgttatttttaaaattagagatactaaggatactgtgaactgaaaaagtttgagaacccctgatttgtaaaatgagtatcattaaagttggattaaaaatgtcacctaacttccttttactagatgttgaatttcatttcagaagagaaaataaatgcatataagctgctcattattcagggccctggtgatgttcagaatttaaaactggagactcttctgtacttctagctaagagactagaggttttgaataatatgtaaatttctcatatctatattccttccgatgcatcctcctgaatatgtttccttcctctgtctctgttagtttggggtaagaatagtgggtgattaaagcaaaggaaaaaaagaaatgaaggaaagaaggaactatatatttaaaggagaaattgctagcaacttctttcctgacagctaacaagtttatgtgataacctatactattgcatttattaataacacaattttcagattacttttaacgaatctgtcatgccttggcccctttaaaaagttgggtatttctacattgtttctatggaaatgttgtttgttcatgttatatatttcaggaatgatacaacaaagcataatgttgacttaaaagtatagtaagtccattctaaaatgacagtttttaaattatttaaaaaagtaattattagaaaatatgtagtacagtctttaggccagtactaatagctgactaaaagagaacagttctcaaagtaccagataaaacagagacaaatgctttacattttcagagatgtccttttaattttttgtcaattctaagatgtctaacacatttaatatcactaagaggttaattcacattattagtgaactaacagaatgtgcttcaaacaaacaagggttctgagacttatgttttacggacgtaataacaaaaataatgactaacacttgtattgcagcttataaaggacacattcactgtaactttcacagaaactcaaagcagaggagccccaaatggagcataggaaaacaaagtccagttgttgtttttttttttcaagattcaaaatagacttgattgaaattaagtgcgaaagacataaaaaaggttgaatcttataactaaatgtgcttatctttcacttaggagttaccaatccagaagttattttcagagttaaataaaagattacagagggaaactttagtttgaatagttaaaagcactttattcaatgccattcatttccctctgaagaaacataattatatagttagttttaaagaaaaattccctgtgaaagatagtttctgtgtggggttgtacaatgtactattattttttgaaatcatgaaggtccttttacatttgagtcctgtatatatcaaacgtagatataaaacctatcactgagatttttaaaataatacaaatcccctataaaaaaatgacttgagtttaggaagaacaaaggtttgcattcagctttgttgatcattattccctagttttcactttggtctttgaaaaataatatatttatcggactagacaatggtctgtcactgcattaaccatgacatccccctattcactctctcccacaattccctcctctcaggtcactttcaatgttgtgaaggaagagtgtcctttaacctgggattagctgtacccagcatcataacagggcacctgtgaacatcacagcccccaagatcctaggctctgtaatcattaaccttactgggttagttcttatataacttgactcttgagattgcagagtatctcttctatataaactcatgttcgtggttggttcacacttctggaagctaatatgtgtgttcatttatttatctataataattttcatttatcttttttccttaagcatatggcttctcctatataactacttttacaaaaattctttgaattatcctgcatattttcaatataacttaagcttaaagtcttacatatgaagagttattttgataatcttgacatgttttgctgtttacttctgcatgttgtggattgcattttctctaatgtgaagatttataactgaaggcaagaaatctctgctaagccaaaatattctcctagtactgtttcatcatttcatcagtcctctttcatcatttgtgttgctttagtgattatattcttccctaacacgagcagggtttggatacatattcagtcactgaaaaacttgggtgaatctgaaaccacagtttgagtgcattcctattgtattaatgatctatatatcacaggtcatgtttcacttcacaaaaattctttccaaaatagtatttttaacagtcataacattattcatctttacatgtttgaatgcataaaatacttttggaaaaaacaaagccttttaaaaataaagccttttattatggtaagcatgatcatcctgattttgtgggaacttatgatattactatttccatctttagttgaagaaaatgaagatttttagtttaaaagctatacagtttgtatatgattatatccttattttaactcaaatttgaaatatttcaagatttggttcctagaaagggattttatatatgtttaaaagaaaagcctgtctattgatgataaatacattacactgtgtggaagaagctcaaggcctttgtactctcaacaatattcctctaaaatttaaataaaataccaaaaacaagctcttacttaaggtcatggagatgactttctagtataatataactaatcctttcttttttctagagacaggtctttctatgttgcccaggctggagtgcagttgcacagtaatagcccactgcagcctagaactcctggcctcaagtgatcctcctgcctcagcctcccgagttgctgagattacaggtgtgagcatgtacacccatgctgggtataccagcatgatttaattctttatattaggaaacttgcctttcacaatttcctatttctagttagtattctgcctcttgacatgtgtaacccctttgacatgtacctcgcactggtacaaacttaggcacttgaaacaagactgcaaaaccaaatgaaaagaaacatgcctgttttctagacttactctgtagaatacagaggaaaagcagacacataagggagagagaattggtggaaaaaaatgttgaacaattgaaatgtggaggaagagaagagaaggcaacttttatagaagtttggatctggaagaagcattctaaattatctttatgtatttgattacctcattttacaaagaagaatgaaaacttgccttaggtcatttacctaaaccacttagaagtcaaaaagaggtaactaaacatggcagaatttgggatgagaaaaaacaaaggaacaagataaagtgaaaggtaatatcatttggctatgaaaagagtttggctatgaaatttggctatgaaaagagttcttcagatcagtgaggatcaggaaaagagaaatcagacagtaataagataaaatggggaaactataaactaaaaatattagacctgaaaatgcactattttattagatatcttccatcatgtaatataattataatggtacttgccctgttccaccccacccccattttagtgtaatctcattgaggtcaagactgtcttactcagtaactttctcccttatagtactaaaaaagtatacattagacatagtaggaactaaattagttaaaaacttagatactttatatggaaaagattactcttaatagctaaggagtaataggaattctctccagggataagctcagtatacgtatgttccaccctaccttaccattactaaacacagttgttctagaaaaatacaatatttttagagctacattttgcttttgatcatcctttgtttacttaggacatccagttttgcttaggacagaaggaaatacactgaaaaggacagaaggaaagacactgaaaagagaagggaagcctttgaaagataaaaactagcaggaggctcttcagaagaaggaaccatatgagtggagttgattggtaccctgggttccagctgttagatccaaggcagatgggctttgctctgccctgcaaatgcttgtgtctggccaacaatcacacggcacaacagccagattccagcagtgaaaggcagagcggagagacattttttttcctggcacttgtcactctttggatgctatctgcattaaagatttaaattaaattaatattgctggccatatgctctgtatactgtagttatatagtgttgtcttggttgctagctactatggatgctgtggctaagcaaattgttgccttagccaccagacacatttttagtacaagctctgactttttaatgttacctccttctcttcagaaaactgtttcttgggtagatatgatgtgctatgtcactaggttaaattatttagatgttggttagcccatcaattccaagaatacatttatatttctttctttttattgttgactcattcacaggaggttgtagaatgcccatttatccattacatggtctatcactgaaatgatgggactgatgagtagagttgagaagacttagaaagtctttctcctgcccttaaccacccccgacccatccttcttggtttaacacatgtcaccctttcaagttaaattcaagttgtaatttctgtaccttgagtgccttctttctacttttaagatggtaaattgccctgagaaaagcaatatattgccaaatactatgttacaaatgagtttacaaaattatttaattctctgaaagaagagaaagataggaacacatgagaacattgggcagctaataagaggagtagagggactggaatggagggaagaaatgaagaagagcgatggtctctgaactctttgctcagactgggactcacttgaaccatcaccaccccctagagtaagaacagcagatggtttccatccaggactcatttgccatttgatgggcttcttgcaccttttcctttggtacatactgtataaaaatgccattaaagccatttcttgatatgtagctagagcagtgattcaagtggaatatgccttcttcccattgtataaaagaacctttgatgggaaaatagatctttaactttgaactattggcagaaaattaaatataggatctgacatttaaacttatggacaaaaagtgagggttacatttctgtggtaaggaccatcatatttgaatctttagtatcaaagaataaaaagataagcaaattaaaagtctctaaacagaatataccttttgtagagggtttaaagtaaatatatattggcaatatcatctcttataattaactttcgtaatatgaagccattactttttttaagcatggaggaaggattgcattaaaaaaacatatacatacagtttgcatgccagtaactttaggtgtttaagaataaaatacaattagtgtatttttattaaattctgcagaacatctgcttatttccaggggatctggacactaagccactagaattttgtttttgattaggtacacactgactggtcatgtggacattttatgttttggttataaactataagtctttagatttgaaagcatcgtggtttcgtgtaactggatgtaattattcccaaccgggtttaaaatcaacatcttagcaatgttttacagactactttaaaagaagttatgtacaagaggcttgatcatataaaaagaatctaaactcaatcatttctcttgtggacttagtttagattatttccagttgatctgtattttctactttctaaagttaaaagctgcattttccttaattcaaaagtatgtgtttaaaaatccattcatttagatgccttggtttatagagttatcctgttgctactgacttaaaaagaaaaaaaaatctgtaaacctgccaagtgtgggagtaatagttggaaggagctttgtatgctgttggaggaagatagtacagtgttgtaggaagatttggaatagattactgatatagtcaattcttgagtgtgaaataccacactgtctaatataacattctagaagaaaattaataaaagacaaatgtaaggaaaacatgcatcttcataaaatatagagcaatttcagctgtctattcaaggactttaatttttacttcataaaaaatagcattctgaaatcatgaagctaaaatgaacacctaagtactcttgattcccagtttttaagaagtatggaaggaaggcatgatcaaaattaagtcaattcataattcttagcacttagcccaatatctcccaagagatactgtgtttatatctcataaacacaatgctttggtttagtaactatctctgttgaatgaatgaatgaatgagtaaatgaatgaatgacctgccaactacatttagctgacagttttagtttgggtatacatgtaatttttaaactaattactggatcccactaaagagcaaaatagccctgaaattaaaggggtctgaaacaaaatattggactatgggtcagttttatttcttccttgtggttttgtgtaattttccaaatttttgataacaaatattatgtaccaaatttttttcaagatacatacattgttagaatttatcataaaatgaaatataaatcacagctctactaactcatatctcatctatgattcaaattgcagaggccctgcttttgcaataaaggctacttttgaaaacaaatgtaattatagccaaacaacatttctagggttaagttagagaaagaagaattttatcttgacttaattcagtttctacaagtcaaggaaactgaattaatgtttctgccactgaaacaaaaccagatcagttgtattttgtagtgttgagaatgtttattccttcctgagaaataaccaagatatgttttggatgccagtgttcttgtttcaagtatagtcatgtttgaatgacttaaaaaaaaataatcacactaaccaataaaaaaaaatcccctgctgtccctgatagaggcaaaatattgaaccaggatggatggataatctgagccactgttggagttggtagttgactcctatgactaatggtagaggtatctgtctaggtggaccacatggacctagttatctgcccactggaatgacacaatggggagatatccgatgaatatcatggaacatctgtgaatggatcacaactatgcctgatgtgaatcattcttccctcaaaaattctaaagtttaatagttaaaaaattccaaactgttgtcgtcacataaacttcattgtttggcttattttaggggttgggagggaaggaatacaatacatactctaggacattttgccagtaagttgtttgactatgtttaagacccctaagtttaggaaaacataaaaaatggttgcagaaggtgatcagcaagagccctgggtcagtgcaagcaataaaaaagactaactgctcaccactgtcatggaagctacaggatttaagtgtcatgagcttggtggatttaatagtttgccctgtcagtctttaaatttaaagggcttagttaaaggtaggtgtgcataacatgataacggaggcactcccacctgcagaatttctatgatttaggggaacttgggggaagcatttggtgtgtagctctttaggtgacagtttctttcactgaatgatcctgtttcacatatatttccctaatttgtgatcacactgtttttttagggcattattacttgaaacaactgggaaaaaaaaaagaaaaacaactgaaggattgtgtgggattagctaggtgtgaagctgtggtttcctggatactgctaatgctgcttttacaactctttctgggtaatttagcctacctgtttatagagatggggtgggtgagtgggggaatagcttagtgtgtgcttttatttctattgccaggagtaacctgttaccgctatatgatctgaaacatttagcattgtcttgtagtttgacgtgtttctctttgatatcttgatatacctgtctgcttcttttgtttccttgacactaaagagaaaatgagtatacataaaatctgttcatcaggaacatttacaaatacgagtgtgtgtttgtgtgtgtctttatattttgtgaaatgtgagcaagttatggtgaatatctttgccaataattgacatatatttaatattttataaactgtatgagaatatttttagctgtggtaaacatatcacatagactaattttttaaaatgagataaattaatatttgaatgaactgtgtatgtatgtatttgacagtggtataatcaacaggggtcaactctgttcgaataaacagactagttggttacagtccaaaagaggcccactgcaatctctaatttctaaacaatgaatgggcttttagagagataaatatataaacggaagaaaaaatgaaatgtgtggatgtgatgtattcctaacaaaaactaaatagatgggatttgttctacaaaatatcaaaaagtaaatttgtccctattgttctatttttaaataaatatacaatcattgttttgcattgaaatgcatatttgtacattttatttgataatattattttgggaaattgtaatctgttgttttgtttgtttgttaagggaagcacgaagaagaatttacaaatgtgaataaaattgtttaagattaccaatagtttcttttctggacttgaaatagttacgtttctaaatatgagaaaaataactttgcctaaaatttcagtataatgaccaggtcttctctccattttagagaagcagtccaatgtggaacagataagacggcagcgatccagtgaggtcaattccccacagaggaaagctatgcatacctaacttaatggaaggtaaacttctcttcaattaatgatgtcctccttttctcaaggtgtccaaagacaggaggtggtctgtaaaaggttggatgacaactccattgtccagaacaattactgtgatcctgacagtaagccacctgaaaatcaaagagcctgcaacactgagccctgcccacctgagtaagtaagggaaagaaatgagaattattttcttcaggtgcaaagagaaaaacattatgtattcatgtttggaaatatatttatatgatgagaataaattaggctgaaaaaaggtagaaaacatcctgagagggaggaattttgatgtctcttttagtgagcaaagattcctatttatccatagatttcagtcattaacttctttaaagcaggaacttcaatgaattttgttctgacacaatgctggaaatgatcatatttcatcaattctaaagcacacatcttttcacattttagcatctctgaaattaggattcaacttgcagctaatggtgtcttactataataattgacatttttcccctctcttaatggcacataaaaaaaaagtcttagatgtaataaaatatagtgatttatttacactcctgtcttttctacatatttgtcctaaagatctaaagacctcttttttttttttttttttttttttttttttgagacggagtctcgctctgtcgcccaggctggagtgcagtggcgcgatctcggcttactgcaagctctgcctccagggttcatgccattctcctgcctcagcctcccaagtacctgggactacaggcgcccaccaccacacccggctaaattttttgtatttttagtagagacggggtttcactgtgttagccaggatcacctcgtgatccgcccgcctcggcctcccaaagtgctgggattacaggcatgagccaccgtgcccagccaagacctaaagacttttaaaatggtttagaaatactctggaatagaatatcagggctttaatttgctgacccagtttaaagttctgttgttgtaaggcatcctatattctgagtgttgggtacaggcatagaggtatacttcagtctctttctgttgattaatgcagcaatacaactcactgtaaagggattaacaaggagagagcccattcattttaatgatggttttaaatgagacctgctctcaatgagccacacattataatctgtaagaacagaaatgtttcttgattgagcaaaaggctcaagatgattatgtgatgttgagttgatcacgacaaaagtaatctttgtagagattttgcctgattgaaaactgcaagagaaaacatgtgtgattggcatttcattcttgtttgagaaattggatgaactgttatcttcctggttaattaatcatcccaacatgaaactgataaggcaaaagagaataagcaaatgaatttgtatgttccaaactctctacaactggagagaaaaactttataatgaagcttctctaaaaatgactagagtggagctacataaacatggaagttaaaatacataaataatccatgtcccaaataacgtttaaaccaaggtgcatttcttgttcaaggtgcatttcttgttccaaagcaataatgccttttgaacttccattatttaaagtcagtgtctgcctgaacatttgaatcttaaaggtgatactcactactagtcccttgaagaggtgtagggtattggcaaccaaataagaagcacaaggaatctagagtgatagtttttgttctaagacttttgcaattttacattgagttcttttcaaaatgttatcaccatataactaatctcttaaaatccagacatgggaaagtatcaaaatgtgacctatcatatgtgttacaaagacaagttattaaatttttttcacattcctcttttctgccaattatttttataaatttatctcaagagaaactgagaaactgtagagcaatgcgatgctcaaaatccatgggccaattttgtccctttctatgtttccagtaacttcagcatattttcatgtcattgtgagtctcagtctattacgttaattctctgacattcaggatcttaagtagtatatttggcatttgatcagcctgtgaaggcatctgagtgagcctggtcacaccctattccattttggcctaagctttttcatttgtttaagcttaaaagtttaaatgtccagtgtccttaaagatttcagttgttggtcatttcatcccataagttgtgtgtttgagtattacattggaggtttgtttttgttttttaacagtttaaggataattgacatattgatgtacactattaaaattaagctttctatctccttatgtagttctgaagtgaagttacttacttaagtttggagatggggaatggaattcaaaagaaaagatacagagaatatgggaaaaatagaaagtttagtctgatgggttttttttaaagacctaaatgtagatacttaaaatattactcattattagcctacttctcttagttgctttttaatttcttctttagtcttttgaattcagactatggaaaaggaaattttaattcttcaaaatggttatatatgcttgacttgtggtgggattacatcctgataaacctatacaaagttgaaaacattgcaagttgaaatgcatttacttcacctaacctactgaacatcatagcatagcccagtgcaccgtaaatgtgctcagaacactaccattgggcaaaatcatctggcaacacagtacactgtagagtattggtcatttacgctcatgatagcgtagctgactgggagctgcagattgctgttgctgcccaacatctagagatactattgtacctcatattgctagggtaggaaaaggttaaaattcaaaaattcaagtagtttctactaaatgtgtattgctttcttatcatgtaaagttgaaaaatcattaggtcaaaccgtcaaacatcagggaccatctgagattcccagttgacattggtattatagagatagaaatcatagaaaggctactgaattcagtaaaactttacgagtgtgaagaaagcagataggttttttttagatgatcatgtgataggcagataagcaaaaagaaggaaacaaaaaaacctataaaccactgttaatactttgatgtatatatttccagtattttttctatgtatacagaggcatgtgtatataaaaaaaattgtattacactacttatgacactttatagtcagttctcaacatttggaacatttgaagtctttgacaacgtttagtagatatgtgattgtttatttaaattggtattccactcttgaacgattttggctgtactttttattttgatcccctgcaataatgcagcattaaccacttttgcttctgaaactgttctttataattatatatgctaaataaagaagaaaataatttatagttcaaatggaagcacatgttagtctttgagatcacattgtccaattactttccagaaagattgtgtgaatctatattccgattaacagtctatgagaatgccattttcctggaagtgaacaacagtcgttattattattttaaaaataatctttcattattttataggggaaaagccctgatatctaattgctgtcttattttgcatatatgggactgctgatgggactgaacatttaaaaattatgtttagtggctgtttgtactacttctcttttgccttttatcatcatggcctgtcctattgaactacttatcaatacttctattgaagtatttattattttgttattgatttgaatgaactcttaatgtattaaggatatgaactcttttatctgtgttctgaatattttttcctagtttgtcgtctattttccatgttatttatggtgttttgatctatttttactgataaaatttagaaaatcttatttaagaaagctgtcaaacctttatttcttcattggtacactgtttagaaaggtcttccccactcttatactttcaaagtttctttttttatttttaatgtaaacattgatctatctgaaatgttttgcctgatttgaggaagggatctatacttattttcaatcacgattgttttccctataccattagtttaaaattctaaatcgtattttttatcagaaagtattttttcaaataatgaaatatttcaaatgtctttagttatattgagagaatttataagtacagtatacaaaaagggagaacagtaagatttgtccttatagagaaaatgacggaggactaggaaaaatagacaaaacaggcattgatagagaaataatattatgtttatttggaagactttgaagacccagaggagtccttgctggggaaagttatcatgttcatagcagcaactctttttataagaaagagtatagtagtcaaggtagtaaagtgactatgaatgaaagtagtgggatccatgacatagccttaaataactggaaaaaaaaaaaaggaaaggaattaatattaaaggatatgattggtaagaagctaatccccaaccataagaaaaaaaaataagttggaatccaaagagaaaggctgagttaagtttttaccatgccgtgttttaatagcaagagtatttctgcatatgacctcatgtgaagaatccttgagtgataaatattattcctgtatgatactgtggtttttaaaattgtgaaaaccagagaggtgaaaacaagagaactattcattttaataatattgtgaccaagaatttaaaaacatttattaatcaacttcaagttggaagacactgtactttgggagaaatggttctctttcctgagggtaatctaattgggcaaatatatacaaaaataactacagtacaagacaaaatctgttaagtacaataagagagttataagcaaaagtgctgaaggaaacttagggtgggaagagattaatttttatccagtggctaggttttatttaattggtatattttaaggtataatgtttaataaccattattctgagtcattggacctcacccatggacaactgtcatctcttattttaagcttagaaaaaaattcattagagtcatctataaaactccaaaatttaagacctaggaagaatcatagaaattatttaggtccactcccatcatttcacagactgaggtatgctaatatccagtgatgttttttccattacatcagacatcaccagcttggtaaggtacaaatcaaatgtctggtggcactttgatacatctaattttgcttgcttcattgacacattctcagttgctacaacttcagagatgtttattatgttgatttttaaaaatttagaaaaaccttgactgtataatgtttagggcatacagtgttctgcttaatattagtttcactttccaattagctgagaaatgaaaaaaaattctttttatttttttaacaactttttgttttgaaatttttttaagttaatttaaaatgtaggaaagttttttatctttgtaagtagacaataatttatataaatgaatttctctttgagtaaagatattattgtcaaattctgaagatttttacaattttgctatgttgtgtttgtaaaaagagttgatgattagacccttgactctgggacaaagcctaggaaatctctctcttaatcctaatatttaatatcagtttattttcatatgctctgccattttcctttaaattaaaaagcaaaaacaatattctggttttatgatgattatttcttcaaaaatattctggtttaccaaggttggggcaaattttttatactgtctctcttattcccttctccaaattatactattttttgtaataataagagatcgggactgtaggtcagattacagaggctgcagcaagccactcttatttcagacactcgaacatgaatcccactaattgttaatgtctaatagctatgaaggacttgtgaagataaagacaatttgtgtattgggaaaagctcagaaagaaacagccccagaattgttccagctataacgattcggcaatttatattcccagagagaatttctgtattcatgtttttgccaccaagtctagaggagggaaagaagacagagaaagaatgccatcagagggtcaaatacgtggagaaggaagacaagggaaagcagtatgtcttaaactagatgggagagtggagaaactgagacaagcagatgcagtggtagaattgcaaaactgtttaaataactagggtgtgatttaatccttcagagagacatgggaagggatgatacgatgagcaataaagatgcaacagggactgagtgtgaagcctgaaatgagagttaaagtcagaaaggaaattgggagggtgattaatacttctgatttcatatattccaagttaaaggctagagtgatacatctaggttaagtttctgaggagagatggaatggaagaggggacaaagaataaaaagacagaggtgtccctgaccctttgcaacacttctgaatcattgtggttactcgggacacctgtgtttaatttgaaggcctccatccctcttacattatgagaactaatgagatcatggctggaggttgtgtgactgaactttttgtgactgtaatacacatttctgttttatcccctaatcttggtgatgaaatcactgttgcaaagttgaatcagagtttcactatggctggcatgcaagtattattttcagtacacattttcctccttaccaaaaatggtactaacaactggggatcatgttcatctgtggaaaacagaaaggaaagaatatgaaaattactttaaatctcccttggaaaatgacttagaaaaaatgtttgtgtcagattttttaaattcaaaattaaatcatcattctttaaatgaattttaggctgaaaatttgtagatgttgataaaatataatttaaatttgaaaaactggctaactatatttctaaatgctggttttctttataagtaaagacaatacgaataataatgaacaaaggccagtgttggcttaatgcagtctcaaatttaggatactagtactctgacttcactaaagtattatcttccgtatacaaaactggcacaatggagctatgctcacagaaacagtgagaaatttgctcttaagctttccatattcttctctcttgggagtctcccacctaaaagcatgagcatgttcattgagaataactgcatgatttataattatggattgaagaaaatgtcttgtgatcccgtgcttgtaacctatattttactattcagcaatgttaaaatgaatttcgattgaaatagcaatcaatggggaatccagtcctgattccatcattgctcttttcacgattttggagaactgttttcctaacactggatcttactttcttctataaaacaaagcacaatgccttgaacgtagtagacattcagcaaatatttaataaatgaaatacaatatgtcagtcaagacccttgtttcagataacaaaacttcaacttgagctggcttcagcacataagatttacgtaacacagctgagggaagtgtaagggggaacctagcttgagaaatggctggaatcaaggactcacacaccacccaggctttctagctcctgtgcattctttgaaatcagctaatttcacttgacagggaacccagccactgcagctctgaactcatcatcttatgcacctttgtgaccagaaaggaaagggtcccttttgctccagttgagatataaaaattctaaaccagaattctcattgatctgatttagatcatgagttacatcccttagactaattaatgtgtccagaagagtgaatcctgcagaagtgttgcaaaaaaaacaaaacaaaccacaaaccccctgaaattatgtatgtgaaagtttatgactttagggtaaaggtgtagtatacctacaaatgtgagacatgttatttttttctaagacatttgcatttctttccacattagctgtgtagaagctgtttttaggagccaaaaggttgaaacaagagatctgcctgttttcatagagctagctcagagctctgctcttgccgaaggtgttttaagactcccatgttctcaggatggatacctggtcttctctgtccttgtaaggacattcacatcctatcttcatagaggtttatttctagaaattgaaaaacaaatcctcagcttccttagagtggttttagcataaaatttttaattatgggagaacctgcctcaatgtgataataataaaaatacctactatttcttgtttgttatatgacagacactatgttagaagcattcagtggtgtgctggagccagctagtattggttcataggaccctattattagcatatcttctcctgttcacctttagtatatcaagctggtagcttgaaattggccatagtgaggtttttacactacaaaaattggcaaatgccacaaatcagaactcccccaccccctgccatagggagccagtggttaaacatttattagcgcatcactgggagctttatatatatgaccttatttaaccctcgtgacaattttttatgagattgatcattgttatcctcattttagaatgtaattaaaaaggagaaaaataaaagaggtttaaagacatagtgcacttgtttgaacctgggttctgtccacacactacactttagaaagcaaatgacagtaaaggtcttttccttagcagctctttcatttgccatttgtcttattaaccaacattgaaatgtcagctcgtagtccatcagtgaaagtgccttcacttagctaaaaatctctggatgcactgaggaaatgcttttctgtgtttcttccatgtcttgctgcaggtggttcattggggattggttggaatgcagcaagacttgtgatggtgggatgcgcacaagggcagtgctctgcatcaggaagatcggaccttctgaggaggagacgctggactacagtggttgtttaacacaccggcctgtcgaaaaagagccctgcaacaaccagtcatgtccaccacagtgggtggctttggactggtctgaggtaaggaaatctgaggctatatgtatatgttttgaaatgtcctaactatctatcctaaagcagttaatattaaggacacctgaacatcttagaactcaacaagtaagggctgtgtaacagtgaccatgttatattttattgctgcttgtcaggaaataaggggtgtttttgggtgggtaagggaaatcagcgagaaacttgtcatcaatttgattaaaaataagtctaaagtaaatttgaaataacattatagtgggtactcttataagtggtttttctccttcttactgttgagcacatcacaagtttagaatttgcgatacatgattaaaaattgaagttcaaaaggagagtcaagaacctttcttaccccaaaagttattgaagacctagaatgaccttttctaggatctcatttggaaagcacaatttttaaaatatcttttttcaagtaatgtagcagcctaattacgtaactcttaggtatgaattgttatcaattcattatcacttacgacctatctatatattttatgtcttctatttcaactgtgaaagaaacatggagctgaaggttataacataggaaaacatcaaatttgacttgatcattcccttcacttacatgaggaagacctgaccaagataatgttttcttggcatagatgtgtacaaaatacctaataaaatccagagccactcagaaaaattatcttatgaaaaattaggtaagaggtagttaatttttgactcctcagtatccatgagacagatacgtatgcatactatataattttccacatctcccaaagaagggctgaagccttctgtagtgtgtgttaagtgttaagaatgagtaccttgctatataaccagagatatttctttcaagttagcaaaacaggatgcatctcagactctgttctaatatatcctgccagaaacattgtggtacttgctttgggtatttcctgtagacctcatacatttgtcaaaatacaaacaaaaatattaaacgttgttctttaggaacctttggatgttactattcccctgtgaatcttactgcttgagtggccttattttgctggagcacaggactgaaagaagcactgtgtttaagatggtacatggaagtggagattctgaccagttgtggttatccatggaatctttggcaggaattgggagtgttcttccaagtttcctagccatagtccagcttcagtaattacattctgcctacctaagttagattttttagttatatatttcaatcatatgtagagatatccttggtattattctgtcagtggtcatggaaaacagtatggactctcctgttccctaacgggatacattaactcctaattgatttgaaagataaaatccattgataaagaatagacattctgcagagttgtacacatgttagtgcccaggacccttatagaaatccataaatattcattggtatgagaaatttgttatgggaaaatcataataggagacctaatgattggctgccacagtttgagggcttcaggtcaagtcagtaagtttgagtgattactaaacatactgggataggcaccatgggtaacatgaaagaatcccataagcttgggcaaatgaaaaatacccatgaaacaactagagaataatacatataaggcagtgtgtaataaaacagtggattgtgaggtataaatgtataattaatatggaaattcagagctgagaagggcagaatagcctggagtaggatcagaaggctttttagttgatgggatttaagctgaatatggaggggtatagagttgggagtagggaagagaatagggaagctagagaaaggatgcctgaaaagagaaatggctaaacagaaacacaaagagtggataatgaaagcagtgtgagagaaaagggtttgtttttaagaataaatgaaagactgatagtgataggtactaggaaggttagaatacagaactctatactatatcacccttcataagcagaaggaatgccttctgagaaatttctagaagaagttgctgccaaccactaaaatatcaaaacttcatgtaagcctcatttcacactgatcttctgacctacactattctgtatcattatatgtttttaaataaaacaaccacatatagtcaccttgagagatagcttgtgtatattaactgatatgcttccattccaaattctattttaaagtttccttcagaattcaacttcacataggttgatcttacccctctattagaattttgattcttatctatccagtctttgaagtgactcactcaaatggctctaagaggctctaaggcatttttggaggctgcctgaagatgtacatctaagctgaggacacttttaatcgcatttctgcaatactctttaacatggctgagtcaaagcttaggggcaagaaatggtgctgaggggctggagtacacatgtggggaccactgcctcagataaagcattgtccaagggagctgctgttgtctttccacagacaggaaacaattctgggataagcacaggtcgaaaactgctgctgttactgtctcaaaatttctagttgagcaccatctttaccactgtcatcatcccttgttcaagaggaaaaatggtttttgccccatactgttactcctgtttatttccccaagggggtatgtggggtgtgtttactctcacgcttccattaccttagtttaccaggcagcccatctctttccttccctagatgggttaacaataagtaagaataaataacgttaaatagatgtctgagtagctattgtgaacaaaatgagaacaaggagcctgttcttcccaaaggaatggaacacctcccactaatgaaaagagaaggtcccagcggaagagcaggcggtattcagtctctttcagttaacctttggcaaatatttcacacaatttttttgacacacccatgaaaacctcccctttctgccccctccccacttccaactctcagctgtctgagctctgctaatcacaagggtgaggttcaactggtgaaaacatattgcagcaagaggaatttgccctttgaccctttccttttctctgccggctactgtagtgtaaaatttccattgttgtaaagccagcgtcagtgaaacccacccagtacttatggcaaaaggaaaaaaaaaaaagttaaattaccttggcggaaaatggctcatcagcagccttttctggaactaatgaagccacagctttcgcatatcctataatctatacttgggatcacccaggctatttggactttacatagttttctgtttttgccctcactgggcaagtagctcttgaaagcattgctgcatactgtggatggggtccagcagccctaacccatgcttttgatgtatcaaaatggtttatttgactcctatagaataatgcccattgaaaaagatacatttcttatacttactcttggacaagtgggtaactggcatcttactcaactgactttatagtacgtatgtttagatagcattacttacggaagatggggaaaatctacctacaagggactgtgttttgtttgataagacaattgtgtcagcaccttgcatactcctaggttctactctggtcctttgactaagtaatttaaacccatctctccagggagaactcagtgtaaccccgaaatgttgatgtttctgtcctttacaagtgagggccaaattgttttccctggttggtttcaaatactttttctgcaaaatatatttttgcttcttcttaatcatggaacattaagctgaagcataaatgcatccctcataaaagtcacctcctgtgtcactgagatgaaaacaaaaaacagaaggtctggtcggattttaaatgatcatgagattctaattatatgaataaagaggaaaaaataggcatttacccacataaggagaaataatgagaaataattttactaaagaatagactgaccactagtcttctaaattttataatatcttctaccctgctacctaaaggtttattatgagaaagaatgagatgaattttgatgtttataactattctttgatctaaaaaaattattattgaactaaatatcccaatttctaattattactaatagattttaatgcacactcaaaagttacgcaaaaacatactctttgcatgggtataggctaatgattatctctggagactgctccgaagcattcataattaaattaatgtctatacattacataacatacatgtctatacatacgtaaccgtggctcatcttgcttttctagaaatttttatttttttatttttatttttatcttttacatagctaagtaaaacagaggacttcagatggacaaacacattgatagtagtccccccttatccacaggggacatgttccaagacccccagtcgatacctgaaactgcagatagtactgaaccttatatatactatatacttttttcctatctatacaaacctataataaagtttaatttataaattaggcacaataagagattaacaataataataataaaattaaaatattataacagcatactgtaaaaagagttccgtgaatgtaacgtctctttcaaaatatctttctatactgtactcatctattttcagacttcagttgattgttggcaactgaaactggaaaatgaaactgtggataaggaagggattctgtatttatcagtagggtaaagagggaaaaatgaaatttaggctcaagaaagcagaaggaataagtaaatataaaaacaaactgaggacttctctgcttgaacatctctgacataaggtcagaaggacttgctagagttctacttaaatgaaccaggttaaagtggcatttctgtgcctttactatttttacaagcaatttttaaacatttaattttataatcacctgtaagaagtacaatatttgcagagaacagagttgagactctggctgtagacatgtaatatttgtggctggatctgcagggttcaggtgtagtgtattcactgagtaacaaatgtgacagcaatgtagttttcagtcattcactgtcttgaaaatctggttgattttcagtcattttcttgaaaatatggttgaaaatctctgtacctctgttactataagataaaatatccttggctaaaatggtgaattttgaggtgtaatttttctaaaatgatttcttgcctaagtaaatgtcattatgtgtttagctttacacataactgcacattgttctacagagggttagtctttgtgcatgtatctttcagagctttatttttagtaggaaactgccatcaggatttgtttctacctcttagcatttcagtttccacacctgtaaaatggatatgtaacagtactcacttcatggagtttctatgaggattaggtagattattacatgccaaggatttagaacactacttgacacaataaatattgtgctgctatgtcttctcatccttctttttttttttttttttttttgagatggagtctcgctctgtcacccaggctggagtgtagtggcacggtctcgattcactgcagtctctgcctcctgggttcaagcaattctcttcctaccaaatagctaggagtacaggcacgtgccaccacacctggctaatttttttttgtatttttagtagagacagggttttgctatgttggccaggctgtggtctcaaactcctgacctcatgatccacccacctcagcctcccaaagtgctgggattcacaggcgtgagccaccgcacccaggcttatccttcttattatcagtcatatctggtttggttttggtttgggtttcctggggacttctcagatggagatgaatgaattgtctttcttcgcattcttcatctcccctaattgtaagcacgacctggcatatgattttaggaaaggcagctagatactactacattcttaaaataataacagaagcttcttgccactggaaaaagttattagaataaacaagagatgtatgtcccagactttaatatgcatacacatgattttaaaatgtgaaggaggcaggggagtggcacaagtgcatttttcaatgaatgcttccgttagaaaactaatcatagcctcgaaatacaaaaactgagttccgtatacatcctatatgtttttgcctagcatgtggatgaagtggccttgtatcctcttggacttcacctcaacttattcttacaataattcatatttactatgtattgtcatgagtttgtttctgccaatactaagagcagcctgtgaatacaataataacagagaaatggataatgagtaggccctaaagtatgggtcacaaggcctaggatttagttccagctttaccatttgctgtttatccttaatgaagtctcttaagctttcctcatctataataattcttaaaaatttgtttaataatgtttaatatttgaaaatattttctgaactgttcatctttaatgaaatgtaaagtagtatagtagtgtttttgttaccagtgataatattaagctttaagagagtggcagaaatcctcttaagtctttggtttgaacagtggaggagacttggcatgaagcgaagaggattaaaacaagtggaacaagttcaagagatagaaatggactcgacacaagtgaggcaagctcaaagacttggattaggtctttattcattctacagaaattattgcatgccttggtttcttgaaatataagtgattgttgtattaaattagacaatacatataaagtacatagtacagtgcctgacatccagaaaacacttagtaagaattagtattagaatggctccaccatttaatatatatgtgactttttaccagtcactctaagtttgttttctcattttaaaaacagaataataattgccacctcataggagagttgtaaggactatataaattatagcatttagcacacttggtatatacagtatttattaaatgacagatgctattagtggcagtagtagtagtagttactgtagctgcaacagcaacactatttgctttgtgcctgacactgggctagcactggagaatattggaaattattttatatggctgacatatagagagatgagcctcaagaggtaagtagagccttactactgtggggtactaagcatatatagagtttgaatttttatcttgaaggcaatagtaagccattaagggattttttttttaaatcaaaatgcagtataattggatttgtgctttagaaagatccctctgactaaagtttagggagtggatttgagtgaggcaagaggaggaaacaggagacctactagaaagccattacaaaatttcatatgggaaatgatgtttgtctgaagtaaggttagtggcagtagagatggagagaaatcaacaggtgtgagacagattttggagttggattaataagatctagtgatggattgtaggggtagagtgaggcagcaccaggttatgaggatattgatttggctatgaaaaggaataaaaggaatcaggaatttctctcttgatcttcactccctaactaaagcctcttctcgagctacactgaaaaaattgtgttatcccctttcaaaatgcatcttaatgaaaccttttctaagttggaggaaatgcattctgtgattatattcattgtgataaagagtttgcattgaatcattgatgttcatctgaaaaatttgttaatatttttctgtctttctatgacatactccaggctcaaagattgcccctaacaaaatccatgtgtgtacatgtgcacggtgttcacctagatagcctcatccacaactagtacatcttgatttacctaatggtaaatcaaaattgtcacctttccagataaagaagagcatatatttatcaagtgtttactcagagtcctcagctggctcctgggggatgtgtgtgtgtgtgtgtgtgtgtgcgcgtgcgtgcacatgtgtgtgtttgcatgcacacaagcatgcaaagatgaaacaaatggagtaattttaaggagcttataatctaatagagatgaaaagacatgtaaatacataattataaaacaggctgatggtgttagggacacgataatttatgtgttctacatccacttatatggtacttttaacattaatctgtgtttccatgtctgtctcctaaataagactctgagctccttgagggtagagactatttcattcattttttttttctgaaggtggacaggattctttttattttttatccaagtagcctaaatgacaaaagaccagtatccgcattcatttccacacagtcctaattcatgacaaatgtacttattttctgccatatagcctctttcctaattaagagaaccacatcctattcctaagttattactattaatgacagcacaggtatcaaacttcaaggtgacttgtttgggcacccctttttcttttgttttggctaacaccttacttgtatcatttatgagcccccaccagtcctcagtccttaatcttatttcacaaactatggtcatgggaggctcagatgggtcataacacacatcaggttggtcatttcctgggctacataccttgtatagaatagtattatacaaacaagttctttttagagtcctggtacacttataataaccataaaataataggactgtagcaactttttgtcctacctcagtgacttgatgtatacactggaaacagtcctcagtctgaggaaggtcagttgaagtccttactgtacaagtccaaattttaaggaaaatgagtcccgtgatgagttttctcatgcttcggccatgcgtggaccagtcagcttccgggtgtgactggagcagggcttgtcatccttttcagagtcactttgtaggcgttagcgaagctcccgtccacgtacagctcacagtctactgatgttcaaggatggtctcggaggttgagcctgctagaataaactgagtccaacacctctacacagttatgttcaactgggctctctgataccgggagcaaggtggtggggtttagggtgttgcaaacttcagtggttatgcggggattttcatatagcaagctttggtacttggttaatctggcatttgttaaccaatgatgtcctttgatagtcattaaagttaccacagtatggggggcctttatattcaggttttgcccaagggttagtttatctgcttcttgtgctaacaggaccattgctgccagggcccttagacatggggccaggctttggaaaccccatctagttgttttgagagataggccactggccttggccagggccccacagtttgggttaaaactccagctgccatttttttctctttctgacacatagggtgtaaagggttttgacagttcaggtagccccagggctggggccgacatgagtttttcttttaactcatgaaaagcttgttgctattggttataatagatgtagtttatccaatctacatttttattaactgtcacccaccaaaatattgactcaaatcctgcctctatttgatttcaagctttaaattgatgtggtattccccgtgggactccaattgcgtctaaatagacgtgagagttgaaagacccataaggggctttctcgcacgatgtcttatttttcctccctctgattgatgaaatgtcagggtgaaagggatagctaattggactaaaatacaagtgccactccagttattcagcagagtgcccagtaaaggtccaccacaataccatcacacatccgctcggggatgaacaagagctgactgattgataagctcttgacaattcttaagctcactgcatcccttcaggtctccaaggaagctaagtttcctccctgtcgtgagagacacgaagtgaacttagtgttggaagagggaggctggatggccctcggggactgacctgcaaggtgctggacattgggatatagcagagagagcttggcacgacttattactccaggttgtggaatcctggaagagagctaccatgcagcccacgcctggtcgactggaggaccaccttagtggaaaggggacagtctgggcctctggcctgccatgtgcacaagcataataattgcttttgtttaacgtgcagatggaatatttgatcgactccaaccaggcatttgcatcttggtatcctgttttaattgccaaagtttgttttaagtctttaacttttatgatcctcgagtaaaatgaatgtacgattttaggaaattacaaaaactggttggggcagtccatccttgctctttagtggtccacagaatgttggaccaactacagcataaaagctctacattggggggcaagaatcctggttgacactagggtctttatcaaaatttccctggattaaatggtcctaatttactaatgcccagtctgagaagagtcaggagggacagaggtacttttctgaagtagagagctgtctttgacttggcaggtccccacagggtataacaaggcaagcattaaatgcaatagtttgaggcgaaattgacttggttatgttaataactagatggtcagcaatagagcgagggaagaagaaagagtaatagaatagatgaaagagttaaatttttcttagctttagtttgataaggttttcccctgggactgtggcccacgactctggaggtgggggcgctttgactcgggtgtgatgagtccatcccttttccgctctacgaacggcagtctcagtggttaacagcacaaggtagggtccttctgaggctggcttgagtttttcttctttccaccctttgatgagaaggtgatcttcaggctggtgctggtttactggaaattctaggggtggtacctgtgctaaaagacttttagttttgagggaaaggaaagtggaagataaaccaagtatataatttctaagaaattgaccttttgttttaaatgtggggacatcagcagtggactttattgtccttggtgccttcctactgagaaatttcctttagcacctatttttattagtttttagaccaaagaagccaaacaccattttatatctgacagtgcttcctgtatgatttttataccagataagctaaatttcaccttttactgtgctattactgtgctattaatgttaaacttagttttaataaactttgtagacatttattcaatttttaatgtcagaccataaggtaagatttttatagactctttttaaccttttataatctttgttaaagagcaggttagtgctttaagaaaaacccattgtgtttttactttaatgtccagttcacagaaaaactggatgatacccctttaactttagccaatatgtttacacacagaattttctttacaattaacgttttaaaacttgcttaaatcttcaaaacaatatatactttttaaccttttaatgtaggtaaaaatttacattgttatgcctccttataatccttttaccaaaggtatattttactttccttatacaacttgcacataaactgttttgttttacattcaggaggcctagttacttttaaattatacaacatttcttgcataaattctttttttaataacatttttttctttcacgactttcgcagacaatttttcgacatgcctcaactttctgacttattacaaacatttatttctttaaataaccagttaatttatttcaggacaagaacttcccatataacactctttttacataaattctgcccccccctttttttcccttttttttccgaagatgataaccattcttttccaaagcgaacttcttttatgtctgtggactagactgtcttaaggccacaggattagaagttaccataatacatgttacactgttaacttttagcaaactttacttttgttgaaaaccttttaagtttgggatttcaattatcctttgctattaataagaccttgttcagtccaaattaacttagaattggtatagatgttttttttttttttccttcaattacctgggaggaaccatcgattgtcctgtcctgaagggagttcctcctaggtctggtcagacctttgtatggtaattaagatttagatcccctgtaaggaaacctgctgggttaagggaattttcagtggttaatgttaaatcatccttttttttttttccttaggatacttctgaactggtgagatgtgctcacaatgaggtttcctctaaaagttattttttttactttcttctgttagcaaagcagttgcctacagattgaatgcttctgggccatccacaggttactgggttaaggatttttgataggaagtcctcagtgctttcgggaatacgcccttgtttacactgacaacaaagtggtattagagtgttacagggttacggagaatacctttaattatcaattataggttttaaatttaccttggcttttaaaggaatagggtacactgtttttttttccttaacttctggtatatttctctctttctctctttctttctctctttgactttctgtctctctctttttgactttgcttttgcctctgtctctttctgcctctctgcctctctctttctctctctctctctctctccttgactccctctttgtctctctgtctcttcctctctctctctttgcccctttttctctctctttcctcctctgtctctctctgctggtctttccttgtctctgccagccacttatgctgctgttctctcaaccactggtgaggggggtgtggggtctaaaaccagctgtaaccaagggtctatgtatgggaactcatctgggtgccctggcttacaggttaccttgtgccatacctttgaaacaagggacctgtccaggcttccttctgatggccaacccacctctaatgctggccagtctatttcacacaaagttctaagttttcctggtgtcatagtaacaccataatctcccttaaatccttccttgaaatttttcaacatagttcctagtggggtgggcttactttgtgcctgacccatgcttcttcgagacaaaacaccatgctcacaccacaaaacaaagaacgagtaaaaagggcacacacacacacttttacagtttacaccaaactcagaatcaaaaccaaaatcagagtatccagaaatccaagccaggtcaaaaacaaaaccaaagtatcaagcaatccaagtcaagtcaaaaacaaaaaccaaagtgccggtacaggcagaccgtgggtgatcaggccacgcttccactcaaatggagtgggcaagttccaaagactagtcttaccaagtttcagatgtccagactccaagtgccagttccttcccggtgttcagccactgcgttgatcgtccacgggggcctgccacgtgctcctctggcgaggcgttccaccaggccaattgcctacccaggagtgctctcaggatccgcatcggccaagctggctggagtgccccatagggatgctccacagggcaggcctaagccacctaaggggctgcctcgaccgtccgactgtctgttaatcacctcgcttcccggtcagggaaccaagaaatgtagcagaacaagccacgggcaaaacccctcagacaccgagttaaagaaggaagggctttattcggccaggagcttcagcaagactcacgtctccaacagccgagctcctatttcattcatttttatatctctccagtctagtgtagttcctgtaggagatctggaaatgtttctcgtatgaaaggtatatatacagtgcttccagatgttgtgggtaaggtcctcacttgattgaggggaaggaagtatagatttttttttttttttgagacagaatcttgctctgtctctaggctggagtgcagtggtgcaatctcggctcactgcaacctccgcctcctggttcaagcacttctcctgcctcagcctcccaagtagctggggctacagacacacaccaccacacccagctaatttttgtatttttagtagagacagggtttcaccatgttggccaggatggtcttgatctcttgacctcttgatctgcccacctcggcctcccaaagtgctgggattacaggcgtaagctgccgtgcctggcctgaattacatattttaaggaagggtccagacatacaggggagaaagctggaagactcaagtcagctaccatgttaaataggtgacttctagaaacacctggagatgaggtacataagatttgtgacatagggaaaaacatccttccctcagtatgacgaacaaacagacccagttctaaagaacaacttccttagatttgtaactgatggatggggaaaagtccagagattttctgtgcaagaaaccttcacctgtgaccaagtattcttagcgacccgacataagaatagtttatctaaatcaaccctgaacttgcttcacagacacaagttcttttggtctactaataacatacaaattccttttagaagaccacacccaccaagtaggaaacgaaggtttccacattccaaaaattagcagaatcttatcacagctgacggggctaaggatagagaggaatagaggaatcaacctatccccaatagagcaagaaaatgagttagccaagaaaagcaaatgttggatttagctcttcaagaccttaagaaaaagataaaagtacctctgcttcaaaacttttaaggaacgttgtatctgagagactttgcctagaacttagtatatgtgtatattctatactaaaacacacatttacatgaagaaagactttcttcaaattttcctctgtctttaaactgtcgtgattcattactatttgttttatttccagtgtactccaaaatgtggtccaggattcaagcatcggattgttctgtgcaagagcagtgacctttctaagacattcccagctgcacaatgtccagaggaaagcaaacctcctgtccgcatccgctgcagtttgggccgctgccctcctcctcgctgggtcacaggagactggggccaggtaaggcgtttgtactgtgggctcctgctgaaatagcaccttgagacacaaacctgaggttccttgtgtgatcattgtaagggcttgagagatgagtaagaattaacacgtagaagtctaagtatgaggcatgagtgtgaaacagtgcacaaaccacagccaccacatgtggacacatacagagtgagccagtgattctcccacacccacacacttcccacttcagattctattcttcagatccattgtggttaaaattaaaagagaaatagaataaccgatagagatctgaacaagctaccaaaactttggattctagtcccagctgtcaactgaaaaggaacaaatcagttaacagcagtgtcttcattttcccacttgcaaaatagagataattactcttttttttttttcttttgagatggagtctcactctgtcgctcaggctggagtgcagtggcgcgatctcggctcactgcaagctctgcctcctgggttcaggccatcctcctgcctcagcctcccgagtagctgggactacaggtgcctgccactacgcccagctaattttttgtatttttagtagagacagggactcaccatcttagccaggatggtctcgatctcctgacctcgtgatccgcccgcctcggcctcccaaagtgctgggattacaggtgtgagccaccgcgcctggccaaaaatatatatatttttaaggctcttcatgaatatccttacaagtcctgtgggtgctttcagagtttttgcaaacaaatccaacagggcttcaatgtgttgaccctgtaaacatcaccatcccctgtgttggcaccagttacttcctcatgcctttgattccaaatttcataggctttctggtattctcgatggcaggcccatagattaacccagcttcattcttcagcctcagcagctgatcagtcccaagtgaaactaagcctctcggacagtaacttcagttctgaagtgactgaatcccagagtagatgcaaaaggagagggagacacgctcatttgagaacacagactacttctcaggtttgtgtggctggcaatcccttagaaaacctgagggacttatttaagctctttttttttttaaatgaccccatcaccaggctccacgcctgtcactgctattacactgaactaatagtttaatcacatacaggacactccaataagccatcaggttatttacctgcacacctataataaatagggagcaatagtgatttcctagccctacaatctctcattattctacttcatcacaaggattttctcatgacactcctgctagagttcaccagccttgccgggaattgttggagtgatagcaagaaatctctatgtattatcttctgggaagtatattgagtctgtttgctagggtaataacatgatctttgactttccaaaccagtttgatagtagaatgacctaatcatacacctctcaaaaatgaaccacatgtgggctttaaaagttaatattgtggccaggcgcgatggctcacacctgtaatcccaggattttgggaggctgaggcgggcagatcacgaggtcaggagattgagaccatgctggctaagatggtgaaaccccgtctctactaaaaatacaaaaaattagccggatgtggtggcgggtgcctgtagtcccagctactcgggaggctgaggcaggagaatggtgtgaacccgggaggcagagcttgcagtgggttgagattgtgccactgcactccagcctgagcgacagagcgagactctgtctcaaaaaaaaaaaaaattaatattgtggctgggcgtggtggctcatgcctgtaatcccagcactttgggaggccaaggcaggaggattgcttgaggtcaggttcgagaccagcctggccaacatagcaagacgctgtgtctcaaaagaaaaaaaaaaaagttcatattgtgttgtatttgaaatgacatagtatattttttacctcctgaaaattgttgagattaatattttgtttctttgtgtctttggatttagtgttctgctcagtgtggccttggacagcagatgagaactgtgcagtgtctctcctacaccggacaggcatctagtgactgtctagaaactgttcggcctccatcaatgcagcagtgtgaaagcaaatgtgacagtacccccatttctaatactgaaggtgagttttccatggaggaggggcctgtggtttctaatgacccacctttactgttcccagggtctgaagagcacagtaaacccactactgtagtgtagtttgagtagagcatttgtgaaagctgcttatatgcagacagcaatcaggaaacccaagttttttcctgactttttaagtaactttatgaccttgttaagtcacttaacctctctggagctaagtttatctataaaataagaaattggagtagataatctctaagatcatatccagccttgtattctaagtttgatttatagtaggactttagagctgtttcctaatgaactactcttgaagtgcaaacttctgtttctttttggatatgacagtggatctctatcattctgaagatttaaattcattcttgttatacatataatgaaagcatatgtttgaaactacttgcattttaaatgctaattttcttatcgtagaaaagtagaaaaataattatgtagctgtttataaaggtggacaaagttctttgtgctctggaatttctctttctgttttgtttttgtttttgtttttgtttttaattatactttaagttttagggtacatgtgcacattgtgcaggttagttacatatgtatacatgtgccatgctggtgcgctgcacccactaactcatcatctagcattaggtatatctcccaatgctatccctcccccctcccccctccccaccacagtccccagagtgtgatattccccttcctgtgtccatgtgatctcattgttcaattcccacctatgagtgagaatatgcagtgtttggttttttgatcttgcgatagtttactgagaatgatggtttccaatttcatccatgtccctacaaaggacatgaactcatcattttttatgtctgcatagtattccatggtgtatatgtgccacattttcttaatccagtctatcattgttggacatttgggttggttccaagtctttgctattctgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcagctgttgtttcctgactttttaatgattgccattctaactggtgtgagatgatatctcatagtggttttgatttgcatttctctgatggccactgatgatgagcattttttcatgtgttttgtggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaacgcctaggttttcttctagggtttttatggttttaggtctaacgtttaaatctttaatccatcttgaattgatttttgtataagatgtaaggaagggatccagtttcagctttctacatatggctagccagttttcccagcaccatttattaaatagggaatcctttccccattgcttgtttttctaaggtttgtcaaagatcagatagttgtaggtaagcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctatccatgagcatggaatgttcttccatttgtttgtatcctcttttatttccttgagcagtggtttgtagttctccttgaagaggtccttcacatcccttgtgagttgcattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaatattctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttggtcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctctgtgtacctctggtagaattcggctgtgaatccatctggtcctggactctttttggttggtaaactattgattattgccccaatttcagctcctgttattggtctattcagagattcaacttcttcctggtttagtcttgggagggtgtatgtgtcgaggaagttatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcatgccttctgctagcttttgaatgtgtttgctcttgcttttctagttcttttaattgtgatgttagggtgtcaattttggatctttcctgctttctcttgtgcgcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcatttttttgttttccatttgcttggtagatcttcctccatccttttattttgagcctatgtgtgtctctgcacatgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggttattttgttcattagttgatgcagtttcttcctagtctcgatggtctttacattttggcatgattttgcagcggctggtaccggttgttcctttccatgtttagcgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatcagctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacttagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggttttcagtgtggatgtcctttctgtttgttagttttccttctaacagacaggaccctcagctgcaggtctgttggaataccctgcagtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcaatttgatctcagactgctgtgctagcaatcagcgagactccgtgggcgtaggaccctccgagccaggtgcgggatataatctcctggtgcgccgttttttaagccggtctgaaaagcgcaatattcgggtgggagtgacccgattttccagctgcgtccatcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagattaacccggtacctcagatggaaatgcagaaatcacccgtcttctgcgtcgctcacgctgggagctgttgaccagagctgttcctattcggccatcttggctcctccccctctgtctgttttttattcattgggaaatccctttattaacagcagatgccccaccccccggccacaatcgtgactttttaaaatctgttatttaaatgaaagtaatttctttattcttttaggcattcattaggaattgcttgaatgctactacgtgcgagtcactatgacagaaattatcaagaatgtgaagacaaacatggcatagtgcagaagtttagactgccttctcacatgaaaatacaggcagggtcaaatatatgcacatgaacaacacctgaagccgcaaatttaaattataaggccctgaaaaaacctatcattaatatatagtcaaataatttgttaatatttttcaagtgaaaactatatgtttataaacctcttcaagagagatctctttcttttgatcaactctgtctaattcaaaggattcttaaaaataatactcactatttaaaagtgttttcttgggaattttaagaaagtgatcttgtatgacaagatccagacaccttgcatctttgcaaatggtctgtttttttatacttaagcctcaacacaatgcacttattatacacataatttactctttcaaaatgtataaccctatgctacattaattaaaaatcacaactttaaattttgcagaatctctggctttactgctacttcttttttgtccctttagattctggaaatctagctttccctctcttgagaagggctcaaaatccataacaaacaaaagtatttttcttggaaaaaaattatcttttaaattatctttaaaaaaaaaaatctcttagctgggtgtggtggctcacatctgtaatctcagcactttcagagggttgagttgggaggatcacttgagcccaggagttcaagaccatgctgggcagcatagtgagacactgtctctacaaaaaataaaaaagttagctaggcatggtggtatgtggctgtagtcatagctccttgggaggctgaggcaggaggatcacttgaactcaggaagttgaggctgcagtgagccctgatcatgccactgcactccagccagggcaacagactgagactctgtctcagaaaaacccccccaaaacaaaacagaacaaaatctgtcttctgtaagactccagcaaatgatttcttttatccattgtaagttagcaatagatcacatgagtttggggttctctttttctttcagaattggaagatacaaggttaaggtaggagagaggatataactatcatattaaattattctgtgttgggtattatgttaggccctttatatatattatctgtcttatatatctcacatacacaaatagatctctctctgcaagtgtgtgtgtgtgtgtgtgtgtgtgtgtgtgtgtgtgtgtagtatcttatataatcctgacaacaagcttctaagagttggtattattaatgaagaaagtgaggcacaggggaagatagtgatttgcccagtttaaagattaggaagtagtagagtcaggatctgaacccacatttggtagggtccaagtacctgtccatttcaactatatttgcatgctattcttaatttagtctttaaagtagggtattttgacataaaagcaagagtttctgattttgaagtaaaacatttctggcatgactgtcagcctaattcaatagattaagcctaagtcattgctgaaagaactgccttttgacatgcctaaaacaatatatctgtggaagttatgctcataccttcatttcagacaattttaataatttctccaaaatcttctctataatgcataatcattatagataaactttgcagtttatgtataataagtttcaaaactattttcagagtaggcagaatatcatttgtacctgtgctaatgtctgccttaagggaattgtcttaaaatggatacgtgttaatttgaggtttcttgggttatttggagaaacacctcatggttatttcatctacctggctaaatcgctttttattaatattattctaaagtaagcagtaaaaacaatatatttagacttctcagtaaaggaggaaatttttaggaaattattaatcctgcaaagtatgactcatgttagaatcattattatctaaagctgtcaactcatttaaaagaaagaagataactctctttacaaaattagatttaaagtacaaatgatacatctgtcataacttgttttgtgttccctttaatttcccaatagcatatatggaatgcatttaaatatctgaaactatttgttcatttaatcagcagctaattactgaatgctttctgtggccagcctctgctatttattatggaaaatttaaatatatttataagttcatagtctttcagggcaaatacttaaatgaaaatttttttaattcaaaaaaatttaagaaaggaaggggaaatgtgttgtgtggagcagtttgcacaagtgctcaaatgaaggaccaatgaggtaacattttccatcaaggcaggcttcatagactaagtaatcagtaagccatctatataacacatagttggaaaaacccagtgtgtaccttgggaaaagtgaataaaacattatgagctgaattacaagttttaatccatagagatatggaatggacggataacatagatttcaaaagagacaaggaggccgggcacggtggctcacgcctgcaatctcaacattttgggaggccaaggggagaggattgcttgagcccaggagtttgacaccagcctgggcaacatagggagacaccttctctacaaaaaatttaaaaactagctgggtatggtggcacgcatctgtagtccagctacttgggaggcttaggtaggaggatcacttgagtttgggaggtcgaggttgcagtgagccatgatcacaccattgcactccagccagggtgacagagtgagactctgtctcaaaataaataaataaataaaaagagagagagaagaggttctagtgtgaaaataatgcaaacgtggtctgttacggtttgtaggaggcagatcaaggaagaaaagaggccgggcatggtggctcacgcctataatcccagcactttgggaggctgaggtgggtggatcacatgagatcaggagttcaagaccagcctgaccaacatggagaaaccctgtctctactaaaaatacaaaattatccgggcatggtggcacatgcctgtaatcccagctacttgggaggctgaggcaggagaattgcttgaatttgggaggcagaagttgcggtcagctgagatcacgccattgcactccagcctgggcaacaagagcaaaactctgtctcaaaaaaaaaaaaaaaatggaggaaagaaatgccttttagcaaggaaaagttaagaagaaagttggaggccgggcgcggtggctcacgcctgtaatcccagcactttgggagggcgaggcgggcagatcacgaggtcaggagattgagaccatcctgcctaacatggtgaaaccccatctctactaaaaacaaaaaattagccgggcgtggtggtgggcacctgtagtcccagctactcgggaggctgaggctggagaatggcgtgaacccgggaggcggagcttgcagtgagccgagattgcgccactgcactccagcctgggcgacagagcgagactcctctcaaaaaaaaaaaaaaaagaaagtcggagaaggagcagtttctggttaatgcaggagagtggaagaggtggaagaggatcccctttcctccagcacagtcagattcccatgactcatagtacgaggctactgaaaaaccacttcaactctaccccaagacagggcaggatttggggagacgtattgagatctaaaatagtctttcagttgaatctctatgaattaaatgggccacagatagaatgttgagaattgttttgactaccaaggtttgggtaatggtctccctcctatcagtatttcattatgaaaaaaattagaagtttcaaacatacagcaaagctgaaagaattttacagtgaacatccaccatctagattatattacttttaatggcaaaaactgaaattacttttgcaccaaaccatagcattatcatttactgaacatgctttttcatatatgtgcatatatctgcccatccattcctcaagcttatgattttttaaataacatcctacattcatccaatcattaatttatttacttagcaaacatacttaccatgtgctaggcaccaagactatgaacgcaatacaacaggttccctgttctcaaaggtttagtaggattggcaacatacaaataattttgacaatatgagcagtactgttccaggcgtggcaagaagtgaccatgagtgcacagaggagcaggtaatcagcagaagcatcacagagaaggcaagctgagctggacatggaaggtaggaaacagtttacccagaagacattgaaatgcagggcattcctgacagaggacaagtgtgtgcagtcacaggggcatggaggcagtttgctatcgctgcggtgggttgggagatgagcaggcagtgcagatgaggctacagagagagaggcagggacttggttttggagactccacatgtagtggaaggaagctaggactctatctttgggttatagggaacaagtgaaaaaaaactggggtttgatatgctcaggatgacagaagggtaacgaagcagagggagggcagccttgtgtgggagtagaatgagaaagaatttttctaagagtccaggcaagagaggatggaggcgtgaactaaggcagatattgtagggattaaaaggagagtgatgaactggggggaaaataataaaatgaaaggagaataaaaagagcctgatgaacagttagacatggagatgagagatatggaggcgttcaggatgactcccacatttcagatttaggtaactgtgtaccatcattaatcatgaaggaattcaggcatctgtagggaaattaaacacattagtcctctgaagctttaataagataatggaatttgaataagattaaaaaataaaataaattgagagagattgaagaaatggagggaggtcaagcaacaaatgataataaggaaatcagaagcagggtttcaaaaaattaaaatagcaagagggaaatgggaggaagaagaagggagatacaatttgctgtgttcaacatctgctttagttttttgtttctgaaagcctttggcaaagggttaaaacattataggcatgatcttgacagactgccactgatgagggtaacactatgttgctgctaaaagtgaattaaagccaccctgggtatcagtacatttgcaatactactcagagtaattttttgaagtacatatgtcagttgggactaacctcctcaagctcacctgaaattctatccaaaatgccattttattcatctttcatgcagtttcaagttcccttgtagtttatatagtgagtcttttcagcttctcaatagtacaaggaactctgtcacagagtatttattgctgtcaggtcgtgattcatggtgtgccatgggctggtaaccaatccaggaaaggtgtggttagtgtacaatggtttaccagcccaggatgtctaatagtggctttggtggctcttagactccctcatgtaaatagctctgggaaagcttaggcagctccagaaatctcaaaccaagaattttggtcaaactagctactgcatttgggttttaatgtggaacctgatgtattaaaatcagtaaaggaacgataaaggtcatttgaaggctttggtttcaaagaggtgaggaaggccagtttttttctttaccacttcaaagagttcgtaattcacttagcatgcaggttcacattcctggctgtctggtctggagggaaccctggatttgggttgagattataccacctccaggttgaatgtgggtggcatccagggaataagactaaataaaaagaaacttgagaaagcaaagagagaaaggaatggtctagtctatgggaaattgaaatcagtgtaaagttcgatagctgatatcatcttgcttcaaggataaaaataagctggtgtactgttctgttacaatgaataatgttaggttcccaagcaaaagttgccatttcatccttttctagtctgaatatgtaaaatgtcaaggggtcaagtacaactttattaggagaagtacactgagttcacattccccaccccaactcctgtgccacgcatgcacaacctttgctatctcacttctcatcaggttctgcatttccatgggcagtttgtcagaagcacagctgtttgtactttttaaatccaaaagatagacctttaggtgcttaagtcataactcttcacttactgttttcttcttctgaaccacataaggagtttacagaaacagagggcatgcattctccaaagagagatgctgatggtccaacctggtcatgaagggtatctcccaactccagtgagacaagtaggcaagctttgtaacattcagtgacataaatgcaaaagccctgcatttgaggacttggtcttgtatttcttggaccaaatcaagccttcaaagtcacaattaatctgaatctaattgcattctaaattcataaacctctattcagtatattttgaaagcaagtcttttaggtcagagttttgaaagattaatgtaaagcacctggggaaaaactcattggcacatcaatgttaagtagattcatgtgttgcctatgaaacaggttgtctaattttatcattcaactctaccaaaacccagattaccaatgagaaccactccagcatgcctggcaaattacttcagattctaataatggatccagttcacatttcagcgcctaggggctggctttcagcccttgatgtcttcccaagtctctctgagaagaatttgggaattctccgtaaagtcattcccaccagaagtctctagtcctgggtaaagtgtaacttttctttcaggggtggagtggggtgtaaaaagaggagagaataattaggtttacaaaatgttaactagaaaccacaagataaggacctcttacctttccaatatcctcacaggaaaagggtagaaagggtgtcttgtcattcttctcctaggagagtacttagctggtacatgatgatagtcgaagagaaaataagcctccttcatcttaaaatccttgacccactggcttagattccactacttagaaagcagtaagtagatagatataagtgtgtttgcatgaagaaagtatgacagtaaagctcaaaccttcaaaacaaattaactacagagtgattataataccaaaaaaacctgaaactaagtaattcttttgaatggacctcttagtattatttatttgctgcacattatgcactacttgggtatagaggaattttgaatttttaaacattttaagtatcagctagaaatcaatgccaactgtaaatcattcagaaattaaaacagaacatttgttattgttttaatttcaatgggatatgtgatttaacttatatacagcttttccagaatatttttggtggtggtggtggtttttttttggtgttttttgtttttgtttttttggttttttgtttgttttgttttgttttcgtttttttgtgttttttttaaacaatagtaagttgtactgctcaagggtagaagagaaaaggctttcataatttcactgggctttaaggatgaggcagattaatgaaataagttttataattaaggcctctcaacgacatcagcataattgcaatgagcacagcaaatcagtcctctctagctaagctaaaagtggtagatgggttgaatgccccaatataatttaaaactggtactaatattttgaagattactttcagttttctgtaataatggggctttaaaacttcttggtgtgtctaaaatcaccttttcacttgtgtacttttacaaaatttgaggaggaatatatagtgacaaaaagtataaagggataattcaggctattctaaataattcagatgctattctggaaacctccttttaaaaaacatagatccccttctctaaggtggaacagcaaactcttaaagaaacgaaacctgactatgatgctccaagttgatttatcagtgttgtcagccaagaatacagagtcagagacaggtagaaacttcttgcgtttagatgctaagaatattgctgaaatagaatggctctggagtcagataaacctgttcttagaccaactagctgtgtgacccagcatgagtttcataatctttttgagcttatgttttgctgtctatataaagctgacattttatatacggtcatggactgtataatgatgttttggtcaacaacagactacatatacaaaggtggtcctataagattataatactatatttttactggatcttttctatgttatatatttagatacacaaatacttaccactgtgttccaactgcctacaatattcagtatagtaatatgctgtgcaggtttgtagcccaggagcaataggctataccatgtagcccaggtgtacaataggctataccatctaggtttgtgaaagtacactctaagatgtttgcacattgacaaaatcacctaacaatgcatttctcagagaatatccccatcattgagcaacacatgactgaacttaaaaggattaacatatatatataatatatgtttatgttgtgccttacacaaatgatatgcttgataaattataatttttaatgctgtcactactaaattaagctcttgtggagttaaaagagaataaaagatgagtcgtggttggtgaatagattttcatcaaatctaaagatgtaatgaactgattcttctagtcaggccagttcctagaaggcaaaaccaagaagtaggaaccggatcttccatacagcctaggaatctccatattaatgtttgagtcctgaagtctccagatctcccacaggtctttccccactcctgccctcatcataattttcttgctttctgtttaatagctttctgatattttgcttaaatgcgtaaatgtgtaaccctttctgagactatatttattttgacagggatcccagagaaataatacatgatagttgttctcagaggcagatgttttgctgttaataatgagaactaatgaacaatgcttactctgagccaggtgccatggcacatgcattatctgtattacctcatgcaaacctcacaacatcctatgagcagaccttatcatagtctttattttggagatgaagtatctgagatttagagaggtgaagtaacttggcagaggacaatcaactcctagaagaggcagagccagaattcacccccaggcccacctgaatccagatctcctgcccctaactactgggttgtgttgccgctgcaggcaactcaggggacactcataatcccaacgtccctaagcttgatcctgttcccagaacctacggacttcctgcttccaatcaagttaagtgggaactaacttaacaagggtattgggaagttcagaaaggaacatcctgatagctggcctccagcctgcccacaggctagatactgcctctgaacaaaaggctgtgttctgggcctctgcatgtagagaagagtcttatttctagcactcatctaaggaacaaaatccctgactattcatatttgagttttttgtttgtttgtttgttttttgagacggagtctagctctgtcgcccaggctggagtgaagtagcacaatctcagctcactgcaacctccgcctcccgggttcaagtgattcttgtgtctcagcctcctgagtagctgggactacaggtgtgtgccaccacacctggctaatttttgtatttttagtataaatgcggtttcaccatgttggctaggctggtctcatgctcctgacctcaggtgatccacccacctcagcctcccaaagtgctgagattacaaacgtgagccactgtgcccggccaactatttataatagccttaatgggtgggtgggtaggcaggtgaagggagaagcaatttatgaatattctatttcattcattatgtattataatttaaactggtgaatttacttctaatttgctcaactcagagttttcttggtccagctactcttctaaaaatggagtagtaaatctaatgaagttgttccccaggaaatactccactttgttttgtctgcaaactgacttgtgtctttagggcagtattttcttagtagtagttcaaatattgcatcctcattgagatatttggagagtaactccttgcttcctttctgtcaggcaataaagatactaataactaataattgtaataataatagcaattcagtatcctacacttatcccatacttcctgtgttccaggcactgctgtagttgacgttcgtaaggatacacgtgtagtcttacatgttacacgttgagtgtgggttctctaatcatttctgttttacagatgagaaaacttaagcacaaagaggttaagtgatttgtccctcttctaccttcttccagctaaaacttaaatttactgagaatcctggtgtgaaaagttttaattcatatttctagctattaatctctttgtaagtgaaatgttgagtaagggagctgggtggtggcagagatgttttcagtggatttgggagttccagtttcaaattttaagactttcaccaaaggagcctttaaaaattgagatcaataagattgttatcttcatattcaataataagaactgggaacttttccatgtctttgtacttaattttccatgtttatcatatggctcatgtgataaactacaatgtatctgatctcttagaacttcagtgggtttttgaagccaggaaaaaacaagcaaacaacaaaaactgtctgtaacactgaacattacccactgcccagcctgattcctaattaccttcaacaatttacccaggatgcttcagtataactacctggaaaaatgagggtggaactttggttctagcaggcatgtgaaaatttcattactaagtttacagagtatcctaaagtctccaaacaaaagtgaccagaatactggaaaagaatattattgctagcagtggggttgtatggagccagggggagttctgagaatcaaaggcccatgtccctttctctacactggaccctcatcccaccttctgcaaccagcctcaaggggagatggagaaagaatcatttattcaccttctggctgcaagaactgcagactgcaactgtggcagttctagcactgaggagaaaatacacataggaaaaaagaagaccatgtctcacttccaaattaaaaaaagacatttctacatgtttccataacccacagactgctgccatttgaggccaacccctcaaagctttcttctttgtctagtgtagttgctgaatctaggccactctcagcaatccttttcattcacccaggcccatccccacgcctcacagatgcagagattctctggagacgtgtactttggtatcaaacaatgcaactcatgtttgattttggataaccttgcactgttgaataaaataacccttgagaaagaagcaataaaagtgctgtaagaaaaatgactcatgtttccaagctgtctaaagtgatcacttatcctagcaaatggtaattctttcaagacacagtgggcatacaccatacttataaaaatctggaaggaaagccttgcaaacatttttttaaattgtgttaaaatatatcaaaagaatatttctagtagactgtaccaggcagggtatgcttaaaaacaaaaacaaaaaccacatggaggtcgaagccaaggtggattggcccaaagggggtccttgctgaacatgcaggcccatcggcttgtttatgtacttgtttatgtgcctctaattgttttccattttctgcccccattcgttagagtgcaaagatgtgaataaagtggcttattgcccactggtgctgaagttcaagttctgcagtcgagcatacttcagacagatgtgttgtaagacctgccaaggacactgacccacagaaagccagagagagtgccttgtcatttcatcatggaaatgcatccatcaaagagagccacccagaggaagaggattgatgtccttgcaaatgcattaccctgtggaaaacgtaaccactggtcagccctagctgacaaaatttcaatattattttagcttctgtgaagtgggatttattgatccaaagtgctggacacggtattaggagggaatgccagattggagagatccaaacaacacagggagacttgcttactgtggagcgtttgtgttctttcgagtaaatccaatagcctgtttacctccttggaccattaagataatttttattatggacttagcaatgacactgaatccatttgtatttaaaactgtttaaaatgtagctgttatgacttggtcaactatggaagtgaagaaggttcagaattcttaagtcatagcttaaaaatatttactgtactttatctcactacaacagcaccacaatttaaattataaaacgggctttgaactataatttaaggagcaattataaatcaaaagtaatgaaagtttgtattatttttcttcattccacttaatttccttaggaataatcccctggttctgaacactgctgtgagccatatataaaactatattaaactgaacaataatgaggggcatagtttaaagcagtgcatcagttactgcagctgtgcaagtctataaactcagtgctgaaagactgtggccaacttgccattgtgcaagtaaagctgagatttccattaaaactttaagagaaaaacatttcaatttcatgcagaaaccagacctggggtatggtacagaccaaaggaccaggccctttgctgccaccacacaggatgccttagttcttatttgagtccctccaactcacttgtgtttacatcctccccagccacagcacggcttctgccctttggattgctgcacgtgtgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcccatgggtagtatggcccgagcactgaattcccttgcgccttttcaaagaacagttaacttggtgctaatgtgccctggtgaaataaataaaagatgggcagtttctgtggcattttaggcataggtttgcaatccagatctgattttctccaacataaatatcagctcatgttcttatttcaaaaagatttcttattaccgactaaaagctattttttacctcacctggaaactaccattgtgagggccatcccccaggcactgcacagcaccttggctgatgctggaagaggagggcagtcagtgtcacttctgggatgtgccccagcactgagaacaaaatgcaggcatcccccggggcagcatcagagtgcctttctagagggagccacgcacagaatgtaacaggatgaaacagtttcaagtaagccttgaattgaaacctgagtaggttaaaacaattctatttcatagcacatcacaatactgctgctactctgtagccacccccatggctacatgatgccctattcctaaataataacaatagcattgtcagtggaggctgggccaccatggcagaccttccaaaagtagtgagctacatagactacttagggaaccccagggaaactggtaccctacacctgggagcagtatctgccactgggataaagtcctactaaaaaaggaacggtaaatgtaccctaatgattaaaccccgtgagatacatatgatttccaaatagtccatttcattaggaacttttttgtttgaatgaatgtcacataggtatcctcagtaacacagaacgaaattacctttgtattattgtgattagttgttgcttattattttatactcagtaataatgtggtacactgttaatttttttgcttttgtaaattatattctaatttattgccatgtttcctaacacttgtcctacattcattctcctgcttgtaatgaaaatgaaaaaatcattgtaacacttgatggagtgaaattccacgccaggcacagaatttttttgacatagataatttagtaaaataaaaattcagcttataat

SEQ ID NO: 170 - DNA, 5383 bp, Homo sapiens
tgcagagatgaataaacaaagaggaaccttctcagaagtgagtctggcccaggacccaaagcggcagcaaaggaaacctaaaggcaataaaagctccatttcaggaaccgaacaggaaatattccaagtagaattaaatcttcaaaatccttccctgaatcatcaagggattgataaaatatatgactgccaaggtaaaacattaaatatatcttcaatattattgttctaggatgtgcagttgaatgcagaagggtgaggaaagattagggaatattttgcacttgtgagaatcggagttcataattgggatctaaaattctaatatgaaatcagaagactaattttattcgggcattgttcaactgtaatctgcggtccactcatggaacattatatttactgaaaatgaaatggtatattctgagagaaagattactagagtagatgtagatttagaggccagagtttatcattatgtttccctgtgcatgtgggttctctagtatgtaattctctagtatgtaatcctaatcaactctctatctcccctctctcagtgcctctatttctctccctgcaggtttactgccacctccagagaagctcactgccgaggtcctaggaatcatttgcattgtcctgatggccactgtgttaaaaacaatagttcttattccttgtaagcatattcttgaaagattagaagggaacgttttactttaatgcttggaagtgcctcaaaatatttcatactgttgaagaatagaactcttattttactgtttctttcaaagatctattacttcatttatttttatagaaaaagttaattttattaaagattgtccccattttaaataacacacaaagtttcaaagtaagaaactaaactcattatggtttatctaaatattactttttataaaaatcattttaatttttctgttacagtcctggagcagaacaattcttccccaaatacaagaacccagaaaagtacatttttattttcaaagttctgatattagtacaatttggaaccaaaagtaatatggttattctgaatttttcacaacataaataacaaaatcattgtagagaacatgtgtttattttttgtgtgtaatctatatatatgtatatacatacacacacaaagatattttctgatttcataattcaaaggcatgctatagaagaaaagtatttagaaaaacaaattaatttttgaaagtggttacatcaaatactacaagagatggtgaagtttgtgctaaagtctttaaaaatgtttatttcaaaggtctattactttatatatttttatagaaaaagttaattttattaaagattctccccattttaaataacacacaaagtttcaaagtaagaaactaaactcgttatggtttatctagatatcagtttttataaaaatcattttaatttttctattacagtcctggagcagaacaatttttccccgaatacaagaacgcagaaaggtacatttttattttcaatgttctgatattagtacaatttatattttgtgtctgttttaaggcatgtaaaagaatagtggcatttttgcagaaaataagccataaattcagccataaatatttataaagaaagattatgaggcagcatttccttttctccagtgagtagaaatactcacttaaaatcattctaccctctttctcccaattaacagaggtttcctactgctgtgagatgataccaaataaataattttactattctaaaaaagcagttgtgtatcagcgatgttcaacacatgtgtagagtgtatttttgtttgttcatttgctttatatgggaacacaattagggaggagaggctaacccttgtctgtgcatgtgtgtatgactgactcagttattaaaaatatacatttataagcctgtaaggatgcgtaaatatgttaagcacatatatgtttatactgttgaaatatgtgaactaattttcatttttaaaaattcatattggtctagatagtaattcatatctttattagcacgtcattgtggccattgtcctgaggagtggattacatattccaacagttgttattacattggtaaggaaagaagaacttgggaagagagtttgctggcctgtacttcgaagaactccagtctgctttctatagataatgaagaagaaatggtaagatgtaaatgtttcaaacattttatgaaaagcttccttcagtgaataatacatttgtagaaaacatccatatgtgtgtacatatatttatctcatatattttcaagtgtatgtaatattcaattgattgacttaataatgtttttaaagttatatactgctaatgtacatttattttcagtttttgtttttcaaggaaaaccatgcttctataagtgctttgaatccacaataaattttgctatctaattttatcgggcatgatatcatctggtcatgcagattgatcacaaagtgaatgaatgcatgtgatacaagtcagatcatgaaataaaagtttccagctctagcagttccacccctgtgtatgccctcatcacttatcctgactcctctccaaaacgcagtcttgacttttaatattataaataatgattgcctgttcttgaatttatttatataaagggaatcaagcagtgtgaatttcatgtctttttcaatcctatctgatatttgtgcaattcctccatattattgcagttatcagtagtatgttactgttcactgctgtactatgtacaaagaacagtaagaatccattgagtccttgtctctggatggggaagtgggtctcatgccctcagggacaaagaggaccctaggtggtttacggtgcactgttagtcatggggtccctttgctgatcctcctcatccacagccatcctggtgtctcttggtatgagaaggaagcactttctctagctccatattggtagcaggtctcctggtagatcatccttgccagtggcaccagccttgcctggtattgtggaggggactctccttcgataccctcctcctattgccaggttgggtgtagggaaacagcaggcctaggtcaccttcttctgtcgtgtggaggacttaacatgctcactcggacacttggttgatccctgatgctagggtcccagacaatttcatctttctctttccacctttcagagttctccattgcttttgtctttcattaatcccagagtttatagttgtttttagtcgggagtagcagagagagacgagtctacaccacctggccaggacccctgttattccgcaaaaaccgaatcggataaaaattgagggcttatctagttaaagaatggtgtggtacccagaaaacccaatctgtagcttccatgtcatctatttctgaatgacaacccctcaattcccttctaaatctccaactctgagaaatatagcacaaaaatagattgatttagtcacagtatctggaggaatgaatgcacagtatcaggaaacttattaaaacccttcctgcgtttattctgttaattggagtaactattacattgcaagaattaaaatgtctttattaacatgagaataagaatgaaagtactaagtataaacgttgaagagttcatttaaataaaaaattcaaacatttatgaaagtttttggcactgcaaatagtggttttcaactttaatatattgtttttgtaatgttttcataattattatttaagtgaaaattatttcttttcttttagaaatttctggccagcattttaccttcctcatggattggtgtgtttcgtaacagcagtcatcatccatgggtgacaataaatggtttggctttcaaacataagtaagttcttttgtatggcgctatataaaaaatatatataaaggataaattcagaagaataatatgaataaatttatgtggaatcattgacatgaagaaagatgtggaaagttagtgaaatgttgatataaatattttacaatagaccatagtagtccatatatttcaaccgctcattggtctgctagtaaccttcttggttatcagatggaccaggggtgtcccatctttggcttctgtgggccacgttagaagacgaatagtcttgggccacacatagaatacactaacactaacgatagctgacgagctaaaaaaaaaaaaaaaatcacagaatgttttaagaaagtttacgtatttgtgttgggccgcattcaaagctgtcctgggtcacgtgcggcccatgggcagcgagttggacaacctcgagctggactatcagggaactgcagtgcttgtttttattaaaaagccacgcttacttttttacttaagaatatcctcaaagcacaataatagtgctgttggcatattgctataatttttttattattagttattgttgtcaatctcttattgtgcctaatttataaattaaactttatcacagttatgaatgtgtagagaaaacataatctctctataggttctgcactatctgccatttcaggcatccactggggtcttgaaacatatccctcgtggatgaagagggactactctgttgagtgttcagaataatgactcttactaatattatgaaaaatttaattacccttttccatgaaattcttttcttacagtacatggaaaatgctttcgtctcatgaatcatttgcttaaaatgtaacagaaaatggatttttctccattacaggataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctgatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatcc

SEQ ID NO: 171 - DNA, 8274 bp, Homo sapiens
gcagttatcatagagcacagtccctcacatcacacagctgcagagatgagtaaacaaagaggaaccttctcagaagtgagtctggcccaggacccaaagtggcagcaaaggaaacctaaaggcaataaaagctccatttcaggaaccgaacaggaaatattccaagtagaattaaaccttcaaaatgcttctctgaatcatcaagggattgataaaatatatgactgccaaggtaaaacattaaatatatcttcaatgttattgttctgggatgtgcagttgaatgcagaagggtgaggaaagattagggaatattttacacttgtgagaatcagagttcataaatgggatctaatattctaatatgaaatcagaagactaattttattcaggcattgttcaactgtaatcaactgtaatctgcaatccactcatggaacattacatttactgaaaatgaaatggtatattctgagagaaagattactagagtagatgtagatttagcggccagagtttatcattatgtttccctgtgcatgtgggttctctagtatgtaattctctagtatgtaatcctaatcaactctctatctcccctctctcagtgcctctatttctctccctgcaggtttactgccacctccagaaaagctcactgccgaggtcctaggaatcatttgcattgtcctgatggccactgtgttaaaaacaatagttcttattccttgtaagcatattcttgaaagattagaagggaacgttttactttaatgcttggaagtgcctcaaaatatttcatactgttgaagaatagaactcttattttactgtttctttcaaagatctattacttcatttatttttatagaaaaagttaattttattaaagattgtccccattttaaataacacacaaagtttcaaagtaagaaactaaactcattatggtttatctaaatattactttttataaaaatcattttaatttttctattacagtcctggagcagaacaattcttccccaaatacaagaacccagaaaagtacatttttattttcaaagttctgatattagtacaatttggaaccaaaataatatggttattctgaatttttcacaacataaataacaaaatcattgtagagaacatgtgtttattttttgtgtgtaatctatatatatgtatatacatacacacacaaagatattttctgatttcataattcaaaggcatgctatagaagaaaagtatttagaaaaactaatttttgaaagtggttacatcaaatactacaagagatggtgaagttttgtgctaaagtctttaaaaatgtttatttcaaaggtctattactttatatatttttatagaaaaagttaattttattaaagattctccccattttaaataacacacaaagtttcaaagtaagaaactaaactcattatggtttatctagatatcagtttttataaaaatcattttaatttttctattacagtcctggagcagaacaattcttccccgaatgcaagaacccagaaaggtacatttttattttcaatgctctgatattagtacaatttatattttgtgtctgttttaaggcatgtaaaagaatagtggcatttttgcagaaaataagccataaattcagccataaatatttataaagaaagattatgaggcagcatttccttttctccagtaagtagaaatactcacttaaaatcattctaccctctttctcccaattaacagaagtctcctactgctgtgagatgataccaaataaataattttactattctaaaaaagcagttgtgtatcagtgaggttcaagacatgtgtggagtgtatttttgtttgttggtttgctttatatgggaacacaattaggggagagaggctaacccttttctgtgtatgtgtgtatgactgactcagttattaaaaaatatatacttataagcctgtaaggatgcataaatatgttaagcacatatatgtttatactgttgcaaatatgtgaactaattttcatttttaaaaattcatattggtctagatagtaattcatatctttattagcacgtcattgtggccattgtcctgaggagtggattacatattccaacagttgttattacattggtaaggaaagaagaacttgggaagagagtttgcaggcctgtgcttcaaagaactcttctagtctgctttgtatagataatgaagaagaaatggtaagatgtaaatgtttcaaacattttatgaaaagcttctttcagtgaataatacatttgtagaaaacatccatatgtgtgtacatatatttagcttatatattttcaagtgtatgcattattcagttgattgacttaataatgtttttaaagttatataccgctaatgtacttttattttcagtttttgctttttatggaaaaccatgcttctattaatgctttgaatccacaataaattttactatttaattttattgagcatgatatgatctagtcatgcagattgatcacaaagtgaatgatctcatgtgatacaagtgagatcatgaaataagtttccagctctagcagttccacccctgtgtatgccctcatcacttatcctgactcctctccaaaacactgtcttgacttttgaagttataaataaggtttgcctgttcttgaatttataaaaaacggaattatacagtgtgaatttcatgtctgtctttttcactcctatctgatatttgtggaattcctccatattattgcggttatctgtagtttgttactgttcactgctgtactatgtacaaagaacactaagaattcattctgtcttatgtctctagatggggaagtgagtctcatgccctcaggggcaaagaggaccctggatggtgcattggtagtcgtgggtccctttcctgatcctcctcacccacaaccaccctggtgtctcctggtatgagaaggaagcactttctctagctccgtattggtggcaggtctcctggtagatcatccttgccagtggcaccagccttgcctggtattgtggaggggactctccttcgataccctcctcctattgccaggttgggtgtagggaaacagcaggcctaggtcaccttcttctgtcgtgtggaggacttaacatgctcactcggacacttggttgatccctgatgctagggtcccagacaatttcatctttctctttccacctttcagagttctccattacttttgtctttcattaatcccagagtttatagttgtttttagtagggagtagcagagagagacgagtctacaccacctggccaggacccctgttattccacaaaaaccgaatcggataaaaattgagggcttatctagttaaagaatggtgtggtaccaaggaaacccaatctgtagcttccatgtcatttatttctgaatgacaacccctcaattcccttctaaatctccaactctgagaaatatagcacaaaaatagattgatttagtcacagtatctggagaaatgaatgcacagtatcaggaaacttattaaaacccttcctgtgtttattctgttaattggagtaactattacattgcaagaattaaaatgtctttattaacatgagaataagaatgaaagtactaagtataaacgttgaagagttcatttaaataaaaaattcaaacatttatgaaagtttttggcactgcaaatagtggttttcaactttaatatattgtttttgtaatgttttcataattattatttaagtgaaaattatttcttttcttttagaaatttctggccagcattttaccttcctcatggattggtgtgtttcgtaacagcagtcatcatccatgggtgacaataaatggtttggctttcaaacatgagtaagttgttttatagggtgctatataaaaaaatataaaggataaattcagaagaataatatgaataaatctatgtggaatcattgatatgaagaaagatgtggaaagttagtgaaatgttgatacaaatattttacaatagaccatagtagtccatatatgtccaccactcattggtcagctagtaactttcttggttatgagatggaccaggggtgtctaatctttggcttctgtgggccacattggaagaagaagagtcttgggccacacataaaagacactaacactaacgctagctgatgagctaaacaaaaaaattgcaaaaatatctcagaatgttttaagaaagcttatgtatttgtgttgggccgcattgaaagcttcctgggccacatgcggcccatgggccgtaagttagacaagcttgagatggactatcagggaattgcagtgcttgttttcattaaaaagtcacccttattttacttaagaatatcctcaaagcacaatagtagtgctgttggtatattgcttacaattttttattagtagttattgttgtcaatctcttattgtgcctaatttttaaattaaactttatcacagttatgaatgtgtagagaaaacataatctctctataggttctgtactatttcagacattcagtggggtcttgaaacatatcccccgtggatgaagggggagtactgtattgagtgttcagaataatgacttttagtaatagcatatgaaaaatttaattaccctttttcataaaattattttcttacagtacatggaaaatgcttttgtctcatgggtcatttgcataaaatgtaacagaattatggatttttctccattacaggataaaagactcagatcatgctgaacgtaactgtgcaatgctacatgtacgtggacttatatcagaccagtgtggatcttcaagaatcattgtgagcataagctttagaattaaagcgcttgagcttgcagtgcatcagataaaattttatatttgttcaaacagaaatgatattatgattgcataagccttaaaatgaattgtgttatttgctctaataataagaaaattccaaatcaattattgaaatataatacacacaattacggaagtacagataccctcgcatttaagtcaggctcattttgctgaacgtgatgtttgtggcattcaggcttcctaaaagttgcatgttatgttggtcagtttatatgaagtatcaagaacaagcaaaaccatggagacagaaaataaaatagcgttgctaatgcctaagggaggttgaaataggaggtgtccactaattgctagaatgtttctttgtgtcagtgatgaaaactttctaaatttcagtagcagtgatggttgtaactctgtgaatacactaaacatcactgatttttaatcattttaagtggatgaaatttatgctatgtgcaccgtacctcaatgaagctgtccaaaacaaaaatatatactgtcctgggattgcttgagtctgcatttaatctctaaagtaatttttaaagattagcttcttgacatttccatacaatatcatattgtgtccttcaatgtactgggttcaatgtatggggttttctttaatttctctctatcatattatgtattttgggggtttgaatcatacagaaatgcagatattttacattcatgcttttgtaaatagcattctgattttaatattccctttaataacttttgttactgtaaatagaaatacaactgatgtctgcattttcacttattttacatatttaaatctatcatttcaaacagatttttctggattttctatataaacagcaattttattttcttttctttttctttttttttctttttttattattattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtcccctgtgtgtgatgttcccctgcctgtgtcctgcaaataatcacacttttattttttctatccatgtgccacaacttattttttcttcatttattttctctggctagtactttatatccagagttgaatagaaggtacaatcaaattttacatgtatcatatgtatcattttctggttttggcaaaaaataattcaacatattattcatatttacaaagtttggtgtttttttcatcatatctttcttatattgaagtggttttataatattccttttttcaatagatgttatcaattgtaacatttttattttttattacttagaatgatatatgttttctttatacaacattttataaaataattttatttttgtcaaatgttaaactaggctttgtttccgaaacaaatccatgctgatcattgtatattgccccttataaaatatcagtgcacatactactatatctagggtaagatatgtttcttcatctatgttcacaaggatatttgaccacgtttttatttgtagctatgtacttgaaaaagttttggtctcaaggctatcttgggaagattttctgtttctctataacctggaagcatttgttaagagtactgctttagccataaaaaaggatgagttcatgtcctctgcagggacatggatgaagctggaaaccatcattctcagcaaactatcacaaggacagaaaaccaaacaccgcatgttctcactcataggtgggaattgaacaatgagaacacatggacacagggaggagaacatcacacaccggggcctgtcggggggtggggggttgggggagggatagcattaggagaaatacctaatgtaaatgatgagttgatgggtgcagcacaccaacatggcacatctatgcctatgtaacaaacctgcacgttgtgcacatataccctagaacttaaaatataataataataataaagagtaccgctttatttttaaatgttatcattcactagttatgccatctgagtttgcaggctatttttgtagaaaagtttatggctaaactgaatttcttcaatacatgtagggtttactcagatttctatttgaggtactatattttggtaatgagcatttcccaggaattttctatttcatatggacattaaaatgcattgataatatagttttattgcctgtttaataactgtaaagaccataatggtattgccatgtttaaactgggaataaaatatctgtgccttttcaaaatcttcccttagtagtcctttgtgaccattcatcttgataatttctttggcccatatgttattttgacatatattactgaattaaaaaccatataaggttctcagatttttgtttattgacttctgttgtaggtaaaatatagttagaacattttctattaaactggaaatgttcttcatccctttataaatgtggctcatgtggtgaggtactggttttaaatgttatttatttttattaattaatgttaaatttgaatagctacatttcaactgtctcctagccaagcttggctagcggtactacattgaaattgagtatccgtgtgagtatatgtgtgtgaatgcattcatatgagtgatggttacttgtctagtttaaatctttctataggctcactggcctgtcttgtattaagcatcaagagaagagtctttaaaaatcccatttatgattgtttacttgttcactttattcaactatatgttgaacttgtatcattaggtatatgcaatgataaaaaatatattactaatggtttggaaaattaatttatcattatgaagtatatttccccaatttcagtaaatttcatctcggctcactgcagcctcgacctcacctccaaggctcaagcgatcctcccacctcagcaaccagagtagctggctacaggccaataccatcatgctggctaattttcgtatttttttgtagagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatg

SEQ ID NO: 172 - DNA, 402690 bp, Homo sapiens
agcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggtgagtgagccccaggctgcctgctcgggagacgtggtcggtcgccgcaccaacgcgggtgtagcgggtcccgggcgaggcagcgcgcggcggcgcaggagccggagctggggaaggtggaggtcagtgctcatgggaggctacacaaaaaagggggagccgcgtcactgcttccctcctggagggtgccggccttccccgggaggtacagttggcgggtttttcaatctgggctccaggaacgcgggctagagtgcggggatccaggttcgcagggaccggcacccctactctgggcaagggatcgcgagccgctgcagccacttgagttgggcgcagaaatgagctctcccagcctcctgggtgggcgtctggcagtccagatccgcagtcccggtgcctggcaacctgggctctgggcactggcaagtatgcacgaatctcaagaatacaatacagggaccactagggatgtgggaatatcctagagcctgttaccccagagcctccaagtttttatgcctaagttggattcttccacatggagtctgccaactctgacgggttccactagattggggcagagttcagatctgacttcgagctgaagattcgaagagtgagaaggacggtcagttagcaacatcagcagacacttaagtttcccacttgctccctaatttgcccgcttgcctgccactgagcaagatccagttcccagtccaggtagcttcctaggagattcagggctctgatctcgaatgagataaaaaagacaccggaaagctgaatgtgggcagcccaaagatgacaaaacgcaaggacagtggaaggggcgtggactgacagccataagtgtatagcacccaccaccaaggtttggtctgtggctgcatagggcaatttctgaactttgagggttgacacagctcttcgccttttaaactaaacccagttattgttcgctgaatctcatttgccctcctcctttcccaacccatcgggcttcttagagtcacggtcacagagggagccacaggagaagctgtgacatcacatgggtctcttagtttctcccatcttccactttcaaccgcaagagtgaagccctgatctctgaggacttctaactccccctttccaggaactaacagaatatgccaggagcagtgccagacactggcatagtgacgcttcctgagcagttgaaattgctcagttactatactagctctgacctacaattagtcagcccctttacaaaaattcagaacatactaggttttattttttaatcactgaacatgcccactaaaagaaaaatagaaatgtgctactttgagctgcagatatcaaatactaacttttactacacacatgttttttctagactatgggtaattttaatgtgcattgtattggatagagtcttttctaaaatagtttcaaagtatttatttttttaaaaaaaaacttactactatacataactgaaatatcctttatctgagataagttctaggtttaacatcctgggtttttgggaatgcaatcaactctactcaccctggtcaaaaaaaaaaaatattctgaacaatacaaagtaactaatgagcgtgtgtgttataatttccaatacttattaacttaattggggttttgcttgtgtcttttaccttttgaaagagacaaatctagggatgctagaaatggctgtgctagccaatgttcctcatccctgtataacaaatataaggtagcattttcctttcctatatcccccacatctaaaggaactcaggaggagaagggaaaaggatgctttaagacatatttgttcacagatctcagtatttttctaagctccaagcaatcacaatcatctacgtaaaagtagttttcaaggtgaaaacaaacaacatgattcactgaccttacaaatatatgcaacaagataatgaggttttcttttttctaaatgggagccaaaatgcataaaataaaatggcatggcatggcctggtgttgtttatgtgcagtacaaatgtgttactccttctggcctggagtgtcctgtggctgacatgagcactgttgccccgtatgcacctaaggaccaatgcacgcttttaaatgagcagtttagcacactgtggaaaccagctttacctcagaggaaacctgtttctctacagtgactttcttgtgtcagtcaagtgcaatattgaatacaaaaaattaacaaaaaggggttggggactaagccaaagtttatgtgtgtgtgtatgagtgtgtgtaaggaaaaagaaaggggagttgtattctttattatatcctgtcccattcttctttccaacaaaccatcacccatccaagcaaccgaccgatcaactaaacaatcaaccaaccaataaaaagggtctctagattattaactggcatgttttttagtgacttaaaatattcaaagtaaagtatagcaaaatcgctaggcacttagtactgggtcctcatatagagaaggcactcaaatgcttgaatgaattaattactggtctacttttcttgtcaaagtgtctgcttaagcttcagctttggagaaaaggataaaagctaagataaaattcatgcatactgaatatttgagagggtattgagttcacatagacacgtgatttgagcatacactgtgaatgtctgttggaaagtttataatcttatgcaacagttaagagacagagaaggtcggtaggatagtggtgcccttaacattattactgcactcaagaagtttcccagcagcttgcatagaagagaaatatagctggttgctgggaattgtgtggagctgctggagtcattcctgcctctctgtatacaccagtgtatatcaacaaccagttagttgacatatgtaattagttggtctgtgagcttcacaatcacaaatatcttccttaattgggtggctgacttataactaatggttagaacaggatctaggtaaacttagtagacgtggcccaccaccattaattaaaaaaatattccaagtgcatatgcaattttaggacagatgtgtaatatttataataaggattgcagaaagacagataatatatttgtgtgcatcatctcaacacatacaattatagaggtcatggtgaaaataggattaagaattgagcagtgggcagccaggctttccgaagcatgttttggtgtcagaaagcataggtttgattcccacgtccgtgatttactagatacatcaatgagtgagtgagggttatttagtcttaccaggccattgctgttgcatctgataaattgaattaaaactattgcaaacctcacagtgtcattggtaagagctcaatatgaaagggctttgagtaatatctggatacatttgttttattattattattgttatgttgtttttactactttttttattatttacattttcttcctaaacagggtcttaacagttgattggtgtatctttataagacctttaatatctttaagcctaaatctcttcatctgtgaactagcagtaatcatatcagcctttcctgtttcacaagggaagatgaaatacactaatttctgtaatttgccaaaaaaccaccaaataaatatggtactattatgtagttaagtacatcacataaatagaaatattatggagatttatatgaatagtgtggaaatctatagtgacaatatcattgttcacatgcttttatttccttgagagaggtccaaatttattttatgccaatcattaccttggctggagcatcattttggatattttaacccaaagatccccaaagttccaagtaatgtttttagttgttcatatttttacataagtgtgtacagacccatgactttatttttaggcacttagttttttcatcattttaatattcattcttcattcaacaaatattatttgagttcttacttccctagcatgagccagacacacttagaaaattgcaggatgtacaacagtgaataaaatggacagcatctgccccttgaggtttgcattctggcaattgcaatctatactgctgatgtttttcatcagattttccacgtggacacattaaaatttttttcaaatactattcttgaagagtttttagttaatgttctgccactgatctattacatcagttgcatagtcaacttggaataggttctagcttccaagtgcatagagtgtggagagtggtgcatgatgccaaacctggaagaaactcagaggagagttgcctgtgtttaggaagacctctgtggctggaggtagagtcactgagagaggcacctgtgtcttcaaaatcatgttggtcctaacatgaacttgaaaactccaatgggtgctgggaaagtctaaagagaaggtatctgatagtgtgatataaaagggagtgcctgactaatattaacatgttgctgagaatgagcagatcttttcccttaacaattttacctgtgtcattcatctttgcatttaatattgattttatgggcctaatgttaacattacatagacctcaacttcagctacttttcttgtaaggtttgtgatctctggttttcattgagatagtgactttgcgtaagttcagttattactggtagaaataccagaaattgaaactagctattctggtctcaggttttgagctccttccattaaattatgccatattgtatatggacttatgtatgccaagtacacacagtataagtgtgtgttcaaacaataaataacacttactttcagtaatttagttacctggaataactaaaagcaagagttcatttctcttatatttgatttcagcttagtatacactgtatttgtcctaacatgaacttgaaaactccagtgggcgctggaaaaatctagagagaaagcatctgatagtgttacataaaagggagtgcctgactaacgttaacatgtttctgcaaatgagcagatctttcccctttcactgtgtgtactaagtggaaatcgaatataagaaattacctcttgctcttggttatccagggtaactaaattacttaaaagtgagtgtgatttatatgtgaggcaactagcaaagagaaaaactgatattatcagtggactctccagaatttctcttttgaaagggttcaaataatgcaatcaagttggagaggaagcctcactacctacctatgcctagcaaacacactgtttgttgttagagtgtacaattaactgggatgggtttagaggaaggattgatggagatggcggtggtggtaatctctcaatcctctttcgttgtttcactgataattatccatataacataggaaatattctaaaattttccaaaagctatttagactagaggaaagagtagtggagatctcaattctgttttgttgtttcactgataattatccatatgtcataggatatattatttatgttctaaaattttccaaaaggtatttagactagaagaaagagtaacggaggacttcagggagaaggggattcatatttccagctgcctttttctaattgactgaaactgagaagattatttaatttgttaccctccattttgttatctatagaagagaaaataataataacaaatttatagtttatcataaggatgaaatatatcacatgtaaaatgcatggcataccttcagtcttgaggaagataactctctccctctctctctctctctatgttaatgaacagggtgagagttttgtgctccacaattacctatttgagcaagtaagcatggggaaatgttcttacttgaagattcatgaggcacgtttgtatagtaaaggctttttgaaattctgcagcaaaacaaacaaacaaacactctgtttcttttgtctaacccagtgtctttcacattttaattattggaagacccttatttgaatcgtagctattaatgtcccactcaactcatgctccccagagcacacttgaggcaacatgggccagtaacaccactgcaatttcagcacacacatccaaagtcacatgaccatacatcctgcagctgcttcattctaagccagagtctgccattcccaatttcagaacattttcttaaaggtttaagattaccatgacacacggttacctatgtaaaaacctgcacatactgcccatgtacccggaacttaacataaaaatacaaattaataaaaaaaaacacttagtatggtggcagatattttgcatgcttaataaatattttttctttaaaaaaggtatacttagatgtttaatacttattgccctcttttatttagaaaatattcttaaaaccacataatctattctaaaggtttaccattttattagcataaaatttgatctggagccattttacttttctttttctcgtttttttttttacactagacttgctttttaacattgttttaaattgaaaattcatattagacttaaaatatcttttccaggaatgtaatttgtggtaaattaaaggtctatatttacaatttaacctattctttattttaaaatgcttatctgattttttaaatgacaaattttcatggcaacacaaaagcatccaaattaaaaggaatgtattccaactaaatcaactgtattaatttgttatcttgatttactactgagatcaagttgtatcaaattggaaactccctacttattatacagcactgtcactatttttccaagtaatttatttaaaataattaaattaattgtttgaaataataaagtaattagaaaaatagttaatcttggagaggaaaatttttaaaaaggaaagaagtaaaaatatttaatttataatctcagttatgaactactgaaaacattaaactctttagaataactttcccaagttacttggacaatattttacttttttcttattaaaaacttaggaatcttctaaagtacataatgaaatctaaggtaagattagtcacaaattgaaattaacaagcaatgatattgactaaataataagtaaactactggccacaaattaatctcatagaaacaccttccacagcttgaaaagattttcttttagcttttaaaaatattatttggcacatttgtcaagtagagcagttaaatttgaaagattaggccatgttgtgtcttttgattagttgccagtttactagtatcctggcaaagcaaacatacaaaataaagcaatcatacaacagcctatcaactgtattgaaaatttctacttattaatgtttcaagagaagtgtgataatgcagatttttatattagaattatgcctgtgtgttttcatttaacaaaaatccaatggttaattgttattattaccatcagttatcatcaatttggagactaagagttcactacaacttactatttccctttaaaaattcaaaaaaatattaaaacatattattttttacaccaaacgagtcaaagagcacagacaatcttaaggcaaaacacctattttatctaatgattgattaaaactcaacctatacatgggttggtacacacacacatgtatttccttgctctgtctgctgagagggcttaggaacaatgataccccagtaacaatgaacactcctggcacctagagctcctcagaaaaaatatatattattctggtgctgggaagggagatacataagatgattctggaggatcttatagtgctggaaagtaaagaaatgctcccatgagtgcatactgatatagataaatgattaaataaataagtagggagaataggcaaatctgctcagcagaagagccaggggatccaggttagcatcagcagtggtagattatgctgctagtattcacgcttgataacaggtgatgcaaagggtatgttacctatctggtcttcctccccaaagcctagagccctactctactaatgagaaaatatcagacaaattccaacagagtagcattctgcaaaatagctgaccaatattgaccaaaaccaccaaagtcatgaaaaacaaggaaaatctgaaaaactgtcacaaccaagataagcctaagaagattagtgagaaaaatgtaatgtgctatcctgaatgcaatcccgaaacagcaacaagaaaatgacattaggtaaaaaccaaggactctgaataaagactgactttacttaataataattcattaatactggtttattaattttaacgctgtaccatactaacgtaataatttcaggagaaagaagatgtggagtacatgtgaacttggtactgtattctcagtttttctgtaaacctaaagctgtgctaagaaataaagtctatattttaaaaagattcaacccatgtcaaggtttcttctgttactgtttctacctactctgcagtacataaagatctgcaactgtatcaagggaaacaaaaaggaaaaagtctcgttcattccatacaacatgctacatggagggttttctaagagtgtccttaaagacaacaatatttaatgttgaaaaaatcattgaagaaataagctttatataacagttgctaatctgatggtcatacgtcttctttagaattctgcaaggagtttgtagaaaatcagacattagttgttcctatccattagcatcttggtcttcaactattatactttttgtacttaaatataatttaccgttgaatattgatgcaagcattgtaacattctgtcagatgctttaagtgctgatgtctttaaatgaaaagtcacaggaaactattttcacagattacttttcttagcaaaattgtctaaatatgcctttaaaaatcaatacttaattcccagagggggaaaaaaacacttcataatgcagattggggaaaggatggtaaaaatcaagtgttcttactttctttcattgtgaggactcaatcataacttttaaaggttttcttttttcctaaattttaaacttctaaaatgttggattacatactttagtaatccgtaaacagatgttgcattctgatgaactggctgtgtttatactgtatgagatgttactgtactttttctcctaaaaatggattaatgagatagagccattcttcaaatctaaaggcaatatttgccttttgaattctgggtagcgctgttccttttgttcttaggaaaaatctgaaccctaaggctgtttccatgcatgtccactgagttggcaagaacctttataaatgattgtgaatcatctaaatgttcaacaggagagaatggttaagaaaataacagtataatgtcatccaggtttattcatgttgcagcaaatgacaggatttcattctgttttgtggctgaatagtattccattgtgtatatttaccacattttctttatccattcatccgctgatggacacttaggttgactctgcatcttggctactgtggataacgtggcaatgaactgaagtgcagatatctcttcaacatgcttatttcaattcccttggatatatacctagaagtgtgattgctggagcatatgataattttatttttagttttttaagcaacctacatactgttttccataatgattgtactaatttacattcctgccaacagcatgtaagagttgccttttcaccacatcctcgccagcatttgttaattttcttttcttgtcttttttgataatagccattctaaccattctaactgaggtgaggttacttaagaaataaagcattcattaaatatgatccgtaagaagaaataagcaaaaaatgcacacaaaataatatagaccatagtgtatggttttacatactttggattgggaatttatacagttcattcttgcttatacatgataactttcagttagttcatgtggaaaagggaagtttattggttttgttaagatggtagaattgtgggtgaaagttttttttcacttttattcccattaatgtgttttgtccagtttaacaacgattagttaaggataagattttgtagattctcgattattaaagcagacatttgcctgcagattgccatagtgaaaagtgcactggaatgagagtacttccacttccggtggttcttagcttggccatgtcacataacctcctagtaaatccaaccctttatcggagactagtgagtggtgagcaggtaatgggtgcgtctgctgatctccatatctgtaatcccctctgcagtatctgctttattttattgtcattgggatgaactgatatgctgcatgaagatgtgcagctgtattacatttaacatttatagccacagcatccagtgtgtggaactttgtttgtttccctgtaattaatgttaactggcacacatcaaagtgaggaccttgatgtggccccagtgggagtttcctcgctttctatttcaaatgtaaattattttgaatctattttctctcttctccctacagagataaaagacatgaaaggagaggcatttgctgtcattcctccaggacgtccactggggtgtagcttgttccactaggtcctgggtatcagcctctaatgcactgcattcactgcccaaatccctgactgagcagccccatgtggctcactctgctgctgctcatccttcaagactcagcgcattttccatctggtctctcacttagctggtgcttacccagcgcctctttggggtggaatttgtggctcacacagcaacacccactccaagtgaccttcaagtcctgctggttatctcaggctctttctgtctaagtatatcctgccttcatcttggctttcctggtggcactttgaatggccaattgtacactatggtcctccactcccagagacccacctgcctgtgggcacaggttttctccagatctaagggattttattgtcctcctaccatgactccaggtttcccaactcgaaggggaagaaagatggagctgagttcttgtattatcacatgtctatctcagccctcaggttcaagctgtaaatactgctgtggtatttaaagcaatgcttttaaaaattaaagcagcaacgaaagaagcaacaaaaacaataaactttttaaatttcagttttcggctttgcaacagaaagcctaggacatggatgtccaaccctttgaatgtgaggatgtttttgcttatctgtggtggcagatatgaaaattatgcccaaacttttttcttagctcatcaactctccttagtgttaatgtattttatgtatggcccaagacaattcatcgtcttccagtgtggcccagggaagccaaaaggttgaacaactgtggcctaggatttaggactagtgtctctgtctctttctctctatgtcgtatatatatgtatatatgtatatgtgtgtatatatatgtatatgtgtgtgtatatgtatatttttgtttgtttgtttgtttttgttttttttgagacggagtcttgctctgtcgcccaggctggagtgcagtggtgcgatcttggctcactgcaacctccacctcccgggttcaagtgattctcctgcctcagcatcctaagtagctgggactacaggcacatgccaccacgcctggctaatttttgtatttttagtagagacggggtttcaccatgttggccagggtggtctcgatctcctgacctcatgatccacctgccttggcctcccaaagtgctgggattacaggtgtgagccaccatgcccaacccatattttatatatttgtataaataatatataatataataagtgtgtatatggctgcatttattacagatttttcaatttatatatatattataagcattgcatatacatattattaagcatatttattgcatatattatacacactacagcccaaaatactgaatataaaacatatactacatagtatacataaattcacatataactatatacaaatacatatatagttgtgtattatttattataattatcctttagtttatatattacatatatatcattacacacagtacaacatatattacatatcatatataatatacgtgtattcatagataaattcatatttatataataagattccaatttgcatttttctctgtcttttacctattctacctggagacaaatcatacataaagttattattgcatttcgaataactgggcaaggcaatgtctgtgagtgctggtggtgtggagcggggaggcatcaggcccacacagaccatgccaatttgttatgcttttaggatgttctgaggctacatacaactgagtttgaaatatctgttctgcttctcatgagaatattcctctcggtcagattgaacaacagggaacacatgctatcatccaggctccaattaacctcgaaggattgatgatttgctacatctgtgggacatttgtgagaaaataggcagtatgatatcacaaataaaattccttagggaaaaacataatttcatagaaaacacaacaaaactgttataaataattgtccattattagcttagcctaaacagtatactcttcttggaataataatgataaataaattgtaaagagaaagaaatcagacccagaaatctatttgaacaagctgtagaaggcacatagacttaaatatatatgtgtatatatatataatttcttatatgtatacaaaaaactatataagatacataaataaattaacaacaatagtgttcaacacgaggcagagcctttaaagatcctaaagtccaactttttcatttcataactgagaatactaaggccccagaagcttaactgaaataaagactcagtaagcaagccacaattcttaaccttcttctcagtgctgttttcttgcaactttgtttttctcatacaactaatttgaaaggtgttaaaaatctatatttgaatgaatgagaagtagtaatcaactaacaaaattcctaaaagctttagagtacaaaaagcactggactaatcactgtggtttctttaaatcagggtgcccgttgtagagaattttgagatgtgtcttaaatgagagagtgcacatgtgaaacggaggtgaggccagaggaattattattgtaaatactcaaatctagggaaattttaacatccagggaaaatatcaataaagaaatcttaacagaaatatgttaaactatacataccttgcaagttttttttttttttttagctttttatgatctaggtatttctgattaacttatcctacagttacttgagtgagcaggaatgtcttcatctctaaaagcactcttggaaaaaaataaagttagcatttacaaacgagtggtatatagcttaacaatttagaataattagagtctacggccattacaatttgtattatcctaatttaactggaaatatttaagtgagtgttatactttggttaggctaagtacatgtgcatacaagggaagaagactaaagagtggtatctgtcactcactttttgagaacgtcataaaaaatcaggaaggcagcccaccatttgggactttgagattcatagtctcactcctatatcagatgcaaaaagtgaggtggaatgtattattgatatgctacttaaaaagacaaaatcggtgaacaattcctggagagtatgctaagtttgctgtactattcctgaaggctgacctgccttttgtttcatgtgaagtaatccttcaaatcaacttctgggttttgcaaagtaacatttgagcttttcttctcccttcagactatgaagttttaatttatgtattcacaccctctctgtcatttactattcatttattcattcttatatttatagcttgtcttattctaaaaatattttaaaggcttataaaaatacatatattataatctgataaaatacattaatgaggatggaggtgaaggtgaagcaagattaaggcaggtgcgtttccctgaaaagatgccaaaagtggacgagaaaattgtatctgcggctgaattgagaagggaaacagaacaaacttcagagttgggagggtctggttgcttaaacaaattataggtttttcaggttaaaaaccatgcaagaaatttatcctgtgatcctgataaggggaaacaatgtgatgttatagatagcatacctacgatcaaatcagtggtgtgtttcatacatttgtttcttatgaaatgctcaatacaactctatgacaaggcatcacgtagtaataagaacacttctacaaaacatcttggtatggaactgtcaaatagtttggtttgatctagacttcaatttatagtatctagggaaatggatggcttgcacgtcacctcatcatcattcgtaatgattgctccttgagtctgagcttttcctgaaggagagcagcagaaagttagagggaaggggggttgtgattaaatgtgcatttctacttagagccagatccataaacattagaaggtaagaatgaggtccttctatgaaattaagaaacccaaataaggtaccttgttaaatagaagaccacctcacctctaagaggatgagacgcctggaagcagagccaatgttttactcagaaaattcttgcaaatagttttaaataatgacaagagtcactaaaaggtgaaaaaaacaaaaaaggtcgggggagaataaaattttttgagacattaagattaaataccatgtctttcaggtaaatgctaagataggtaggttgggaattgcacattgacctcatataggagcatctgtaaaccaataatgtgttcagtatagtctacccaccatggtgattgggtttcagagcagttgttcttaacctttcttacagtaaccatagaataaagctcatgatgtcatgagctcaatgcttcataactgcatatatatctgttcatcacttcatcacaacccttcttccatctaaccttctttttcttttttttcttttttttttttttgagccagtctcactgtgttgcccaggctggagtgcagtggcatgatctcggctcactgcaacgtccacctcccgggttcaagcaattctctgcctcagtctcctgagtagctgggattacaggcgcccgccaccacgcctggctaatttttgtatatttagtagagatggcgtttcaccacgttggccaggctggtcttgaactcctgacctcgtgatccactcatctcggcctcccaaagtgctgggattataggcatgagccaccgcgcccggccttaaccttctttcatatatgagtatatatctccccactgttcagataataatttccaattttttgtactcttgttttcctaagattttgtatttggtacttgcttaactatgtttttgttgttttgtttgttattagagtctactttgcatatcttggtctggtcagtaataaagcttaaatcttttctatcccctctgaacctttcagatactcctctgtaatcctaatcatctcctcttagaaaagcctattttatctaacgggactattgattacataaggctgaagggaaataactaaacgttgtttgtcagtctgtgttctgaacatcaaatttgcccacctttctttagactccatattttagagtactaccatgggcttaagatgtaagaacaagcaaacaaaacctgaaacattggcgtgtttggtttaaggttttgatctttgtctgaggttcctgaaaagatgactttaacttttgttcaatttcttgcctttttttctgagagaaaggaaacactcgttgtaactccatggtatatttcatttccaaactcacacttctctattttgagttcaaattaaagacttctgtcacatctgtaaaatgccatgctgagctacaaattgagttaatgatagcttccttctacttcatgtttattattacaatgttttactaggtttctctagttttctctctttcaaacattaatatgaatgtggtacattagatattatgcagaagtacaaattctcctttatagctgcctgagaaaagcttgcaactgacatttcgactgaaaagtaatatgcagaagtgaaaaaagaacttctctagggccttttgaaggaggacagtatcaccctacaagtcaatatgagaccatccaaattagcattatatttcataaatctatctacagcataattcatactcagtcaaaaggaaatacagcaaaattccctgtggaaagactcatttttgcataacacatacacatacacataaacacacacaaatggcatagaattgtgtaaatcagtacacaagtcctttcgggtcaaataaaaagaaagaagaagggtgattgctttctagctagtgtagacttgagaaaaccattttatgttctgcagtctggtcttatgcaccactcccatctgagattcttcctgaggaaataaaacaggttctgcaattctgtctgtatcttatctcaaaagtctgctaaaaaaagtaacttatttagaagcatacaaatgcatgacccaataaagaaaatgaagtgtaaaagggccgaggaatacaacagcaaaagctgtaagtttgaactttagtcatttttaagcaaagtaactgttttcatttatttttaaatgatcatttaagtaagtataccttttgccatacaagaattaagaaaattagttgaaagtaaagaaaaatgaaaagttcatttaggttgcttccaatatagatcataatttttttctaagattgcttctttctgagatttgtagtgtccatccaatgctgttaaataataaatcatttctgtataatgacaaaatatatgtacatttaattattaaaggctatgaagaatagaaaggtatgcagttttaagataattataaaatcagttttcttctacccacagaaattattttttaacagtgtttggcatttattgaagaaataaacaaatatatagaaaacttattttaaaaataaagatgttaatggttttattgatttacttaaaaattcagatattctttattggacataagtcatttatttgatacacaggtttatataccatatcttcactgttactccaaagtagaaggtagttatatctaatataaccattttattgatgtagaaattgaagtcagagtttatgaacagaatcagattaatggtgatcttgcatgtaacccaagagcggaaaaaggcatcttgtgaacacattgtccaacttagtagcttgcataatctagattgggataattgctaatcctttctttcatctacctttatttacaaaacaatagtatcacccagaaggactactttaggatgctatcaaaagcaaaggtaaatctacttacctgcaaaattattcttagattgtcttaaagtaatgagcacctagtacctaggaaatgcaagaagtgtattgtcaatggtaatttttaaaccaaaattttcagtttactacaactaaatttcctctagaaccttgtccaattctatttgtcaagttttagcgtacgttaatttgtatagcaatattaaagtgagcttatgtgcagagaaacaaaaccaaattcaaaagacttaattaaaaacaaagggaacctgagtgaaattttagatgttagaagtctggcctatatttttatttatttatttgattcgtgaaaactcaactttttcttgaaacttttacttgagaaccaaattcaaaagacttaattaaaaacgaagggaacctgagtgaaattctagatgttataagtctggtgtatttttttgtttgtttatttgatttatgaaaactcaacttttactacagaatgattacagattaagatacttttttaaccatgagtaaaaccattaagaatggcaacaatttgaattaataatcttagtgggccttgcaatgaggactaacatgctgaactggtcttttctactgtgaaatatattggaaaaaccttgcactagtatttcaacagcaccctttccattacacttatatattgatttgaatctgtcaaggaactcctctagaacagttgtatgcaactgcgagtcattttttttttcttccaggggacatttggcaatgtctgaggacatttctgtttgtttctactgtgggagtggtggaagctgctactggcatttagtggttagaggtcaggagtgctactagacatcatacaatgcacagggtagcctccacaacagggaactaaccagcccagaatgccaacagtgctgaggttgaattttaggttggagattatgaacacaaacctagtgcaggtttagtgtagatgctttggaaatcctgctccagaagaaaataaataaaaccatcaatcatctattctcagatggtatgaacggaagccacataccacgttagtgttttgccatgaatcaggaggactcatggcaaaacacttttgataacacttcccttgcccagtgtgtatggtgcctcttctgaaaacatgtccatctgaaacacaaaacagacactacagcaagttacaaaatcatgtatgcaaatgcacttcactcaatggctctccaagcttcatgagtatctgctataggcaggccactggatacatatgaatgagcaggatagactgtctgttttcatggagctcatggaaaggcacacggatgtgaattaaatgatcacacaaataaatatttaattctaaactacgacaaatattattaatgagagggtcatggttctatgaactcctgtaatgggaaaaaccgacaaggttaaagaaagtcaaagaaacttttgcagggtaagaagtttgtgagtttatatctgtaaaagaagtcattcctagaaactgacttcaagaaaaaggaaaggactccaactaggggaacagcatatgcagacgtccaaaggtcaaagggcatgtgtgctcagtgacaatttagctctttattaataccttttgttagactgtgtgtgtacatatagtagccctttctaataatgggaaaatgaaactattcctcaagttaaatttacaatgtagaactagttatttaaccaatagctatctcccccaaagataaaatttaaaacttctctttgaagaaatagagaaatgaagtagaatgttcttattatcccctgagagactgtgagcaaagaagcagagtaggcaatttctgggaaaaaaacattcaaaatatttctctttgcctaaatcttcattgattcttcttctattctgcctcagggagagcccttgttcctgtaatggtttttctgaacctctcccctgctcccattccttgtcaaagaacacagggaatcaaagaatgtcagccagaaatgattcaaaacttaattggtttatttacaaataaaagaaatggaggaacaaagaggtcctcactgtttaatatcaatttttaaaataagtactatcctgaagcacgttggccccttaaaagggactgtttttagcacattaaacctcttcaaaccactacgtaggtttattcaacctcatgctttgtaaaagtacagaagtcatttaaaaatatggttttaataatgaatcaaatggctgtttctataattaaatctactctgtgtagctagatagacagcaaactctgttctagcaaactcttggttctcctgtaagtcatttagggagtgctacctttgctcagtgaagagttaagacaaagaaagccttgaatatgtttctcatattcccaagctcaagaaagtataacctatcctgaacaagttatgtaggtgtgtgtttatgaaccgccctgagattcactctacttacagattgctgtaatacttcttgcagagagcctggaatacatcctctgtgtgcatagccactaatctgaaatcactcaaaccatgcttccgccaacaagagacacttttctgcagtgactatgatggatattctctgtttgcccctccagatccactcttcaccagcctcttacctccgtggacttttaggagttgcatcacaagtgtctcttgccttcaggcttcatattgcttttggccagtgcaagacaacatcagcttggaagacaggaacagcttgtggctttgagctccttgactccctttctattgatttcatgtgagatgttgtggctgagttcctcctccaagggtcttagctcattttgggtgcctctctcctaaagctgcagatgtctcagtgcctcttcttcttgaccctttacccctaggattgatacattgctggtagcttagagctgttgctaactctcagttatatcccttgccttccccttcgcctgttgtacacttatcaccttctccaaatactcttacagtcaccttctatgaatatgccatctgctctctgccagaatgctgacctagacagaggctggatgcaattggggctgaaatatctcttgacaaaacaataaaataataaagataacataagtgtgcaacttagttggtgtatcaggtattttccacaatcatttcagttaggttttctgtaatataccaatttaataatgtgatatatgcattgtttctgaacatttatttatttgctttgcttatttttctgttagttaccagagcatagtatgcttggtaaataaatattgacacacacacatttcacattattatgtgctatgaaatatgccagaaatagatgagaattggtcgttgcatttaaagattttcaatttagataaaggagatataacatatactggtgaatattgaaatattcaagagcctgattatgaacattctatacctttaaatctccgcttcatatctaagtatgtgtaagaactgggaaaattgcacagcctctcttagcatcaattttcttgtctgtaaaatgagattggttatgtctacttcgctgggcttttgaaaagattagttgagcttgtatatgaaaagcgattagtacagtgcttgggaatgtggttaatacttaagaaaagttaactgccattattaatgttactattacttcatttgcatgtaattatttgagattcataaataaatttggatttttaaaattttcttagtaattctaagtagtaactcctgtcaacattatgcccatttttgagttgagagaatttaggagtgagaataaattatataaccaggttcacatatcaagtttgtgactaaaccatcaccatttatctatcatttatccattaatctatctatttatccactcatctattagttcatctttctctatataatgcagagtttgaattaaaaataatctcttagtcaggggggcatattaaagtgtgtgtgttttaaagaaatcatatattttattttttaacagaaattaggtctgttttgtctgaatggtttgagaaggaagacatgttaaaaagtgaaaaacatgtctttggtttcactgatttaactaaaatatataaatcacatatataagatgaaatacatcagaaactatgtattttgagaacatttcaactatacagtgaaaaaatgtaaatactggcttaaaatatgtgggggtagaacctaggtttttacaattattttggggtcaagttagaaaaaaatgcttagagaccactgtcctcaacaatgacagaccaatagggttttatactcagttcaatggaaagcatttgaagagttttagattgaagaagagaacatttcaatgtaaatgctttgcaccatagtaggcttacagcaaatcactgtgggattaaattgtgtcatttcctatgatcgttctcctaacatctgaataaaaataaaggcacagcataaattgttatgtttaaaatgtcagtgatgcagagattggcattcctttctccctaatgccgtagtaaaatggcagcagaaacagtaaataccaatgtgcaaacctgaccaagaagtgagacatgcttaattattcatttctctcaatttcagtcacagggcttcatacctcatcaaattagagtaaaaagcatattttaacgtttgtctgttttgcggtgcctgtcttttgtgaaaaataaatggcaaatcaccaaaaagaatttcttcctatcttatgttaaaatccagtcttcatttggaaagtatttaggtgtgcaagcgcaagcaagccaagtgatatactgaaaacgaaatgtcttaagtcttgatgagtttgaacataatgagaaaaacatcagaagcatgttgatttcgagaaaaacacataaacgtcattactttttctggagagaattgagactgtgatgtctaataccagcttagtttgtagaatctgtgtgtgtatgtatctataatgttacataaaagatatattcatgtatgtttcatgtcatcagtaaacaaatctctgtgaatacagaagtgttatcctccttttagtatgcaactgcctgcaattatatctatttattttacaaggctgcaaaccaggaacattgggtttatgtgtattaaacccagtgatatttaagacttgaaatcataatccactttggctttctgaagtggagacagagttcttacaagagatttagtcacaataagatgaattactatcaagagaactgtttgttgctttgtctctacatagttgctgtagctattgcactgtttttattaaatagactcttttattatcgattattatctttctttccctccctccaagcccctttcagttaaatgtgtatggatggaaatttagaaggtgttatcctctatttttaaagtaaatataaggatattaaatgacttgctacatagatttcttgatgcattaatctaggttattagctttccttactaatgctgctgcttcttaaatttttttttacagaaacaggttattctctggctcccactttgagttgtaatagcaaaaataacaaaaataagctatcttttatttagtgtctattctgtgcccaggggtgtatgacattgcataaataatctcatttcattcttacaacattataatatggatattaatatactgaaacatatttttccaatcttgaacattacttttctgtgtaaatttcagtttcaagcattctgtgtaattttctaagtactgcattcatagtaatgtttcaaagaaaagaaactagataactgtaagaaaattgcaataataaacaggaaatataagaacatattttattaactcaatttgtagttcaccttggccttttacagagtagtttttgactttactaaaattatttttcagtttaggactgttaaggtgtgggcttggaatatatcatgaggttttaatgagtgttttctttctctctgaaaagagtaagacatgctagaatgttgaaaaataattttcaggatccacagataaacaaagaggggatctggattaaaccacaattttgtgctaggtttttgggctgggcacttcatatatatgacacatttaattgtcacagagccactgggggtaacactattgcatttcagaaaggttaagtaacttgcttataagcttctgtggaactgtaccatgatttaaactcaggcagagactcagatcctatggtggtgacatttgtttttatttctgttgttgttaactttacatcacaacatgttcccgcagtaaacagtgtcataggacagcagtactcacacaccaaaccagccatcctgaaatccagagaaattgttcccttcctgtgagagaaagagttagtgtttgaaactagactagcagggcagtatatgtgaaaatatactaaagcgttgtgcctattacatgataggcactcaataaataattgatgaatgattggatgaatgaattaatgatttagttgtatcaaatttaaatttaaccgctagatagttggtgtacgtttagagcaactgtgaatcttaattgcttacaaggtctggttggatatgccagatcaagttctagtgtattcagtcagctctgagcactggacacagataggctgatcctctatggttgcacataaggaaggaaggtgtgtgtttgtgtgtgtgtgtgtgtgtgtctggattcatgtatatagcgtggaaaagaattaacagaatagatggattgaaaatgagcacatatacatgaagaattttctatcactaaagtcttcattaattaattgacagtcattttttgatgatacttttgggtgcatcacctatatttctttagaaattatgtaaaaaacatatttcatccttttggattctcttacaataaaaaatataaataattcaaatgaaagtggcttaacaatagggatttatttatttggcaagtaatttaaaggcagatgtgtcagtgtggtttaataatgctcccgtaacaaagaacaccctgatctcaatggcttacagccacaagggcttattttttttgcacccacaaaacactcaatacaaatttacagggtttcctacaatggggacttaaggatccaagcagatgtagactctatctcaacatggcagggaaaggatctcaaaaggttctgccccaaagtgacacacattgtgttggacaaaacaagttgtatgagcatacttgacttctagggagatgggggaagagaaatgcaatgctatcttgttcccaaaaggaaggaaactggcctgtttgtgaaacaagccaatgaataccatggttagtaggtcaggattggcatagcagctcagtcaagtcagggcttgaagttggcattgctgacatcttcatgatgactgccattgccccaagtcttaagttctcacatgactgccccataggggcaggaaggaaatggagaaggaggaagaatttctcttcatgtgccttacttcgggagctttctcggaagtcccagcagatctttccttccatcttgtcagctagcactggtcacatagtgttccctagaataattcctctcatggaggaatgaagctactaggcttggcttaaacagtggttctctactggcaatgattttgtactcccaatgccttcccagaggacattcagcaatgtgtggtggcattttttattgtcacaacttggggatgggtgctattgccatttagaaataagaggccaggtatgctgttaaatgtcctatagtatgcaggaaaactccccacaataaagaattattttacctaaactatcaatagccaagattgtgaaaacctgccataaactaaacaatatccatcccttgagcccagacacagtgtgccagaacaaaatttgaattattttagcaaaagcaaaatacaaaaaggctgttagtggtataatcagtagtgtatatcctaagtactgaatatgtattttcatttgaatgacagctatcacccataaattttatgtatatgtgtaacttgaaaaagaaaatagagaaataaagaataaaatgatatgaaaaaccaagaaaaaccaattgatattcagactgccataagatttaatcacttctgatgatgccttagttgaaagtcagggcaattctacatacaaatctacaaatatatatatatatatatatatttagtgtttctttaatttaaatctactgttttcttttgacattgtgtattctatatatctcaccttttctacactgttgtaaggatactcatatcctattccaggtctttacagttagtcttttatcatgcttaagcataagaaatgtatgttactttaaatattaaaaatggttattagattcagggactagatctggaaacagcataaagtcgtggatactttttctaccatatactctattaaaaatgctctttcttcccacttacataaaagtacataagtatatgtaagtaaaattttaaaaacagaaatatattgtgctttaacatgtgtcaagtgctttacagagttatccatttttatttcacaatagtacatcaagacaggttttcattacttcagttcatagatgaggtgatgaaaacttgaatggtgaagtcagcttccacagtcatacagctagttagtggcagagctggggctcgaacccatctttctctcaagtccatgttcttgccaaactgccagggcaacacaggtgctttggactggaattcaatgttgaaaggacaggaaaaattgctttcataaagtaacctccatatatggtgtctttctggcataaaaatatcttattaaacacccatggcatgtattaagtacgtcatgtaatgaatatgttattattaagtatgtcttgtaatgaagaatgttatttctggattcttgtgccattggctaagtgaacttgatactaattattttaaacaagtaagtatattttgaatgtaaatgtatagataagtagctattacttgatattgcctaaaataaaaccttcgggaatgaactcttcacataccctctctaagaaaatgtatcatcatcatcatctctccttttgctaatggttttcaaccaggtctcaacccctggaacaaatataccctgtgagtctacaatgaaaaatcatattgagatgtattaaaattctggataaatattttttatcacactctctatatccagggctttagaataaatataacttaatttacaaaaatgtcacaaaaatagtgctctgaattcccatataccttttgaaagaggaaagaaacccaaaaagtggctcaatagtcaaagacaggtttattttggagaataaacctgagaggggcttctggccgatttttggttaggagtgctctttcttccagactaagagtatttactgatgagagagcttggaatgtttctgtgtaggggagaagtttatggtggggttggaatgtctcttgtcagaggagaggttatcttggggctgacatctctctgatcagaggggaggttatctagcggctggcatgtctctggtcagggaggggtttggaatatttatggttggagatgttatttgtggtttatggtcatgctgaccttagcccttaggctgatgccctttggatttaggcagtttttgatcaaggggaatttataatggcagtgcttgtgcaagatggcgatgctcctgctctgtcacctttaacttaggttcaccaattgctatcattttaccatatccactttatcattttctctctttctttctctctgtgtatatgtgtgtttgtgtgtatgtgtatttcttagctgaggacatcacacccctttaattctaaatacttcagtgttatcaaagagcaagaacattcattcagcaatcacaatataatgatataaaatcagtgtgttagtctatttgagctgccataacaaatgaccatagaccaggtagctgataaacaacagaaatttatttctctcagttctagaggctgggaagtccaagatcaaggctcaggcagaaactggtgtctgggaagagcccactttctggttcatagatagtcttcttttcattgcatcttcctatgatggaggagggagggagttctctggggccccttttatgaaggcactaatctcactcattatggggctgccactctaatgacctcacctaaaccatattacctcccaaaggccccgcctaccagtaccatcccactgcgtgttagggttttcaacacatgaattttgagggaacacattcagtctatagcaatcagagtatgtaatattaatataacgatatcaactttataggttttactcagatttcctcaattatctcaataacatagtttatagcaattttctcccagtccaggatcgtggctgcatagtgtcaccatgcctctgaatcttcctcaatctgaaacagttccaaggccttcaatgattcatcgcagtaccattttgaagcataaaatcagctgttttgtagaatattattcaatgtagatgtaataaacattttgtccctatattcacaaataaatagtagttgatgacacagattctgaagtcctgttgcccggttttgccactttctctctttttgaatttgggcaagttactcaatctctctatatttagggtttttctaacacataaggtagcagtaataataaaaaagtaactcccatgtaagagtattagaaggattcactgagttagtatatgtcaagcacaatacttaacacacagaaaggcttatctgtatttattacagctgttgttattgttattattgatgactagtgcacttaatatagttttaaaataataatcaaaataatgtgaaagccatataggatattaatattctgccagtgtagacttatgataagctgttccaaactaacgaagtcagtcttgtaaaaaaaaaaatcaattgtcttctttaatcatgctttctcataggcaagagaaaaacagcattctatattacactgtagccatgacccttcaggataaatagatcgtgtaaaattactacaagcatatgaaaaacttcatgtgaaaatcagtataggatgcagtacaacatgtcctataattagttagaaagggcctacgtaagccagacatttacacatcatagccacaagaaaggttaatttttattgaattgaatatttcctagtatgaaacctgtgcctcctctagctatttagacatcaatttcctataatcccaattgaatttgctgtattacacagtatcacaaggtcaaagaaaaatctaccatgactttgtttgacaagaggagaatatcagtcattactttctctcaggttagtgaaacacttgtacattgctaatttctgcccttctcaggcctctcaaatgacagaagtcaattaaagactgtttttgctttacggagattgacttcctgagatataagtgtgaacaaggctagataggaaggatccccacgtgtttagacaaaactaagggcaaaaaacaagtttattacatgtcatggaagtttaattctgaagaatttattcgaaggtctttttaagcagtgggttggaatgtcaacatttttaaaaacttttaaaattattttaaaaattttttgtgggtacatagtaaatgtatatattcatgggatatatgacatgttttgatacaggcaatgtgaaataagcatatcacagagaatggagtttcaattccctcaagcatttatactttgagttacaaacaatgcaattactgaatgtcacctttaatggaaaaggtctattcaaggtcatcatgcttcttgagagcatattcagacgagggttcagcttgccattgtacagtattatattgtccatgtgtctgtaattaaatgtcttttaaaattattcatccctgagtcttctgagggataaaagttatactcgtcatgtaattatttcaataaagatttttaaatgatagctccatattgctgattcccagacgcccaggctctctccgcttctctgcggattccttggtaaatgcccatgtgatttttcagaaagtgatttcttgagcaccttgccaactgctcaggattttcaggattaaagaactaaaccacatctgatttgaaagtaatctgtcatttattttttttctaattattactgcttagcttaggtttcaacaatgtaaatgaaagctattttagtttgaatgtgttaaaatgtgctgagtttaagtaacacatagaaagatatcaaactcatgagtatagagttgccttatttgaagccatattttagtaacattctatttaattaaatattctattaattattttatttaatattctatttaattagtagaacataatgtaacataattacatattaatgaccagagatctctcagaaattttacttatgttttgcttgcattaactactataaaacctcacaaaggagccaataatttgattaaatattttatagggccataaagaaaaatgagatgaagcagccagtaaaatgattttcttgtttttaagtctttaaacatttatctttagggcccttaaagatccctgttaaatattatatttgccattttctgattgttagatttaaaaatttcgtggcttgatttattagagtacaaatatttttttctaaagttggatagtttgttaaataaaaatttctttgaaaatgggcatacaatgtgtaacaaacacgggaagattttaaaaataaaacataaatttattttaaaaagtgatgtgtttaaaaatattcttacaaagattttcagtactcaaaattgaaagtttacttagtttgttcatatggaaaataattcatctaccaaagccattttgcagaggaaatacttgagaggaaggaagcttttagcacttcattgaataatttatgaacagaccaacattatattagtcaaatgaaataaagtgtcactcttaaaagagaaatcttgttcattgttgaagtttctatactcatttgagtaatggaaaaatcgagttgtaattgtttatctctattaaataaatgggtgaataatactggttacctgtttacttgtaacacactagaaaaatatactttattttatattacaatgaatcacattgaccagacatcatgaaatacaaatgcctgagatgcagcttgtctcgactagtgaggtagcttgattttgaaaatgtatgttggaggcctattttgaagaatatgcctggttaatttttttgtttgcttctgtggaaggagtgagtagaaaactcctgaaggtacgctctgctgttcggcttcctttccaccgtgctgaagatttggccagctctaagaagagcaccagcaggaaattggaccaaggtagattcagccaacatgacacaggatgagatagaaaatggggattgacaaggaggaacaaggggaaaaaggtcacagtagaagatggaagatggtgaaaagtggttgatatctaggaaactgagttattagagaattagggaaattataaaaatgattattttcatatacatttctgtgtaaataaaattataagagtaagatttgcataactcaacagaaaaatttctgtttttcctctttttttcggctatagaaattggataacaaatgttaaagcttttataatgtatttttaaacccttagaacaatgtctggtgtataataagtgcccaataaatgttaattattattatatttaacaagaccaatgggaccacttgcttgaacttgtttaatttatagatgaagattctacatccctgagagatatttttaaaaatgaatagaagtcagttttcaccaaaacaatagtaaaacttaaataaaattgtagctctgtattaattttaactgtattttgttggtttttaacacagaatggactgacatagtttctaatgataaagtaagaatttaaaagttagcacgattatacactaaattgctcttttttgcacctatgttttttaattcactagcatattatggacagaatgagactcctgtaggcagtagtaccggtaaaaatgaatcttgtccttcagctttctgtttttgtcaggtttagctcttattttcattcatatagaatgccttttgattatttctttttatactaataaattttaaaaactagaaattcgtgataacttcttaattgattaaaatgcgttagctgaacttagattcttctcaatcatttctctttacaatataacttatttatgttcacagctagtaaaaataattattacaaaatacattgaaggagactgtcagactatgattcgggggacacgtctgtcacctctttgaatatattaagcatctaattattatgtaatgaatccaatacttttgtatgatctagaacattgattattttacaaaaatcttgaaattttcttggttttcttctcagtatggcacacacttgagttttcaaaatttgcaacattaaccaaaaaacaaaaagtaacaggtaaaagcattgcaatttttagggactctgaatttcatttttgatatttattcttccactgagggagattgtattgaattcttttttttttctgtaagagtagaaaaacaaaaacaaaaacaaaaaaagcagcaatgaccacattccattgatacaaatttagaggaagtgaattgaaggtgcatgctgtgtgctttgcagaaactttagatttatttgctttggcttttttttttttatttttattgattcatctcaaagagagaagcaaaagatttcaggtctgtagtaagttacttttcacgaaagccccaaattttattgtttgttcagttttaaatgcaataagcaccatatagtattgaatatgttgcaatcaaagtttaacccttcatgtagttagtcctaaggaattattttattcagaaataaaatttactaaaatggagtaaatgggagaaaacagaggaatgtgctccaaataattcaagaacatgagcctatcaaatgtgacatccagaaataaataaattttgaaaagataattggttctaaatactattttaactcttttgtcttaattttatttcccctcctgaattatccttttcttcttttctgtttgttgccttcaactatttcttaaacctcttcagcctataaaccaaaagctagatgaatagatgtaaaatgtaaagcaaacatataataaaaataaataaggcattgaatataactcagtaaacagatgaaataacaagtgtcaatctaccttaaaaaacaattaaatactgctcataatggaaaacaaaacaacttaacaatttttgaaataaaatattttatcagtatgttatatttttctgaagcttgaagtttcttagattgtaccttaaaaataattcataaagaggttttctaacatttaactggatctgtaaaggtatttgatataaaatatatagctttctcagctgtttcttttagccatgtgaggattacatttcattagaacaaagcctggttttgtagcattcagcaataagttgtagcacacaatgaaactcaaatatataaaatgagctgaaattattttccttttctaacaccttttcagtgaaattccatgccattaatgagaaaaagattgaaaaaacgaattgctgtatttcctatctagcatatttttcagctgatagtcctctatatttctttgcttcttataaaatctgcttcaaaaaaattacaccaccccaaaatgcatacacacactccaccgggcaataacagatatttaaaacaaacaaacaaacaaacaaaaaaaacaagttttgggccaggtgcggtggctcacgcctgtaatcccagcactttgggaggccgaggtcgggagatcacttgaggtcagaagttcaagtccagcctggccaacatggcaaaatcccgtctctactaaaaatacaaaaaattagccgggcgtagtggcgggcgcctgtagtcccagctacttcggaggctgaggcaggagaatggcgtgaacctgggaggcggagcttgcagtgagccgagatccctccactgcactccagcctgggcgacagagcgagactccgtctcaaaaaaaaaaaaaaaaaaaaaaaaatacaaaatttgctgggcatgatggtgcgtgtttgtaatccctgctactagggaggttgaggcacgagaatcacttgaacccaggagacggaggttgcagagagccaagattgcactgctgcactccagcctgggtggaagagtgaaactgtgtctcaaataaattaataaataatataaaaattaaaatatatataatataaaaatttttaaaaataagttttgaaaagccctttgcttgggccattttaactgtccattttatagaccttctaggacccagccttcctccttcctggtgaatctgggagaagtcagtgtaacttaatataacttgctctttaatacacaaaggggagtgctctgtgtgggtaacagacgatttcagatttgaattcccaaatactttgtcatgatcaagtaaggaaggagccaaaatttggccccactcagtcagcaaataatcatgtttctaaattgctctgagccattggctttgatccaggtttaaaatgagttggtttaaataatggcactctgaccctctgattctaaattttcagtatgtttcacactgcctaggatcatgagaccgctcggaggctcagagaggacctcgtgtggcctgataattgctgcagcacgtatagcggtgtgaccctttggaactctgaagtcagagcatgtcggttaacccagagtgtggccacatgaacgctgtgggaggcaggaggaattttgagataccctccccagagaagggccttgggtagcagtcctaacacaaaggactccactgagaagtgttgatctgttagaacagagctgggtacatgacagtgttctggctcaggtcaacacttcctggttccagcccttggtagggtgctttccatagctctgccacatgcttccggggagttcagaagggcccatcctggtccctgcacaagtacatgtttcaatcagaacagctgatcgataaaaagagactagcacatgtaaaatcattgcaaccccatgaaagtgattgcagtaggtctgagaagcgtgagtcattgagggctgaacagtcagagaacaccctgcactgatcagtctatccatttgctccataaacattgcagactcattcattctctggctggattgtgttaagctaagaacacaaaagtgagcaagactcagtccctgctcttgctgattttacacagtattcattcatacactatatagtcataatagttccaatttcagttttaaaaaaaaacaaatttaggttatttgagtccttttttttcccaaaaaaaagtgtccacaatattttgagttttctttttttaatgattattatactttaagttctgggatacatgtgcagaacgtgcagttttgttacataggtatacacatgccatggtggtttgcggcacccatcgcctgtcacctacatttggtatttcttctaatgctaaccctcccctagcatcccattccccacaggccctggtgtgtgatgttcccctccctgtgtccatgtgttctcattgttcaactcccacttatgagtgagaacatgcagtgtttgattttctgatcttgtgagagtttgctaagaatgatggtttccagcttcatccatgtccctgcaaaggaaatgaactcatccttttttatggctgcatggtattccatggtgtatatgtgccacattttcttgatccagtttatcattgatagacatttgggttggttccaagtctttgctattgtaaatagtgttgcaataaatatatgtgtgcatgtgtctttatcatagaataatttataatcctttgggtataggcccagtattgggattgctgggtcaaatggtatttctagttctagatgatcgccacactgttttccacaatggttgaactaatttacacttccaccaacagtataaaagcgtttctatttttccacaacctctccagcatctgttgtttcctgactttttaatgatcaccattctaattggtgtgagatggtatctcattgtggttttgatttgcatttctctaatgaccagtggtgatgagcattttttcatgtctgttggctgcataaatgtcttcttttgagaagtttctgttcatattctttgaccattttttgatgaggttgtttgctttttttcttgtaaatttgtttaagttctttgtagattctggatattagccctttgtcagatggatagattgaaaaaattttctcccattctgtaagttgcctgttcactctgatgataatttcttttgctgtgcagaagctctttagtttaattagatcccatttgtcaattttggcttttgttgccatcacttttggtgttttagacatgaagtctttgcccatgcttatatcctgaatgatactgcccaggttttcttctaggatttgtatggtcctaggtcttatgtttaagtctttgatccatctagagttaatttttgcataaggtgtaaggaaggggtccagtttcagttttctgcatatggctagccagttttcccaatatcatttattaaataggaaatcttttccccattgcttgtatgtgtcaggtttgtcaaagatcagatggttgtatatgtgtggtgttatttctgaggcctccattctgttccattggtctatatatctgttttggtaccagtaccatactgttttggttactgtagccttgtagtgtagtttgaagtcaggtagtgtgatgcctccagctttgttcttcttgcccaggattgtcttggctatgtgggcccttttttggttccatatgaagtttaaagtagttttttccatttccagtggtagcttgatggggatagcattgagtctataaattactttggacagtaaggccattttcacgatattgattcttcctatccatgagcatggaatgtttctccatttgtttgtgtcctctcttatttacttcagtagtggtttgtagttctccttgaagaggtccttcacatctcttgtaagttgtattcctaggtatttgattcttttagtagcaattgtgaatgagagttcactcatgatttggctctctgtctgttattggtgtataagaatgcttgtgatttttgcacattgattttgtatcctgagactttgccaaagttgctcatcagcttaaggagaatttgggctgagatgatggggttttctaaatataaaatcatgtcatctgcaaacagagacaatttgacttcctctcttcctgtttgaatacgctttattgctttctcttgcctgattgccctggccagaacttccaatactacgctgaataggagtggtaagagaggacatccttgtcttatgccggttttcaaaggaaatgcttccaggttttgcccattcagtatgacattggctgtgagtttgtcataaatagctctcagtattttgagatacattccaccaacacctagtttattgagagtttttagcatgaaaggctgttgaattttgtcaaaggctttttctgcatctattgagataatcatgtggtttttgtctttggatctgtttatgtgatgggttacatttattaatttgtgtatgttgaaccagccttgcatcctagggatgaagctgacttattgtggtggataagctttttgatgtgctgctggattggtttgccagtattttattgaggatttttgcatcgatgttcatcagggttattggcctaaaattctccttttttttcttgtgtctctgccaggctttggtatcagaatgatgctggcctcataaaatgagtttgggaggattccctcttttttctattgattggaatagtttcagaaggaatggtaccagctcctctttgaacttctggtagaattcggctgtgaatccgtcttgtcctggactttttttggttggtaggctattaattattggctcaatttcagaatctgttattggccttttcagagattcaacttcttcctggtttagtcttgggagggtgtatgtgtccaggaatttatccacttcttctagattttctggtttatttgtgtagaggtgtttatagtattctctggtggtagtttgtatttctgtgggatcggtggtgatatcccctttatcattttttattgcatctatttgattttcctctcttttcttcattagttttgctagcagtccatctattttgttgatcttttcaaaaaaccagctgctggattggttgattttttgaagggtattttgtgtctctatgtccttcagttctgctctgatcttagttatttcttgtcttctgctagcttttgtatttgtttgctcttgcttctctagttttttaattgtgatgttaagatgtcaattttagatctctcctgctttgtcctgctttctcttgtggggatttagtgctataaatttccctctacacactgctttaaatgtgtcccagagattctggtacgttgtgtctttgttctcattggtttcaaagaacatctttatttctgccttcatttctttatttacccagtagtcattcaggagcaggttgttcggtttccatgtagttatgtggttttgagtgagtttcttaatcctgagttctaatttgattgcactgtggtctgagagacagtttgttgtgatttctgttcttttacatttgctgaggagtgctttgcttccaattacgtggtcaattttagaataagtgtgatgtggtgctgagaagaatatatattttgctgatttggggtagagggttctgtagatgtctattaggtctgcttggtccagagctgagttcaagtcctggatatccttgttaattttctgtctcgttgctctgtctaatattgacagtggagtgttaaagtctcccattattattgtgtgggagtctaagtctctttgtatgtctctaagaacttgctttatgaaactgggtgctcctgtattgggtgcatatatatttagggtagttagctcttattgaatagatccctttaccattatgtaatggccttgtctcttttgatctttgttggtttagagtctgttttatcagagaccaggattgcaacccttgctttttttttttttttttcttgctttccatttgtttggtagatcttccttcatccctttatttcaagcctatgtgtgtctttgcaagtgagatgggtctcctgaatacagcacaccaatgggtcttgactgtttatccaatttgccagtctgtgtcttttaattggggcatttagcccatttacatttaaggttaatattcttatgtgtgaatttgatcctgtcattatgatgctagctggttattttgcccattaattgatgcagtttcttcatagcattgatggtctttacaatttggcatgtttttgcagtggctggtaccagttgttcctttccatatttagtgcttccttcaggagctctttttctttttattttcttttttttttttttttgagacagagtctcataaggcaggcctggtggtgacaaaatctctcagcatttgccactttgagttttccttacatagaaaatgtatttatcatgtgttttctgtacccagcacagtgcttaatacatagaaggtagttaaggaatctttgctaactaaaggaatcagtgtgtttttgtactgaatatgtaataagcatttagttgggcatgtgtctgagacatttgggaaggtaattcttcctcagcatgacctgacgatttctgtcccatctcagttcaactgagtaagtccatctgcatcattttcttctacttcagtctggggcagccctggcacaaggagcatagagtacatgccaccaagatgtccccaaatcctccctctggtcacctgaaaatgacatctctataatcagtccccttgaggttattctctaaattttgtcctaagagattaaaaatagaactagattatcagctctgggagtggtttataaatatgtttattaagtaatagcaaaacataccaaaaaaaaaaaaaggtaaagcagcatgccttatcactctatagatactatacttccttacatgactatgacaagagactgatcaggacagcaaggcaagaatgaaaagacgcatgaaaaactttgaaggactggatttaaaacatccattaggccagtcagacaaacctgcataggcatggaaggcagcaataatagccaagcttagaaaggattattgtacaaaagtgtatcaggaaatcctaggtgctccaggactgcatacttactcgaagctaaactgtagtaggtcttaaaaaacaatcaaaagtaacaaaaagccctgaatgacctcagacctaatcacaaatttaggtgttgttaatgctagtccttcagagtaatttcaggacactttgagcaatattgtatatatttagctgatttcaaaatttaattctcatttcaatttggtaaatcatttaaaaagaaggccagttaaaaactgacttttagagaaagcccagatatgttgtattacaataagaatatgaaaaaagccattagattatataagtagatgttttcacaattttttttttttgagacggagtttcactcttgttgcccaggctggagtgcaatgacgtgatctcggctcactgcaacctccacctcccaggttcaagcgattctcctgccttagcctcccgaatctcattgccaactattatgttaattgaaatatataaaatctactttgaatacttatttgtgtactcaaaatacctttgcctgctaatgtgcaatttcatatgcattttttctcataaaattctataagaaaagtatgctatcagcatgatttctgaatccactaaaaagcacactatattaaagaactattaattgtctttttgttaagaagcctaattattgcatatggtctaataacccagcaggtatgctatctttttaggtacgaaaccaaacatactaatttttaaagcaacggggagatctttttccagatggaatcttctactttggtttcaggtaactagattgtcctctcatagtctaagaccaagcttattagtcagtgtctctggcatgacttactggatgcattagggctgaactaaccccctcacctgacctgtgcccatagaaccttttgccctgtcatcccttctgtcagcctttcctggtgtatttcctcacccacaatgttaggaggggacttgttcccagactgtgtcgagggcatcgtagcacttaggaatgttggctgagtgaattgcaccacaatatcagcttcatggggcagggacttttgttctgctgtttgcagctggtagaataaaggtatctgctgcagaaacaagtaatttaaagtataattaggtctttaggaaagaaaaggggaaaattctattaataccaggattcttgtgatattcacccaagaacagattattagaacatgtatgagtggtagaattaagactcagtaggcgaagaagctaaagacatgaaatttaactcggcctggtaactagggcaagttactttaatccttctgatcatgtttcctcatctctaaaatataactgcaaatatttctcctcctcctggctttacacaattgttcaagtctataagataagatatggcagttttattcaaatatatgtcaaaatgactttgtcagtcttgttttatatacttggcccaatcacatatatcatttgtgcttcagaacagctacaatgaagtgggaattattatgcttgtgctttacagctaaagattctaaaaatcagagattaaataacttgcccatggtttatggctgcctgtggcagaacccagattataacccaaagcttttaagatgtcacattaattcactccaagtcctggactaacgttattttttataacctggactcaaattacttctgcagcttttcaaatttgttttgggtttaacatgaatgtaaaattttctaataataaagctaaatcattattgaaattgattaagcaatgaagtgagaaacaagggtaactaattatgtgcaaagtgagcctgacctatagaggaaaatacatgtttgaaggaaagatcgctaccaatttcttcattttctccaattccccttagttatataattgaattctctgccatgcttttcaagattttaagataatatttcaacgtcaggatcattccatgtcaatttcatttgcaggcatgctttactgtcaggatcaatggttctttgtaatttcaacttgaaattcactctgcctcttggtaccacctgccaccgaactagctaagcttggttttgacacagttcccactttctaagtcattaataacactttggaaataccttcatacttgctacaaatcactcagacaaaggcatgaaaaattatcaggtcgagattgtgtgtatgtgcacacacacatgcacacaggactatatgaagtattgtgtaatctgattgttttaaatccgcttctcattcattgtaaggaaatttgagttttttaggttaagggggtaaaagattttgccttttgcctcaccttttggaacccacagactcagaggctgcaagagctacaaagtgcccttgacaataagctcctttctaaaaatgaggggagtttggatggggtgaggtggggttgctcacgtttacagagccactgtgctgagtccactctgcttccagcctctctccagctctgtagtgttgattccgaggcagccaccacatcaccaatagtgacccaagtagctaatctttacatagaattggtcagttcattcattcttttatctcttaggcttcctctgtagtagaagtcataagatagtgaatacagtgtatttcctgacttctaaagatcctgcaaaatattagcaaaattcacaaccttaacagctactatgtgacagatatgtgttatatgtcagatactgtgataagcaatgtatatataaaattcattcattcaaaatacattttttgagtgcctatatattctgggcattgtcctagatactggggatatggcagggaacaagacagacaaaattccccatcttcaaagaacttgttttcctttttggtacacaaacaaaaataagtaaaatatgtagcatattaagttgcaataaatgctaaggggaaagaatgaagcagagaaggaaaatattgcagtgtgatactgaaattttacctagggtacccaggggaaaagctcacgagaaattgagtttttaattgcatttcaaatgacaaaactacatcaaaagcaataatgtatcaggagaacagtttgcacacaattcgcctcactgatacaacttccctttggagtgtatttgcttccagcctttgtcaatatgcatgcaggtgttccatattagactcagcagcattttcttctctattgtagctataggatagaatatcagtttagtgaaaatatttggaaaaaagcgagggagatagccatgcaggtagttgtggggagggcactctgggtagaaaatatgtgccttggttatttcagggacaacacagaggtcagtgtggctggagcaaaggaaacaaggagaggagatgaaagtgctacactgagtatgatgagaagtcagtggaagccttcaaaccttcacattatctactgtcctctgaatttcacgtatgtgaaaacccgaggctaagagaaggtaaactgctttccccagatcattcagctaagtggcaaagctgaaatttcaaaatcttatacgtctgattccaaaatccatactaatgatgatactgtcctgcatgtattaaaggaagaccaatatgaagacctgaatacactgcaacaagtgctatagacaaagtaaaatcaactgctgcgtgaatgttcattacatctgggaggatgtggcaagatttcttggaggagttactgttcaccttggatcttttcgagagacatggatgggctaagggcattccagacacatggtcaagaaaaatatcccttttgattttgtaaccattaaaaaatctttatgtacaaattgctttaatattcttgtagttgttgtttgcctgttttttctttcaaaaaggcattacaaagggggaaagtgcaatgaactgtgagttaaaaggtgtgattctcaaggattttgacgagatctccctatccacatgcctcctagacattccttcatttgatccgcaggttcgttgaactagacatgcccagaaatacactcattctcttcatctgtgaacctacccctgggttttcactcccagtgaatgttaccatcatccactgagttgaccacacttgaaatctcaaggtcattctagattagttctttttgcctccaagtcagcctctaactccaaggcttgtcaatattcttacttaaatatctgttgaacccatcccttttctgagccccctgccaccaccactattagatccgtatcaattctcatggattaaggaggaaaaagcatcttaattgaatatttgcttgcagtcttttccattcatttgttcattctaaacatattaaatggctacttatagatattatgacagatgttgggaatagaaagccagatgactgccttcaaggaatttaccatctgtcaggagaaggggaaatagccaagttaaacaggtgaatatgttgcagtatccatatactcaaacagaagtggatccagggggcactcatcaatttttggcaaagagaacctaatcaggccatcccgccgattaaaatcttttaattgcatctcattgctttcaggctaaagtgcacatagttgagcagtgtgtttataaggcctgtgatggttgatactgaatgtcaacttcattggattgaaggacgcaaagtattgtttctgggcatgtctgtgtgggtgtcgccaaaggagattaacatttgagtcagcgaactaggaaaggcagacctatcctcggtctgggtgggcaccatctaatcagctgccagtgcagctagaataaagcaggcaggagaagacagaagaacagacttgctgagtcttctggccttcatccttctcccatgctggatgcttcctgcccttgaacatcagactccaatttcttcagcttttggactcttggactgataccagtggttttccaggggctcttgggcctttgactacagattgaaggctgtactgttggcttccctacttttgaggttttgggacttgggctgatccaccactggcttcctcgttcctcaacttgcagatggtctctcgtgggactttaccttatgatcatgagagtcaattctccttaataaactccatctcatatatacatatatccaattagttctgtccctctagagaaccctgactaatacaaggcccttcttcatcaatccactttgtgactacccagccctacctctcactattcctcatgtgcaacctacaaccagcggtacaaaacaaccaccgactgttggattttctctaacctagcacctgccctctgttttgctgatttattctctgttctgcaggctcccaacacacacgcactaatgcttcacctccctgaagggtttgctgaccactcctgccacctctcaagtgactctccaatgactctcctgtaatgactggatcctgattcactcaggcctctttgagctctaggagagatggggcaacctccatgctagtacttatcacactgaattgtagttgttactttccttacatcatctgcctagactctgaattcttgagggaaggagctgtgtctttctctctgtatattctacatcaattcagtgcccaacacgcaagcggtactaaccaaaagcaatgagagtaatgacaataacagccctacatatagtgagcatttatccaggctgtttgctgaaggttaagtctggtaaaacatacaaatatattttctcatttaaatgctatataaatatagattatacataccccacattacaaaagaaggaactgaggcacagagggattaggcagcttttccaagttttcattgcttgtgagtagtagagttgggtattaaacccaagcagtctggctccagattgtacaccattagctaccacactatagtgatttgaaaaagaatgttttattcatagtataataactattgcaccatacttatctctattttgtagatgaagaaaccgagaaaatcaaatgccttttctaaggttacccagataataaataaaaaaccaggattcaaacctaagatgaatctgactccagagcttgtgctaaaagaatgaatgaatgtgtgaatgaaatcacttcatctcttaaagtctcaatttcctagtttgaaaagtaaaacagttagacaagataatctttaaatttccatccaatttcaacaactgtattattttatattataataaaagtaggaactataggcgtgtgtcaccatgcccagctaattgtatcttcagttgaggtggggtttctccatgttagctcatgctggtctcgaactcctgacctcgggtgatccacccgcctaagcctcccaaagtgctgggattacaggcataagccactgtgtccggccaaatttaaattccctcagaatgttttggaggtgcttcaataacaaaacaaaacaaaaaatactttgctggagttcacatacaaatatgatacactaaatagcacaaaaaagattacatttcaagcaaaaagaaaaaggaagagcttctgtcatcacgtaactcatcctgatttctctaagggcatagagacctaagggcttaagggagcctggagaccattgctccagcttgtggatcctgtcccaatagcgtttcttcatcttgggtcggtccactgacatcagcaactgatatggggtgggtacggctgtgccagccttccaggcagccagctgccctggcctgccaatccattcttcacccagcagcagcactcatcactgctgttgttttagtcacatcaatcactttcccaattcagctttgtatcaaatccaagctcccaattataggtttcaaattcctctcccaattattcttccctccgcgtaaatagaaacatctcctcactgcctgcttttgacactgctctagtgaacatgcttgttccaaggattcacatgccacctccttcctttacctcctagcttctcaaaggtgttgctttctgcttacaaaactactcaaagtcacttcctctggctagcttttccaaaccaacaactccagactttggtatttctagtctctttagtatctactgagaggttactaatacaggacacacatcttacaccaggttactctcattgcctaatggaaagcctgtgactgaggcagaaggaatcactctgagttgcagctctgcaaattattccagcatcacctttattcatctataaagatggaaatattattaatgcaaagtcctttcattatgagaatcaaatacactttaattcattcatttactaattaatgctcagattgagtacctacgatatgtagacactgctgtataacaagatatgtgttcagtagatgaaattaacaatctctttgtgtgtggacaatcaaaactgtatttgtacattttcctcatttaactttagatgtttcaatattaatcatagtttttaatacttagtatataaatttttttaacagtagagaataatcatcaactgaaaaaatttttatattttccatttcaaaagaaataataaaacccttttttccctatacctaacctcccatttacactcaaccatctgaaggatctgatatggtaaagatcaaacaggtgttctaacgttccgacaagctcaatgcttgcaaattctgccaaaatctactgttttatagtaagaacagatggtcacagatgagcattgcttcagctattgatgatgttgaagacaaatctttatcacagaaagggaaggaatggaatttttagacataaccattttctagatgtagaatgcattatgcacgccacacaggctatcattgtgattataatggaatgaaatccaaatgtaaaagcatgttgataaagtacttggctgccttcctacacagggtatagactcattcccttctccacgtttgaatcataacataaaaatattttatgtatgatatttgcgtgagattctcgatgatactgaatgatcggattcctgctagagatatttcactttttatgacagataagtgtttggcattttctttggcttttccacacaagggatgatcaaacagaatgaaagaagaatgagtcttatcaaatatcaaaatgatctaaaaatgactagtttcattctgacagaacttgtatcttaatgtaccaaatagtccactgaggcatgaacattcaattaagttttgaattaaatatcaaaaaaagatgttatatcagagattttgtgtggctcagtttaagatattctagtctcctcagtattagctaatagcttcttgatacagataatttataggtgatggtgatctatgacacatacaaaaaacagaccaactggtttctttgattttctttttctggcacttcattatataaatgggctctgtttatctccaacttttccatgccactttgtgtaacaagggcatctttttacagtcttatgtgtttatgagtgtgcgtgtctatgtatgtgtgtttctctgtatgtgtcacttatattgggttcctgccaagtagtctttgctataaatttctggagaacctgatgactttgaccagattggcacttcctgttaaaatactgaagtcttaattctgaagcatttcagaaacatttcattgtgttctttaattatactagtattatacaacatgtgttattatatcttcagaatggaagacagatctacaactgtacttacaattacacagacttcaaaaatgtgggcctgatttctgctggttgagggagtcattattggatgatttcttgattccttgagtattgatgaagagactgcacaatgagctttaggcagaaaattcaaaaacttaaagtcccagcagaaagcaaaactaaagcacttgaaaagaagtttctgccaaaaatcctttaagaaaattcaaagtaagtgaaaaattgatttattttacatattgattttctgtattaggtagtttctatatgcacttaaactggattgtgatttgtaaaaagaagtttatcagttaagcttgagaaacatagtttgtaattaatctagagcctatggtgtgtaggacactgaggaaaatcagaatattttgtgaattttgaagtctaattggggaggtaaataatgcataaaaatatttatgattaaacattaaagtataattcagacaaacagtatcacatgacttattgtcaaatgacagataaatcttgaatttagggtagatacaattactctgtcccaggagatctagacattttcacagataagggttgcatcggtgtttcagaacaactctacaaaggacacagttattcaaaataaatattattaatttttataattaaaacttagatgtataagaaacttatacttagctttatcttccttctttatggataattctatttaatacatttaaaagttacttaaaatacaggatgccaaaatataaagtaaattagtctttaactcacttatttgctctttgctgaaacacactattttaaactgaagaagaggagatagcacaagccacagaaaattagagatggtttctaaaatatgagatgattttccttactgggcagtaatttagatcctgtaatgtatgttacaaagattttgtaggatgaataaaagatttatagggtgcaatgtcatttaatatcatactgtcaaatgcctatagtgtagcaggatatttactggaatagaagaacaagaggtggaggagaaaaaaaaaagaaggagaaggaaaaaattgaaacgcaaaatgttcagggatcagtacaattatagattttccttgtgattctggatttatcctggatggagtgaaccacagtaggagtatttactcttgacttataattaaaggtttcccatatcttttaaaagaactcggagaatggaaagaaggacaaatatgttctccaccttttttatgttaaaaatgtgtataaatataacctttaagaaaaaatacttaacatatattactctcattgtattctaactttcccatttttattaccttgtccatgcattttattcagttcagtcattatctaaaatttatttggtattctgttgtcaaaaatgtctggtatactttttaaagagttgacctactttgtttcaagtaagaagattttagaagtccaatttccatattctaagaggtccctgcaaaggtttttgcccttgagaagtcaacttcctcatagctattttgagaagaagaaactttaacagatttggtgcagaagatttcaggagaaagttacaaaaaaacaggatggaatattttgtgttgccatttataaaaagggaaacctttccatgatggaaggccaggacaaccacctgttcttcaaaagatagtggggagggggaaaaaaaaactcctctaatctaaaacgccatcatagtggagaccagatggtggatttctttggtgagtacagctatctggcctttaaaacctgcttcattgttgttacaagtgtgtataaaaaggcttcaggctgttgcaatgctgcacatcagttgtcaattattgcatagttgactgttattggatttagaaatatttgtggcatttgttagctgttgagtcacagctttcagaaatagactagtctgtaataaaaccttaagaagggaggggctaggccgggtgaatggctcacacctgtaagtggttcccaacagtttgggaggctgagatgggtggatttcttgagcctaggagtttgagaacagcctggtcaatatggcaaaacaccatctgtacaaaaaagtacaaaaattagctgggcatggtggcatacatctgtagtcccagctactgaggaggcctaggggtgaggatctcttgaacccaggaggtcaaggctgcagtgagctgtgatcatgccactgcactccagccttagtgacagaggagaaactctgtctcaaaaataggaaggaaggaaggaaggaaagaaagaaggaaggaaggaaggagagagagagagagagagagagagagagagagagagaaagaaagaaaggaagaaagaaagaaagaaagaaaaaagaaaggagggagggagggagggaggggctataaaatggagacaaggaggcaaggagtgcaggcttctccctcattgatgttcttcctagtcctttgaggttgttgggggaagcaggcccctcatttctagcttttggggagttggtttttaccatagttcacctgatacttctagttgccaatctagtatttattctaccctttttcctgcagacagaaagacagaaccctgattttgtttgggaaagcattatccctagctctggagggatactcattttcccagtctcccttggattggccatagtgtacagctctgggcaatgagatataagcatactggaaatttcttccacattccccttctcctgctgtgaacatagatatgatttctggaacagctgcatgagataacaagcctaaggaaaaaaaatgccaacacactgaggaaggaagagggaaaagattatagtaacttaggtccaggctggcattactgaacagctggacccaagcaagcaaccccttacctctgactttcttattatatgagaaaaaattgcctgaaatgtgtacaagacacctggtggttatgtatgttgttatcagtagtctagcacagttctgatacccttgcaatggtagatagaggtgtgctaacatgattgctcaatatcttgatctacccatgtctgacatcaccaggtgactacttaatggaagcaaaggctgtgatgagtccctcagaagagctcaatgtttcctctaaataactcagattgaagtggaatatgggagtcagatttattgacttgacctggattgttaggttagaacttctgtacccccatattcttccaaagaagtaagtgacacttatttcatgtgaattaaattttaaaatgcctaaaatttttgggatgcaacaaaaatgtgcagtgtaggcaatgactttgtagtctgaaaactcataacactctagctcattcagtgtcatgaaagagttaatgtaaccttcaaagttgtctgatttagaatgaaagtagtttcagctagtcagataatcttcctcgatacttataaaaccaccatacaattagtataagttgacatgcctatggtgaataaagtaaatgagaagaaagactaaaggaattttaatgagctatgccttaatcatccccccaaataaatctaataaggtgtctctctttaactttcactgatgttttttcttcccctaattgttccagctacctatgtgtggatatgtacatttctctttgaaaaaggcttagttgccatttctctcataactcacagttcttctcctttgtttctgagtctatgagcacctaccaggatttatgtttacggatgcactccgatatttggctgtcaaatttgcctagagttctattaacctggtgataagaaaggatataataagccaggcaacagagttgaaaggatccattgtaagtaggaaaagaaaagccaaaaaagcaagtgtttggggtcttttgaacttacccttaaagttattgtacacacaacaagatactttttttttaagtacgaagttgtaattccctacagtgtcttgtacatagaatagaagtcattcaatagaaaacaagtgaatgcccttctcctccatctttataataagtgtgttggaatgcttttcttcctgacagaagtgtgctggtgggccttccagtggtagccaacacaatgaacacactgcagtgtcagcccagttctatatcttcaaaactgttccaatattggtattcctggaaaatatgtgcaaagaacagaacaaagtcagcctgaaaaagaggtgaaaggagtgaggcaaaagagagcatagactttatatttttttctctggatgaaagcaaaatgcattaatattagttatgatcccttggaactcacaggcattttctgtttcaactcaagttctgttcagctaatctcatgttataagtaaagatttgtttcttttaagtatccagcatccatttgactcttgtgtcatttgggaggaaagtgccttgtttattgagcattttgctggtcagcctgaaacattggcaataacacattctaaatctataggaagagtgtttcataaaaaggactagattgacatcaaataggccatgagggattcatacattgatcttcccctgatgtttcctctgaattagctaagacagctagactaacaatggttctaatgggaaagataaagaagaccaaatggtggagaagcagcaatttaaacgtttaattctgattttcctgtttatatcagttataaatttagataattggaggtattcaaaggagaacagctctgaatgcttttgatggtttatggaaggtcattcacctcctaagttttattgcttaacatgagatggcacagcagtcctccttgttagaaaaatgttgctgacagtgatgggcatttacagcaggcagtcatcagtacattaactcatgtaatcattgatgctatgatagaaattttggcagtatttgtcactcattctaccttttcattaatgtttcctttgaagcaagttttctaagacaatatctttcactaaaattctaaatggcaaataggtgctgtatttaatcaagggctaaattctattccttcactcccaccaattctatatcacaagatttttttgcagatctctaggaaggaatttatttttcttacgttaagaaaaaataattccatccatctgagtcccactgtaaaccaactacagctaggtcagggttgtggtatgagaagagaacttttaatatgcctatatttagttaaaaaccatctagcaaaggcttagaagaagaagttgaagactatttaaccatacaacgtccattgccctgacatgaaactctgacatacatatgaacattcatgaaagcaaatccacggtcaacacaataaataccctgatttgatcattatacaatatatgtatgtattgaaacatcacattatcacatttttgctcaataaatatgcataattacaatgtgtccattaaaaagtagtttttaaaatgcagctcattctcatttactcaaggagacctaaaatatggagatttttccaataatgaaaataatattgaaatgtttcatttgggattagaatcttttatggaacagttttgagcaacatcgtcaccaagtgaaccagtatctgtgtgatttgggaactttttctggatagctctgtgggtgaacactggatgtctgttgaagattcccttccagcaattaagtaatcataactttatgcatgtagctatagtgagagattaaaattaagaggtttagtgtcagttttaactagtcaagttacttaatttctaaatctccgttgtctcgtcttgaaggtggagataataactactttaagtaaagcatgtagcacaatagctgataatctatgttttcagttattactagtaatgcaatgtagctcagaaatccacaaactttatctgttaggttagaaacattggcacccactttcatgttttcttatgttttacgtcatcaaatggcaaactgagagatgaacatggccatcaagtaactctctccctgacttagtaatttcctttctgtttccctgtccataatacaaagagtcgggggtgggagtagagggacgaaagtcctcatatggaaaaaaatacaaccaacctgttcttcctcttgaccatacttagagaaatggtaagtagactctggttaattcaaaaacattttacgataggatagtaaaatgagatttgttttaaaaattactctggaaaaaggatttataatggacaaatgtatatatttagaagattagaccatatcttggcatctggctttgtgaaccatacatgttggaaaacttaaccctctgcctgttctttcaacttccattaaatataatatgtttgctcatagcagcttatcgaacagtgatatgggcaggtaacagaaccatactacaaagaaaaattatttaacagtagacaatgtgtttccctgtataaaatggagcagcacatgggagtcaagatttctgtctacctcctttcttatcaatagattacataaagcatcccccccttctttttaggaagagtcagagtggaaaaggacttcaatatctcaggcctgaaggaaacctgttgaagcctgtcgggttttctttgattggttttctcttaggtattttctttctaattattctgtggtttcactggtattcactgcagaatatagctattctgtgctgggagattttgaaatgtgtctgttctaattttcttgcaatgagaaaaaaaagaaagtggactttgagaaaaaacacataaatatttttaaattttaaactatcattgtaaaccagtctttccattcccattcagaatgtcacaggattatagtctgatttctttataacctgatacctgataacactgatgccttcctgggtgtcttgagtgtgtctacagaagatcctgatttggaaggtctaataagcttttatatttcatttttattttttctatttggaaggaaaatgtgcaccacttgctttgtggcaaacaggggacctcagaggctgatattaagaactctctgcttgttagttatgactttctttcctgaaacaaccaatagtcagtctcgctgagtgacttaatgaagtaaaaccattgcaaatctatatacttgagaattctttacttgctaaaggtcaaatgtgaagccattatttttatttgactcaccagcctctattgcacttattatcagttctaatactgtttcatagaaccacaagagtttataaagtaaatttaaatggttgctgaaagttagataactagaaatattttgtagaatatacaaatacattttcctacttcccgatatctgaaaaccactaaatgggttaagttaccttccaaatatattaaatactgcttccagatgagcatgacattgttgaattagtattggattgagtccctcaggtattagcaacagacaagccacgattccatgaacacagaactatgttaaagcctgaaggaggtaatgactaaggttaaagctggacttctggtttcaaggaccttgggggctggttggaaagaaaaagtaattagacatcaagaaagtaaagcaagttgcagcccctggttattagtataaaaataaataaggaaaagagagctctgtatagatcgtggtagatagagaatgcttcatggaggaggccaatgttcagttaagacttaaaggataaacaagaatttcatgtgtggagaaatagaaacaaactttccaggctcattcaattactcatgcacttttgcctagcacttatttacctaggccagggaatatgcatgtgagataattctctgttcccaaggaccctcatttcggttctgtgaatttgataagctttttccctttgtaagttctttgcgcatgatattccaactacattgctttggattcttccccatcatgagctgcttcttccaggcgtcaaaccacacattggagtgtcattgtgagagcacagaattcagagggagacatcatgagcaattcttacccaccagccctcctttcttcccacattcttctcaatcgtggagtatttctaccactagaaccatttcttcaatgacagaaggaaagggaataaaccagaaggaaataggcaatagaaggttctatattagtaaatgttaaaacgtttaaaaatacattaagtatgggccaaactcttttaaaagtcaaaaaaggggtacctaggaataatatggtagtcatcagggaaccatggaattaatggaatgtggaggatagaaatgaaaccacaaaactcattttccaaacagtaaaaccacccaaaagtcccatctcttcctaaacggacaacaaatgcctgttatggcctttttttgatgtcattatttattgttactgttgtttgtttgtttgtttaatttgtctctgttctgatctgtgaaggctttgcctcagatacctttaccccaaccatctgttctcctttctgttctacgaatcccatgatgccaaggagtatgttttattaatttttgaattcctgcctccgagcatagtgaatagaaaaagcaaacaaatggatggttgttgggagaaaatggaaatgtgtcaattgtaaaagattgtcttttattttttacaaattaaatattacatagtattttgaataccattgtggagcacactttactgccaaagatagtaaatataaaaagtcttttatatcaagggatgattccaacacatgtaagagtactgagttcccactctagccaaaggagtcatggtgcagtagaagaagaaagggacagggaattgaagaatcttgttcatatgccaatttcacctctattaaccagtcaaccttctactcatgccttaaccactttagacattggtttcctgatctataaaatgagggacccagtaagggataagccatatttttatatgtaaacatttccaatagagttccagatacatgtgttagatgaatctgacccttgcatggaataagacacttatctgctgtgtggtctggagcaagcgactcagcctctctgattcttaattctttaaaaactgagtatctccaaactctggagcccattttattttgttttattttattgaaattttatgaaaataaaataccatttttaatccagttaagttaatcttcaataagcatgattacatatatacccaactgcattttagaaccaataggaagctatctagcactcagattaggcaaataaattggacataaattacaggagaaataaggcaaagctatactaagagggaaagtgctagcaaaacttacaagtggttcagagtactttaaatcattttaattaattttcattctacaaacatgtattgattatttacagtgtgccaggatctattctgggttgtaataacaaatcaggattaggcttttccacagaaatttagtcttgagattgttgtgctcctgggtgcttctcaaaacaaattacattggtgttgttcagtggcacccaacctggggcactactaacctcagagatcttcaccttatcacctagccttcctggacttccacctatgcacttatcagatgatggtcccttccagcttaagtgttttaagagggacagtgggcaacactgctgtagtcataaacccatggttgggcctgagctcatgccctgctcctgggtctactatcaagacatccctgagcagaaagagcctgcagcattgtcctgattgccacaaatcagcattaaattaggcatttatcatatgtgaaaagacactccatctgcagatctccaccattgtgtaaagttgtcacagacaatatgctacttggcaatctgcacatttaacaacaaatgggaaagttcaatagcaaccagaaataaacttgggctttagaatttcatttcttagatgtagttagtgtttggccagttcccagaacattaccttccatttatgagaatgtagagctaagcaaattcaaacctaaaaacatcttttaacttcctatgtgaacaggaaggaagagagaggatgaatgtaataagattctctgatcataggaaattggaatttgctatcttgccagaccatttttcttaatgcacatctgaagttggcaacatttccttggcagaaaaatgaaatcattctgattcaaagaaacatgaaatgagttggtaaagatttttctaatgacagtgtaggaagttttatgctgacaaataaaaggtaaatatacctttcctgtcaatacttaagggatataaatggtacactgaataatatagacttgaggtttttttgtgtttagcacctcaatatttgattacatcagaggtgaattagtgctatgtttgaaatacagtgaagcgtgagtaatttatttttctgattagggttattatacaaatcgtattctgaaactctgtagtcccaccataatatgaaggcccccaggggcttcagggaactattactgtaacaattgcatatgtaaactcttttcaccacaaaatattaagaggttaaatgctaataggcctttaagatggttggcttgaggttttcttcatctcctgtttgatgttaagcatttgttaaaaaaaaaatcaaagaactggggctgtgtgaagaggttgttattatctttcatctcagggaaataagcagaagacagttgcaaaattgcttggccttattatcctctttctttttaataaactagctccttaaagagctaccgtttttcctaaaatgtctttagatggaagatcgggactgctaattgttctactagttttaactataggggaaaaaaacagcaataacaaagaaatcatgaatcaacgttacaattaccaggttttaagaggataagtaaaaccctggagccaactctaaatacaactaattaaaacaaaaataggaaagaaaatactttctcttaaagtggtcagatatacttaggtacatttaaatgcatacctagctatctagtagtttcttccatgtatctcgtgaacctgaacaatttggtagccagtgtaatacaagtcccttctggatgcctttcactaactcttcccctttgacagctccctctttactcttttgcttctcctgggtaccacagttggcagctctttctctctgttgatcactctaacatagatacctctatacctgacttccctaagaactccagaccaccaattccaacagcatttttagaaatttctaatagcttccccgctattgtttcaaacccatgtgcagagctgagccctctgtcttctactgaaagttgttccttcttctatgctgcctaattccattaacaggattgacaagcttagaccctcctgctcagaccaggatgtttagactcatctttaactcctctctgtcctgctcctctttcaaccattgagtggctgtcttagttaatcgagctgctatgacaaaggaccataaaacgagtgacgtacaaacaatagaaatgtatttctcatagattcagaggctgggaagtccaagatcaaggcgctggcaaatttggtgactggtgagggcccatgacaaaggaccataaaaatcggtgacttataaacaatagaaatgtatttctcatagattcggaggctgggaagtccaagatcaaggtgctggcagatttggtgactggtgagggtccacttcgtgctttgtaggtggccttcttagtcttgatgtgtcttcatgtgatggaaggattgagggagctctctagggtcttttttacaaagacactaatcttattcataaggccttcaccttcatgacctcattacttcccagagaccccacctcctaataatattacattagtgattaagatttcaacgtatgaaacacaaccattcagtctatagcagtggctaaatcctgttgcttcccctttgaagtctcttcattccatcttctcctttgatttcttccattttactttgactgctcctttcatccccattccagatgaggtgctccacctgaaggtttctttggtaccctaggcttacttccatcatagcaccattcacattgcactctaacctcctttacattcttgtctccatctcctagcaaaagcatacaataggtgctcaataaatgctttttgcgttgaccttctgagtcacctcaacctcacttccttattaacccttgctgaggctataggtgacctcttttgcctgctgtcttctacctacaaaccaagcaaatgcagtcatttaatcactagtcagaccactttcctcttttcctaccaattccattctctaaattgtactttctaatctctccgctctcattcatttcaaggagaaatacccttacttcagcctgtctctacagaactgctatctattcctaaggacctttttcaaatattttctccaaaaactcttcccatagtgcctcctaggcataattaatctccccacattccacctatattcaaaagtgttctttcctacttcttttatcgtgttttttcattggtcttgtattcaagctattttgccaggactgattttcttactcgattggggagcatggagaaggtgactttctcatctctctgtctcccacatacacaaaaggtacaaagtgctatgtgttcagttacactacttttacacttgatttcatgattctcaactaactgagacaccgccacaaaataaaaagctttaagttagattgaatactatttactccaataatcatgttaagaataaactcttgacattttaaacaatactgacaacataaaagaataataggggttatatctgctaccaagtgtttccagtatgattcattgcaaagttgtgaaaagaatctaactcatggtctgtaatacagcatgagatactttgtgatctgggtagcacttagtcttaataattaaattcttagtgatttatatatttcattctataaaatttagttaaggaattacttgatactctagctttctttttgtgaacaatagtaatataatcgttcttattttgtctaaagcctgttatccaagattttgagaattaatgagaaaatactttgaaacatttcctcattaatcctccaaaggccactctgcaatagatttatataaatgattaattaaggattaaaagtccttcacaaagaagactacatctctacactattccttgcctagcatcaatgaaaatttaaagttataaaatataaaggagctgtaaaatattttattactgcaggccctagaggagaaagacaatactgctttttattgtaaaagcataaataaatattgatctttgtcatggcatatggagatacagatttctaaaagatcagccttagaaatattttagcaaacttttattctaaatatagttgaaagtatacttttcaccatacatcttttgagctgtcattttgtgtttaagcctcttatttttggaactcattttatttacatcctttgagctaatgcttgctaatttgcaggttattaagtagattgtaatttatcaggtagagtatatttttggttcagtgattcttctaggaagcatagctgatgaaccctaattatttcccaaaagccaaacgaattgcctaactttagttattcagtttatgtatgtggtaaaagttaagaattctccaaaatgttctagattctgtaaaaaaataaagcacgcttacaagactttccaaatctgagtccaaaatgaactccaaagaacatattagatgaaactgcctaaaagcataactacgtgatttaatagcactaggataacgtgggtgtaatcccaacagattacatttccctgggcgatgcaatgtgaatagcagcaacatgtatagaaaaagcagcataaaaatcatgcatgctgaatataatttgcaaaaaaatgaataaaatgatgaaaaatgtacaccagtagggggtagattctggtatcgtcaaagcatctgtggaatcaagataattacagcattcagaacttgggacaatgagacacaaatatattcctataatttcctaagaaataatgtatttgatgtaaagaaaaagagaagggaaagagagattattagctgctactgattactcagtgcatgccagatatcacactaagcactttcaataagctgttatgaaatggcccaatgatcctatgaggtaggtattattaacaatatttttatattaaaaaaactagatccagatgtctacccaaaacccaagtacctagtagttaacaacagccaggaaagacacacacacacacacacacacacacacacatatctatctcctccccttgggattgtgtaataagaacaaacaaacaaccattaggtgtgactctgtgcctagttgacaaaggtgccctttaagaattatatcaccatttcatgaaacagtgggagctcacgtgcttgcattaagtagagtgttcaggacaacctggaccttctagagggctgagagatcagacagatattccagcttttccagcagggactatcaaaatttttcataaagaagacaattatgagctaaaacaaagaacctccaacatgaggaggtttttaggagttaaagcatgagtttttgagtcagccagactccaaaatcccgatggatatttctgagattcagttttcttttctgcaaagagtacatcataattactaccttgaaaggttgtaagcagattaaactaaaataaacatatgaagggctcagtatggtatttgggtcatggtgggctctacataaatttctttaaaaagaagagaagggggaaaaaagaggagaggaggaactgctgagaggcattgtttccaggtgcttccctcagtggaagcccctaaggataccaggcgtaaatcattgtggttgctgaagtccgtaggaaatgctgttgcagctgagtgcaaaggtattgggctttaccaacaggggtgacaactagtaaaaaatggaccattgcaagcagtggaaagaaattgaaaacaagaccactttggagcaaaatccagctctcccttatatcctaggatgagactcctgacatttaggaaatgtgtagtgattattgatttcaatgcctcactgaatgaagaaagagagtaatcatttctaccaggtttcctggtagaaatgatgctccagggactcggagtgttttcttgggccaattacagagacactaaacagtaatcttgtcctcagatgtctaaggtagacaggctataattagaaaggagtattgataaagtggtgctgaggtaaaaataaatctagtctttgcaagtctaattattttggagaaaatgagaaaaagaaattgacaaaataaataatgtttgcatacacacgcatacacacacacatattaaaaaaaaaaaaaccctgaaactattatatatgatctctgatgaaaaaataacaaaattaacaccataagcattcttaataaatagtcattttggaaatcgtttctgaaactttgaaataggcttttaaaatgtaatcatgaatcaacatggctgatatggttcaaaaaatgtggaacccagatgacccacggataatcagtcactaagttctctccatttggagctttattctgtctctcacattcaacctcccactactttctaccatcccagttctgggtcttctctccacatacagaattactgcatttgtcttccaactggttgtccatactctattctctcccacccaaatcatgttatattaatacatgctcctaaaacaggggtcccaacccctgggccataaaccagtacgggtccttggcctgttaggaactgggaagcacagcaggaggtgagcggcggacgaacaaatgaagcttcatctgtatttatagcctctctccattgttcgcattttgttctgattggtcatggggacaaacagttcagctaatcacgtatgagacaaagaatgggaatttggaaggtctgcatctggcctcgccctaggtaacaaggaagtcatccccaagccttatctaagtcattatggggaagggtggttcatgcagtaagccatttctaataacagaaacaatggagagatttctttcatcattgctgatattgctgatatccaggggtacagggctcgggtaacatttaacatggccacttccaatggctttcccgtttactcagagtaaacccattatttttcagtggtcgatagcaggggtccccaaacaacgggccatgtggcctattaggaactgggcctcagtgagtggcaggcgagtgagcgaatcttcatctgtatttacagtcagtccccgtcactcgcagtatcgcctgagctccacctcctctcagatcagctgcggcattagattctcataggagagggaaccctattgtgaattggacatgtgagggatctgggttgtgcgcccctcacgagaatctaattaataatgcctgatggtctgaggtggaacagtttcatcccgaaacaagcctctgccatccgtggaaaaattgtcttccacgaaactagtccctggtgccaaaaaggcgggagaccactgtcctaaaacgcagattttaatatggtcagttggaaactttccaattttttacaggataaaatctaaacttgttctgacattcaaggcccttcaaaacaggacccaacatttctcaaaggcaataaactagatcaatattttccagtgtatatcctgagaaacactgtcctgctagatgcttcataataaaaaaggtccttgtgaccaatcatattagaaatgaagaacaatataatcataaaagagctaacatttgttaggaattttctttgtgccggaaaccaagagcactacacacattataatatttaaccctcacagctctatgtggttgatttacagataagaaaaccaaccaagacttcggaaaggtaagaaatatatccaagtttacacccctgttaagtgtcaaagcagagatctgagccctggtatgccagactgagggctctgaactcttaaacacagaaatgcccaattacttttatgtggggttccaggagattttaacatattaaaatccctgagaagtcctgatgtgcaaaagcttttggaatgctatttaaactaattaaacgacttcattataggaaatgtacatcatgagatgccttttaatatctccacaaacctgggtttccaaatagtccatttcaggaaacaaactatgagatttctaaggctctttttacctcaaagattctttaattccttttttcctgtacttccaaattctctcctcaatgactttcaatttatgtaaatagttagttacaagtccctaaacatactttagctctaacctcatttctcatcctcagaagctgtccactttcgtctcaatcttattggtaccttccatctcctctctgaagcctttcctaactggccacaaatatattgggtttgatatggtttggctgcatccccacccaaatctcaaattgtagctcctgtaatcaccatgtgtcatggaagggacccagtggggggtaattgagtgatgggggtgggtcttcccatgctgttctcatgataatgagtaagtctcatgagatctgatggttttataaaggggagtttccctgcacaagcttctcttttgcctgccaccatataagaccgtgcctttcacattccatcatgattgtgaggcctccccagctacgtggaactgtgagtccatcaaacctcttttttcttaaaaattactcagttttaagtatatctttatcagcagtgtgagaacagactaatacagggtttattcttcctcagtgtttctgtggcaccaggctgaggcgactttgagttatatccacatacaaaagagatgctgtataatttgcgtgttaagaagtcagagcaggaggcagaggcgggcggatcacaaggtcaggagatcgagaccatcctggctaacatgatgaaaccccgtctctactaaaaaacacaaaaaattagctggcgtcatggcgggctcctgtagtcccagctactcgggaggctgaggcaggagaatggcgtgaacccaggaagcggagcttgcagtgagccaagatcgcaccactgcactccagcctgggcgacagagcgagactccgtctcaaaaaaaaaaaaaaaaaaagaagtgagagcgtgcatattttaattagcttgatttagacaatccacaatgtatacatatagcaaaacatcatgtcgtacaccattaatatttacagtttttatttgtcattttaaacatattggcccttggttggcatggtggctcatgcctgtaatcccagcactttgggaggctggggtggatggattgcttgagctcaggagttcaagaccagcctgggcaacaaggcgaaacccactctctacaaaacatacaaaaattagccaggcatgctggagcatgcctgttgtcccagctacttgggaggttgaagtgggaggatagcttgagcctgggaggttgaggctgcagtgagctgagatcgtgtcactgcaccccagcctgagtgactgagcaagaccctgtctcaaaaaaaaaaaaaaaaaaaaattaaaaagattggcttttggtagtagtcacttttccttatttcttccagtgtgcaggtcttgagaaaacacaaggacttacgattcaaaactttgagtccagggtcctttctttttttccctcctttacaacagcatacattgccttaaatcaccagatacatatccatatttatgtctcttcctgattttcactgaaagctccttcgtggtagagaccagatctttctgttcccggtccacttacatagtgaaaattttaggtcgaactcagtcagattctagcttttccatttctaaactgtacataaatagctacttaaacaagttgtttaatctctcttagactcagtttcatcacatataaagtaagtggagaatatgatacctaattcgttgggtttgtgtaagaatgaagtgaattaatacagataaagggggctttgcaggatgcttcacaattttaagtgttctataaatgctggttttattattgttgtttttgtaaattggccacctatcatgctccaggcattttactagaccatgaaaccgaaggactaggatgcaatccctgccctctggaagcttgtgtctagttacagaagagaaagaatgcaagtcaggtggacatgtggggccagccttatccagggagagcagaagagggattgcagcaaagcagcaatcctgcccagccctgaaggacagaccggaggtagaagtgctttcaggcagagtcagaagcatttgcaaggcaccttgatctgtgacacggccagaacttgagagctgcaagtcagttcatgtgactgaaatgtgataggtgaagggcaggaggtaagccggtaaactagatcagccaggtacccaaaagtttacgtctcaaaggcatttaaccgtgagcccattgttagtggggtggaaggaggcaggtcaaagaagcatttaaagaatagatgaatatgatcagatttatattataaatataattctggttctactgtggaggttgacagaaaactagactggatttaggaaaaagctaagtgaagtatgaagaagctctgaatagacaaacgatggtctatcaaatggaaacttacagatcagagaagatgcaataggtctgagttgtgaaacagaaatttgctgattgctttaaaatgtatacaatgaaatggcgtattttaacataaagttattaaatgtaatgtatttaataaaatatgttatatgtattatttataataatttaataaaattattaaaatgtaaaacattttatttagtgtaaaataagtgttctattgttcatcttctaaactggctagatttgtacaaagtaagtataatgctaacaaaggaaagataaaggcaatataaactggcaattgatatcgcaaattgaaaatcttgttcctgctgttgggcctaatcatttcatttttagtcatttctcttgggaaaatcatataaaatgttgcaatacttatctcaattaaaaaaacagaaatgtgtatttctaacagagggaatggatatgtacacaacatgatatataaatgtaatctaatatatgaagaaatttaatacactattatgtgtttaaaacagggttgctaggtaaaatacacaatgctcaattgcatttgaatttcagataaacaatgagtaactttttagtataagcatgtcccaaatattatgaggaacatagggcataaactaaacaattattcattatttatctgaaattgaaatggatccggatgttctgtatgtttatttgctcaacctgacagtcctagttttaaaggatctgcaaaagtgcagtttacactatattacataaaaatatataaattatactcagttatggggggaaatatgccttgaaaatagattgtgagaaaatacagtgtaattaagttagtggttactagctgtggagggtttgaatatagattttttaatgtttgtttatgttttcctacaatggatatgagttatttttattagcagaaaaagatgtacatgtattttatatgtccatatagaactctattctgcttttaacatgggcaggggtttacacttaagagtgctatacgctaggatacacactgcttcccaatttactaccagactcaaaactttctcaagtaactcctagttcctatggaataaaagactctgttttaattttcagcttaaatatcatgccggtagtaagaacttatccacacactgtatctcagttcttcccaccaccacaatcaatatcaatgctttcctatttcattattccagagcaaactcttttcttccataccacttagcagagcttcagttttgttgaaagaaagagtaaatgaataaaggggagaaatgagatcagaaatattggatggcatttctcactaggcttaacctggtatgtatttaggtcccggttgcataatttaatggccctccaggactgccttggcaagtaccagggtagaaatatatgctccataaaaatggatataaagaaaaataaagaccagtaaaaatatttatttgtagagaaactttagtggactcaggagtcggaaaaggtctgtgaaaacaacaaaactggaagaaaagataccaaagcatcttatagcttccagaattttccccaagtgaacgtcaatgttttcccttgaaaggtgatttctgggggatcttgctgcccacacaggtgatgaaaactgtatgccaggctgtcttgtttaagacatatttacttttcatttcactgtattttaaatttgattttatggacttaccatggaaaccatcatttaaaaacaaacaacaaacctctgttttttcaggcctcattttgagtagaatattgttggaatcctattagaaagcaggtgtaatgtggacggatctgtggtgcattccttttcccatatcttccttcttgaaaccttttcaaagctgtttcctgacaatgatagcaaaagaagcaatgcattacaggtgaataaaggaaacagaaactaagcttaaaaaatagaacaaagtgaagaaaaaagaaagacaggcgaagatgaggaggaccaggcaggaaagagataggagggctgaagagaggaggaagggacagaaactcctagtgtgtacctaaattacccctagaaaagtgatcctacagcttcattattgtatcatcaggatttctaaaaaagccaggaagtaggtgatgaagggagagaaaaaaggtttcaagaagaagggtatgggaaaaagaatgcatcacagatccatccacattataccgctttgtaacaggcttctaacaggattctactcaaaatggggcctgaaaagacagaggtttgtttgtttttaaatgacagtttctaaggtaagtgcataaaaacttatttaaaatacagcaaaacaaaaagtaaatatgtctcagacaagagagcctggtatacagttgtcatcatctgtgtggtcagcaacattcctcagaaatcaccttaaaggaaaacatcgatgttcactggggaaaaattctggaagctatacaatgctttggtgtcttttcttccagttttgttgttttcacagatcttttcagatgccttttcccataccttcttttttgaaacttactttctctcccgtcatcacctacttcctagctctttctttctccttcccttccttccttccttccttcctttctttctgtcttttctttctttctttctctccttctctcctctttttctctctttttctctctcattttctctctctttctctctctctttctctctctttctctctttctctctctttctttctctctctctctctctttctctctctttctctctttctctctctttctctctttccttccttctttctttctttctttctttcattctttctttctttctttcttctttcgacatagtttcactcttattgcccaggctggagcgcagtggcatgatctaggctcactgcaacctctgcttctcgggttcaagagattctcctgcctcagcttcccaagtacctgggattataggcatgcgccaccatgcctggctaattctgtatttttagtagagatggggtttctccatgttggttaggctggtcttgaactcccgccctcaggtgattcaactgcctcagtctcccaaagtgctgggattacaggcatgagccaccgtgcctggcccttcgtagctttttctgaagtcgtggtgatggaataatgaagctacagattcacttttctaggggtaacttaggtacacactaggagtttctgtcccttcctcctctcttcagccctcctatcccttttctgcctggtcctcttcatcttctcctttctttatttttcttcactttgttctattttttaagcttagtttatgttttctttattcatctgtcgtatcgcttcttttgctttcattgtgaaacagctttatagctgttgtctctaaggatcttttattctaattcactaaagcagctccacactaagaggcaagctaagtggtcttcaatgcttctaaattctaacagatttaaaagtcactacctgcacccagaaacaagagacatggagtgttttccaaaaggttattgagcgtatactaaaaatgtcattagactttttgttcccaaatgttttgtatgtaatttattaatgatgacataaaggacagaatacaaatctattgaccatccactgggttcaaacaaatatgtgaggctcacatgctgaatgaattagacatttgaaagagccaaactgagtgcaggactcaaaaggccacgtagatattcaagtgtactttgtttgatgaaatttgtttttctctactctatatatacctagagtttttgtgacaagaaatgtcagaaccaattttgaatacaaagctcaaaatttgttttcttttgcaagaataacacttcaaaacatcatttgaattttgtgtgccatactgttatttcaacatgctttttaatgacatgccgtaatctttgacgtcttcattattttgtacttgctcagttcatcagaagtgtcatccccacttcttttgttttcacttcccaattttagatccaaaagtcccccatctttacccaccactaccatggccaagtttccagactgtgatttattgttaataataaaaataatgctcattgtgaaaatgtcaaacagtaactaatgggctaaattgaaaagtagaaattttgtttctaacttccattccacatcccagaggtaatagcaggtgcagtttcatgtgcttcctttaaaaaaaaaatgaaagcaattaaaaacaattaaacatgtaaaaattctggcttagtggctcatacctgtaatctcagcactttgggaggctgaggcaggtgcagatcactttagcttaggagttcaagaccctgtctctacaaaaaattacaaaagttagctgggcttggtggtgtgtacctataccacctactgtgtttgcctagtcccagctactccagaggctgagatgggagattgattgaacctgggaggttgaggttatagtgaaaagtgattgtgccactgaatttcagcttgggcaacagaaggagaccctatcttaaaagaaaaaaaaaaagtaaaaactcttttggtactgatgataaacatggaatgtgctcccttcttagcagatgtcagtcatccttgttcttctaaatgaccactgtccagggcattgcatgcaagtaccctggtttctgtgctttatctaacaagcctaccaagacacattagggctgtggcttttgccatcgtcacaaacgatggtgaagatctttatacaaacatatttgcacatttgggggtcatgccacactatagatttgtgaaaactggaatgacttggtcaaagaatatacgcatattttattttgaaaaatatttccaagatttgtttcaaagttactatgcatctttcacttaatattgggacacacatttcttatgtcattaattcaaaaacttctattgttaatgaatgaatggcattttctcacatatatgccccataatttatgcaatcatatcctcctttaagtgatgtttgaggttcccagtgtttgcaaaattagtgcccttgctgaaatctgcttgtcttcattgtgtttacacatttcattgtgtttacacatttcattgtgtttactgtgatagaactagcagagctgattattacttctcaagttgaagcccagaattttacgtatttattctagtaaatggtataaaagtgttttcatttttaaaaggtcagatttaatgtatttatgaacatttttaggaaatatagaatgctaaatgaatagaggcccagaaaagttgtttttatttggagtgggatgtgagaaatgtaccgtaaataatcacagttatgtctgaaataaattatagtacataaaattttgaattgacaataaacatgctttttgaatcatggtgctactataacattatgtctaaaatattatttgactcacctactgtaggcaggagttcagaaaattctgctttgtaaaaatagacacaagggaaaaaagtcctgtatacagtaacctgtggaagaatgcagcagggaacttacttcctgatcactctaccttagggtttatcaagagtggcatcagtgatattcagagctggataatgcttcattgtgggactgttctgaatgttgtaggatgcttagcagcattacttggcctctgtcccttaaataccagtagcaaccccaacccaatcgtgaccatcaataatggctttagacactaccagatttcctgtgtgggcaaaatctccttgggttgagtagagcttcctgtatggtaaagtccgtcaggtcccacacaggctgacagagcttctagttccacatacttaagaactgatggacaacaaacgatgaacaggcacttacagaaatttcacattaaagacaaagtgcataatgaacaaagagaaggaaaaaaataaaattaaggcaatataagaagcagaaaaaaagttcaaactacactattataatatcttcagggagatgagattagatagaacatccatcaaataataacacattctttttaaaataagagaataagaaagacctgttggttattaaattatgatgtttgaaataaaacttaatagaagggtttaaaaggtaaaattgagaattctctcacaaattcaaataaaacggaaaatacatagaaaatggaactttaaaggtaagatttgagtattgatttaagaggtcaaaattcagagaaagtagggtagaagaaattttttaagagaatgagacagagagagaggaattccctgcatgtaatgcttgtaaagcagaataacatcagactttttgtggccaagaaaagtaaaaaataatgaaattatgtctttgaaattttgacagaaaatgatatttaactaaacatttctaataagcctggttatcaatcaagcatgaaggcaaaattaagacctgatcacaaacacagtcttcacaatatacctccaaggcatcttgtcttggaaaaaaaaaaaaatctgttaaatatacttcactggaatgagggaggatccaaataacagagagtggccagagaatctccaaaataatgattaaagggaggtttcacgatatggcagacctagacaacaacgaattcctattggaacaggaggatgaagggatgtaaacatgaggactccaagggaaaaaaccgaactaataaattatttaatgtgcttggccttattgagaagaagtatgtaattctgtaggtgactgaaggggaagaatgtgtgatagctatctgtaccaaactaaacaaatgagtaaaagtattacctgccttaaaaaacacagggctgcgcaaaaacataaaatagtttattacattcctccaccgtgaaccatatttaaagagttgtaatcatgaaaatactcatggctgatcttttaaaaattgtgataaaacaacattggaagaatgacaggagtacaagaaaaagcaggtccgtggtttctaagtgagctaaattctccttttgcataatagacaatgtcaaaagaagaagaaaaccaggacaactagtgtgaacataattttttaaagtgtctaaatgccaaatgaaatattaatagctaaaagagttaaaagcagatgagctggggtttgggaatctagtaatctgaaaggtaaaatagaaaacctctctttttttgtacagtgagcttgtagttttgtttattaactctatagagtacaaactgatttaaaaatcaaagcaattctgggcaaccacacataaaaagttttggggtgctgttgacacacgtgatatatggtttttggacctccacccctgacttactgaatcagaatttctagcaacggatatcaagaatctgtatttttataaaagctctccaatagaagcttatcaaatttatgtgtggaaatcacacatatactgttcagttattgaagtatcagaatatgattttcaaaaacaacatcaaaataattttatggtccagtatttgtagaatatttgagtacatggattcacagacacatatacacacatagatacacagagataaatacacaggtactgtcaagagttaatccattaaactcagagaaatcagaatctttataaatctttatacagttgtccatcagtattggaatactgccagcagaccaaatattgaggtctttgttgtcataaaaatttcacctgctgggtaattagttttgttctgtgtttagcatagcacataaatcttcaattccagaccctggatagtggtaacataaatataaatagtctgcctagggggcatttgactgatctgtctttacaaacaaggggttcattaaaagcatatgacttagtttcactgaatgtttgctattgcttcctctcctgtagtgtttttttgtttcctacagtaaaccaaagaacataagttacacctgcacaaagcgatgatttggagtccaagatgtcatgataaatgaggaaggttataggaggatgagccattgcacccacacctcatgatggatgactttggggagctggagcggatctgtagataccctggattttgatcttcaaactaggctgggtcatggagagctaataatcctgttttactgttgaatgacaaacaataaattagacaatatacactgatagaaagtttttaaatttaatttctttaaaaagtccacaattaaaaataacatatttgattataaaatgtgaggtacaaaatagcctacaacaagaatttggtggaggaaaaaagatgaagaaaatattttcatataaaaataagtggccaggtgtgatgattcatgcctgtaataccagtaatttgaaaggtcaaggcaagagggttgcttgaggccaggagtttgagaccagactaggcaacatagggagaccctattgccacaaaaaaataagacaattagccaggcctggtggtgcacacctgtagtcccagctactggggaggctgaggtgggagaatcacttgagtacaggagatcaaggtttcagtgagccatgatcatgccattgcaccacagcctgggcaagactctatctctaaaaaacataaattaaatataagtaataattataagggcaatattacctagacaaagacaatacaaaattaaaaattgaaaacataacaaggactacaaaacaatatctctcaaagattttgatgcaaaaatccccaacaaaatattagcaagctgaatccaataacatattaaaaagaattatacaacataattaaatggacttattctaggtatttaaggctggttcaagatttacaaagaaattaatgcaatccaccatatcaacaggcaaaacaagaaaaatgcatataatcaaatacatttatgcagaaaatacatttggcaaaacccaatattcattcattagaaagattctcagcaagttaggaaaagaagggaatgagtttgattaagagtaagtgcagccgggcgtgttggctcacacctataatcccacactttgggaggccgaagagggcagatcgcttgagtccgggagtttgagaccagcctgggcaatatgacaaaaccctgtctctacaaaaaaaatacaaaaatcagccaggcttagtggcatgtgcctgtagtcccaactactcaggaggctgagataggagaatcacttgagcccaggtagcagagttgcagtgagctgagactgcactgctgcactccaacctgggtgacagagtgagaccctgtctccaaaagaaaaaaaaagagtaagtacaaaaagctacagttatcatcttaatgatgaaagactgagtgatttccccataagattgggaacgaagaaagacattctttctcatttctatcattcaacatgaggctgaaagttcttgccactgcaataggcaaataaaagaaatagacaaccgggagattggaagacataaaactatctcttatttccagatgacatgattgtctttgcaaaaaatttcaatgactctaccacaaaagtgagtcacatacgtaatttaaaattttctagtagccactttgaaagaagttaaaaaaaaaaaccagatgaaatgaattttataatatattctgttaactccatatatccaaaatattatcatttccaatatgtgatagttaaaattaatgtttttctatgtttatactctcttcaatattcatatctcctatttatatcatactcaatctggaccagccactggctctttcaaatgttcaaaagccacatgaggctagtggctactgtattgaaaactatggatctagatgttcttttgcactgcttctttcactctacaatttaaatttttttaaatatataaatatttaaacgatgcaataattatctaactctcctccaaattacactcatgtctcagctacatgctttgcatttaaagcaaccacattgccaaaggcgttgtcaacaaataattgcaatccaaaggtcacaaatcctacataccctcctggtgtggcacatagttatctttgacccatttgtggacataatttgtccctgtggttcaagtcattcaggaagggagctcaggtgagggcttgcagatctaagatgaggacagagctggtgagagaggcagatgagttccctatttgtcaaaatttctgtcttctggactctacttcctccctgcaggtgggcattcttccttgcccttgtcttgagccaaaagacagagaggcatccaattatgctgtcactcccccaggttggcagtaacagcagcaggctgtaactctgcccagggctcacaagctgcagctaggaggtttccagcagtcaaaaggcttagagtagatagcctcttattttctctggagtccccaagaggatcagttagacaccaggcatcttactcgtatgctattggtctcttaacaaaccctggcctagagtgaaagttaaaagtctttgattcttattctttcctccatgatgtgtctttatgaaacatcaagtgaggtccctttatgccctgcactttcttcctttgtaaatgaagagcaatatataataatcactggtatttattgaataaacacagtgtgccaagatgagtcctgagtactatagatggtttctcatttacttctgcctataaaccatgagttacgtatcattatttccacattacataagatagaactaagctactcaaaagttacaatacctgcctgggctctcccagatagaaaagagcagaggcagaattcaaacttcatttgtctgactacaaattccaaaacatgaaagagcattctcaggcctagcaagataataatgtggtgcttatcagagaagaatcgggagcccaggttagcgtccccacccagtgctgataaatcaaaatcatccttttcagcctcaggacccacctttgatgtcaactggccaagtgcattactgctggacttgaaagaagccttgcagtcttaccttcccagtgtgaggagacgggagtgccccctacattcaagtacttcttggaaatttcttagctgttgactatcattctgtgaggctagaagagagggcagtggaactgtcagtaatttaaaatacattattcctatcaataatgattcttgagccttcttacaatttatttttttttgtttttttatttcattttattttatatatatatacttttttattatactttaagttctagggtacatgtgcacaacgtgcaggttagttacatatatatacatgtgccatgttggtgtgctgcatccattaattcgtcatttacattaggtatatcttctaatgctatccctccctcctccccccaccccacaacaggccccggtgtgtgatgttccccttcctgtgtccaagtgttctcattgttcaattcccacctatgagtgagaacatgcggtgtttggtttttcgtccttgcgatagtttgctgagaatgatggtttccagcttcatccatgtccctacaaaggacatgaactcatcattttttatggctgcatagtattcgatggtgtatatgtgagttctgaagtttctcaggaaagtgatacaacataaattctacaaaaaaaatgtagaatttatgttgtatcactttcctgagaaacttcagaactgccaaagctgtggctaggatcctttgatcctgtggggaggtgtgcaaagaagttgtgtgtttggccccttgagtatatgacttctgagactgccagggtggagtgaagggcttttctatgaagtaaatcttcttcaaggagaatgagattttgcaccaatgaaaagccagactctgtcactgagcagagctacaggcatggcttggcaggagtggtatcatgagctagctgcttctcttgtgcagccccttagctcccgaaacaaactcctctgaagactttcatgcaattgttgtaaaaggcaatgctgtgaactgccctgatatttcacaacagagtagtccagctgcaactgggagacctgggtatttttctagcactgagaggaaataagaaatacctgggtccccataggaacagccgccggggagtcacttcctaaaggaaggagagctgacagaggtgactgataattgctgtcattaagaggttccagggagacactgggagcccctgacataggacctggtactgcagaagagatgaggcagaaggacaacatgcactgggtttcatgggcaaacgtcactattgaagaatccagccttctctgagtggagagagggtcattcttcattgtcaccttctcagagagagcagaggaattgttattctattacctttattttctctaaaaattgaaaaataggccaggcacagtggctcatgcctgtaatcccagcactctgggagaccgaagtgggcagatcacttggggccgggagttcgagaccagctggccaacatagtgaaacccttctctactaaaaacacaagatttagccaggcgtgatagcacttgcctgtaatcccagctactcggcggggctgaggcaagagaattgcttgagcctgggaggcggatgctgcagtgagccaagatcgtgacaccgcactccagactgggcaacagagcaagattctgtcttgaataaataaataaaaatggaaaaattactgccttcacaggagactagggggtgatgaaatttagtggtttgatgttcgagctgaaggtggttaaagtcttgacatgataactcaaatcttaaatccagtaatggccaagttagatccaaagaaaaacaatgtaaatatataatcagaggattattatttagttgttaatttagaaatgaagcagcttattatccttttaatattaacattagttgtttgttaagttttccatgtaaagggttacccttttcataacaatgaaaattatttattgttgggtagaagtcttctggaaatagccaatgtctaacaaaaaattctcaaaaatgcctgccaaaggctttaagttgtttctattgtgttttaactcactgttttcattgttatttcccagacagatctaacataaactccttatacaaatgccaagtttgtcacatttatgcattgttgtaagaaacatttcttagttacttggcgtgtagctatgtaactgactcctgcattctcgccagactgcaagggattgccaggcttggaaggcagtgtgaaatcatgggaaagaacacaaatttgaagtcagacaggtccattgtgggcatcccagctctgccacttaccgctttgctcatttctatcgcactatttcatgccactattttttcttgcctgggctaccatgatagctttcgcattgacctctctgcttccacgttactttgatgctcactcattatctacacctgcactagtgttttacatttgaaactgaaacaaagttatatccatataaccccttggattaaacccctccaataactttcaattttactttgaatgatgaaatctaaaatccttcctgtggatttgcatcatctgtcccccaccttagctctcttacctcatctcataataatctccctcttagtcctcatcccatcaatgcagagctcctggcagttcctcaaatataacaaatttattccaacctcggggtccttaggcttcgactttgtggtgcctaaaatactgctctctcagtgtttatgtctgccacgtctccatcctcctgttctttgtgctgagatttctgtaagctacctgcctctctcaggcactctgcatcctatcactctacatcattttcatcatagcatttatcatcatctgaaaataaattattgataagccttttgatgattgtctaactttattcactgcaatgtaagccccagaagagcaagaactgtatctgtattttctccttctatatcatcggtgcttagacagtgtctggtacttaggtggggctaagcaaatatttcagaatagatgtgtgaacgattttcagttcagcaaaaatgcagcactgggatcagcctgattttgtgtgtggctttttatttcacaggtattcattgtgtgttcacaacacacaaggggcattgcagtcatttgagagactttgtaattatcatgtgatcatgtcacatgccatttctctgtatttctcttgactcctcaaagttttcaacataattggctacttcattcttttggctgctctggtgctgtatgctgataattttccacctaaatcactaccagaacttctcattctcctctgctggttcatcttcctccacacagtctctggggccagaccaggggcctggggtcctctgcttatctcccgctatagagtctctctgaatgactctcccagccccatgatactaaacacccaccactgggctgactttcaatccacaactagctccaacactacttgtaccccagaaatctagacatatattcaaggaccagcttggaatctctacactgatgtttacgtatgaatctgaaacaatatttccaagattaagctcttgcttttctctccaaatgtgtttccccccaattccagtcttccatcctttaccaaacattcctcaaaccacccagttgttcaagccaaaactttaggagatagctgctcttgattcttcttgaaaaaaaaatctctcccatttcatctgtcagaaaatcctaccgatcgtgtctccaaaaacatcaccaatcagttaattttttcaccttcaccatcaccatcctctcatctgggttgtttatttggtttcataaccttcttacttgtcttgggtttcaagtctttcctatgcctctttccccagctgatctattctcaacccctatccctaatcttctaagaacacaaactagaacatcccactaatctgcttaaaaccctcctttggctgctcattacatacaaataaaattcaaataccttatcatgagctacaaggcccacctggcttctgcctacttcactggcaatatactgtacttggtctaagatgctgggcttatttcttatgtcaagttatatgctgcctttggtctagttatttcctctgctggaaatctcttcctcatgctccttcttgacattcagatctcagcttaaatatcactctttaaagatggtatttttggctggccatctgaagttgcagacagactgtgtagtacttcctgtattttaattgtctctatagactttatatgtaaccaatattattcttttttattttactactttaatttgtgtctctttcactccgtaataaaatatctcaatgggctaggaattagctttttcaccactgcttccctagccctaaggacaatgagtgatatctcacagggttccaatacatactagtttgatagtttgagactacaagatgactgtctatgatgtcagatctagagcccaagttcaggtcttgaaaaggcccaaagtgccctcaacagctcatgccctggtttgcaaaagtgacttagttctccagctaatgatttactttttgaattcaaaagtcaattctaaaagtccatttttaagaggcctttttctatgatgcaaatatccctggatgaagcattactaaaccattcgcaacttcacatgcattacatcagttcagccagctagtttcttagaaaaatctcaaatgatgaccccttgactgtttaactttgatcaaggaagagtgaaagaaatgatcagaagcctgggccttgctggggaagacaaacgaatgacatcactccccggatccttgaaccatcatgatcctagttcctgagtgcaactaaagcaaatagatgagaaaacatcatttccactattttatatatgatatttcctgacagtcatttattcactgtttataatgaccaaaggggcttatatgatcttcatgtgtgcctccattctctgggaattttgtctacctcattcccccacccaagtccattccaggcatagtaatttcttgtttttttttctcattatttttggcaggctatttcttcaaggcctctcttccctctacctggaaagctcatctgccaagtgtttgaaagctcactccctgatatcatttggatatttgtcccctccaaatctcatgttgaagtctgatcccaaatgttggaggtggggcttggtgggggggtgtttgggtcatgggaacaaatatctcatgaatagcttggtgctatcaccaaagcaaagagtacattcttgctctattagtttatgtgagagctggttatttaaaacagcgcagccccactcgcttctctctctctctttcctcctctcttgccatgtgatgcagctccccttccccttctaccacaagtggaagctccctgagaccctcaccagaaggcatcatgcttcttgtacagcctgcagaaccgtgagctaaataaacttatataaattactcagcattaggtattcctgtatagcaacacagatggactaggccgctcactactgacttccttcaggcctttgctcagatgtcatgggggcagtgaggacaaccctggccatcctatttaaaattgtgacccacccatgctgcttacacagcatcacctattctttttactgttcttctaatttttgccttaaacttatctccctctgacatgctatatgtttcctttatatgtttgtttattgtcttgcttcttccactagtatgtaaacttcaggaaagcaggggttttggtctgtgtttctttcatctattttcccaatgcagaatggatatttaatacacgttgatttggtgaatgctcctgaagagtttgctatcaatatgctaataaatggaggaaatcagacattcccatgagtcatatgcagttgactagaggaaagcatagttggcctatttttctccaaaaagctagattggggagattaatttataaaaacacagtaagtagaattagtaaatacttttactactgaaatgattctccactggaggcaattttgcccccaagagatatctgagtactaagagatacttggcttcctaataaacagactttcagaattgacttttgaattcaaaaggtagctggaggactaagtcacttagttcttagtcacatcagaagtcattcttggccaagggtgctgccacatatcctacgatgtacggaacagtcaacaacaacaaaaaatcagaaccaaaatgtcaatagtgctgaggttgagaacccctgtactgctatgtaaatgttaagacttttctttcaagtattgagcctttacttacttgagaggaagcttcattatggcacaaatgtcatagttactttcttggaattgtgagagtgttaaagataacataaaatattttgccagtagagaatgaagaaaagtggtttacttaaattgttcagtgaggctacaattccttttatataaaagaatattttcactacttttagaatgacacaaaatagtactttaagagtgagaagatatgttgattttatgcaaatcttaaagctttgggatataagatcagaatgaattacattaccaaaaggtttttatctagacactctacatagtttattgataaatttggtatatttatcagggaagctttataacttaaagaagcactaaaataaaaatatatccctactgcaatttcaaatctaactttgaaatgtagtaatttgacacaagtgccaagatggaaaaaattattcctcaaactgacataagaaaatattctcctatatcataatgaaataacataacactttactttgtgtaaagcattcaccacttgaaaaacattttgataaatgtaaagtttcctaaatgacttgcatatttatgtggctgttccttcatttgcttcagctttcaggccacatttatttactgcctacaatgtgcccactaggaagaaaatatcagtagtgcactcgagtatcttccagtctagtaagagagacaagatgtacagagaatggaggtaggaagtggaactgataaggggccattgaagtttagctggaagttgcaggatgaaggaagtctgcagagtacatagattttagtctgaattttgggaaatgtatagaatttctacaggtagggggccttcttggtaggaggaacagtgggtagaggtgcccaagttactcagatgtgaatagtaacagtcactatttgcatttaagcgcaaggaaagtgaaaagtgctctgtgggagagaactaactatttaagtagggtcagattcctaaataatttgaatgtcaagcatcaaggtagaaggaagaaagaagtgacaaagcagcattaaggaaaatccttcaagaacaaaagagatgtgagctgaggctgacatcagagacaactgtgaacttagtgctgacaatgggaatggaggggtgggaagaaatgtgagaaactgtggaaggagaaatagtcagacttgaaaatttttccatagaggtaagaaatcagggagaaggatcaaagatggcactgatatgtcacatctaagtaagtgaacggaatggtagtgtctttaagagaaaccagtataccaggagtcagtgcagatttggggaaacagataatatgtttgattctaaacaacatgtattgaagacaggacatttcgtccaaggggtgacatcaagatttatgttgcaattagagatcaccagttcagaagagaagtcagtgctaaagacgctcttcttggaaatgtttaagtagctaagagagttgaggccatgaggtagactagtagccctggctctggaataggtgctgtacatgaatctcctcatagctcatgaagttagttattagattctgttttgcagaagaggaactgtgatcacacagctggtaggagtcagaaccaggactcaagctaaagtcattcagactctggcatttccactgcattatagggctagaaaagggagcaaaggtaaagaacagactgaaagtgagatcctagaagatgccatgttatgggaagaggatgttgttcacatttattgatttatatctcccttttgtctattattgcctttgtaaacaatctgtgttgctcaaagattgctactctcttgtctcaaaaaaatcatttctaggccgggggatgtggctcatgcctgtaattccagcactttgggaggccgaggtgggcggatcacttgaggtcaggagttcgagaccagcctggccaacgtggtgaaaccctgactctaccaaaaatacaaaagttagcttggtgtggtggctcacgcttgtagttccagctactcaagaggctgaggcaggagaattgattggacctgggaggcggaggttgcagtgagccaagatcttaccattgtactccagtctgggcaacagagagagactccatctcaagaaaaaaaaaaaaagaaatcatttctagttgattcattttcacagactgatctgtaaagcaaataagctaagagtttgtacagactgacagtaataaaaggtaggaataatattattggcatcttgaattcatttgtgttaatatcgtaagtaaaagtttgctctaaaagtctgttcttctaaaatattaaatttcctgctgagatactctctggcttttatacaaacattgttacttgttagttaccttgtagtagttatactatttcccctgttatactgaagattcttacttcaaaatgagctgaagatgtgacttatgagtttacataaaatgaaaaaagtagttttggttcttaataaagagaatttatgtgcctggtacattgctaagactaaggaactggcagagtccagatggaggccaagaatacaagatgttatgagcactaaacaaggactccaaaattacttccatcaataacctgtggcatctgcgaccaccttatccattcctgggattcgttttttgttcattgttgtggtggtggttgtccttgttgctttgaataggagtggccaggggagaggatatctgagattgggtacagggtgtgtatgcagttagaacattagggcgatagcagtattatctttaatcttgaacaccttagaaatggataacacccagagccacacatcgaaaagatagagattttttaaatacccttcaaactgcttaatttgtagtcctaacaaaaaaaaatttacatctgctgaattatgttcatatctgtgagatttaagaaatgctacccaggatctacataaatgttccatttatggcaaagagaagatgattttgtttatgaaaaagagataacaaatatttgagatagtttttaaggatcttctgtcagcaaatgttaatgcagtaaggaagatatcatgatccttctgaaagtcagcgaaaccgaaccaaaaagggatgacataaacttcacgggcatatgctattttaagatttgcacagatttctgcactctaaaaaacgtgagtttcatgggggctgtttgttctctcactccacacacatatgagagggtgagagagagtatctccagtaacaggggccatccactgttgggttcagtcattctctcttagaggcaccagagggcaccagagggcatgaagatcagagcagcaagccgctctacactctgcatctttatgctagcttccaccataattaacacctgcagaatcctggggtagttttctcaccatgcacttgaaatgtgccagcttttaagaacccttaccggcactcatctcgaatttaaggcacactctctcattagaggtaagctgagaaattggagtcaaggagttaagcagagagaaggggataagcacatggacacattgtctttggtggttaagaggaacattgctaaaaacaaacggccttttattggcctttcctccttcctgacatcactctacacttatccttaatgaagtagtacataagaactgtgtctgacgctctaaggaaggatgggcgcaggaaacaaagtataacaaaggaggcaacactacaatgacttagaggatttagtttttaagagcttttcccctattgatggatgctcgactgattttatctcatcatcaaccttggaagctattagcagaggaaattgcacttaccatctgtgatgtcctggcaataacttaatattgttctgaaggtttaattcaaatcgatttaattcagcaaacatttattaatctcatgaatgtttggcaccatactagaagctaagggataccaagatgaacaatgcaaaatgttttatttttacttcaaaggttttaaaacctaataaaatacaagaaaaatattaggaagtacaatacagtctgggacatgaaaagaaaaagtataaacaatatgcttaatcattcatttattcatttaataaatattttggcaactattatatgccaggaactatactatgtgtgtttgtagaccttggttaacaaaacagatttgggttctgttctgccttcacagagtcagtttgggaaatgacagagtgttatgataaagaaacatttggcatgggagaaagttccgaaaatctatttgaatagggtggaataaatgaacttccataagagacgacatttaagaagaatcaagtcatcctaaggactaggaaaaacacattttacgtataccaaacagctaaggtgaagatcgtggaaaaaaaaaaaaatatatatatatatatatatatatacacacacaacttggtctatttaaggaacccaaagaaggcaagctgtagtatatgtaataaacggtatgcaaatgccaggctatatagagccttgtagatgatattaagaactgaagaaagagagaatacatctagccacagggatccacaaatctttacaaagaaggtttccatttgagaaggatgaataagattttgacaagcatgatagtagaaagcaggatttctggataaaaacaatgttacgagcttagacacaaaagtgatagtttgtgtatgatttagactctaataagcatcaaggtgtgagtggaggattcaattgcactaggcaattgaattgtttgccatgaggccggaagcacaggttggaaaacataatggagaacttggacaaattactggttcattaggggcatgaagggaagtcacggacattattaatgccagacagtgatactgttggcattccagctcagatagtctaatttagcagaagcatgcattgtacattggcggggacagaaagagaatttagcatctctagatatccacattgatggcattaagggtcttagggtggtaaaagtgcaactagaagcagcgtacagataaagtcgttgccaaggcaaagtctgattattggacttgaattggctgagacgatcaagttagaaaaaaacttttaataataataataataataacttacgtttaaccctgggtaactgagagagtataaatgctactactagttaattaaggctaagtaaagcaatggtgaattttatgtgtatacacatacacatgtgcatgtgtgtgtgtgagagagagagagagggagagagagagagaaagagagaaacaatagtgttgcaacctgaataaacaaaacaaagtaattaggcagtatcacagcaatactgttgagaatgattaggtgtgttcttgaaagcatgatccagcatcccgatgcaaccaatggaaaagtggaagtccagctgaggatacagagaatgcaatgataattgtttcaaagatgtttgacttgatgtagtaaagagacaaccagccattgcaacaaagatgcagagcccagaaatagaaatgtgagaagattatgcagagaaaaaatagtttcgtgtttttgtttgtttgtttgttttttgagacagagtctcaccctgttgctggagtgcaatggcccaatcttggctcactgcaccctccacctcccaggttcaagggattctcctgcctcagctgctaagtagcttggctgacaggttcgcactaccacgcccagctaatttttgtatttttagtagagacggaagtttcaccatgttggccaggatggtctcgaactcctgacttagtgatccacccgcctgggcctcccaaagtgctgggattgcaggcatgagccactgctcctggccacaatagttaaagtatagaaacagtgaaactgctgagaagtaacttataaaagaaatagaagatggcaggagagaggcaggaaggcaaaatagaaaaatgatgggaagaagaaggaaaaggacaatgagagtgaagaaaagagcggagagctaagaattatacctctagcaagccttaaaattataaagaagaggaaaatggttcattaaaggacagagaaatggagaagataaagtatcaaaaaggcagaaagaagaagagccagtaaaataaagtgttgagaagagagtaggaggtcgattaaacaaggtcaagttcacaattttatgccatactgttactcaaatatatatgaaatcttgacatgtgtatttgaataaggatgggatatataatacacatgcatacacatatacacacatacatacatatacatatgaaaactggatggagaaaaaattttataatgaaggaaacaaacgaacaaaaaaacacaagaaaataattaaaacttgaaaccaaaaactataaagaatatttgccaactactgtcaaatctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctctctttccttctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccacgcgcccggctaattttgtattttagtagagaaggggtttctccctgttagtcaggccggtctcgaactcccaacctcaggtgatctgcccctctcgacctcccaaagttctgagattacaggcgtgagccactgcacccggtcaagaagcatttctattctgtgtcttccattttctatttggccagtggggaggaggatccagggcgcaaaggaggctgaggaaaaaaacaggaagtagtgaccatacagcatacaaccaaagggcccgtgaatccacagacttctgagccctacctttttggaaggcaaaaacaagatgttcccctgtgacaaagcatgtaacagggtgagtgagagggttttcaggccacatgctgaatcaaggctgcagtctcttgccactcacttcctactttgcttcccctccacacccaattcttcaacaaactactaattccatagaaaaatgaaaaataatctcaaaggatccaatatggaacatgggtgtagatagtgccaggaaatttaaagggaaaaagaaaaataaacaaagagcaaatgagaacaagtactccaagaggaaaccaaaaattacgttagacaaataactttattttctcaaataaattgtagacaagatggtttcctgaaggaagaagcagggatgatgtcaatgataaaggcatgcaaatgagaaataagaaaaaaacaaggaagggagttaatataattaacaaagaaatgagagtaatataaacatttgagagaaagaaagccacatttgagtaaccaacgcaggattaacagaaataaaaaccacagaaacatgacagacaggcttgaaatatctcacaaaacaaaatagaaaagaatgaggattttcaaatgaccataaatatggtaatagcattggtaaaatggcaataatgtgttttaccataaatgtggtaaaagacataaatatggcaaaagacgtttggcattttttttcttaatcagtattcctgaaaaagagaactcaacaaataaaggagaaaaaataattccaagaatataaagaaaaaaaaagtgtttcctaaaataaaccaatagtgattctagataggcacccattgtttctggaaaaattttaacattgcaatcatcataaacatattctagtgaagttatttaattttaaagataaggaaaatatctcacatgagcatgcaggaaggaataatataaatatcctttgatttctctttctgcacatctcatatcaaacagtggacagtcttataaattttgaaagcaagaaaaagaatgttatactctcctgaattccccttctggtatagacaagtgttctggaacaaaacgaaattttcctggaagaattacatgataagaatatccagaagaaaaaaagatacttgtaaataaagaatagagccaagatcaatcaactatgaaaagtatttatataaatgctataaacttaaatgatgtaaaaataatgacgtactataactcgccaaaacagaaaagtagcaaagtaaatgaagtgagaatatatgtgagggtattgaatggttttacggagtgaggagtccaggaatatagtctaaagttgaaatctgcagtaaaaatccataatgtgtctaatattcgtgtttttgttatattttccttaaatcagaagggatttgcagtagttgattagcttgccttgaagaaacatttacttacatttcaacaattcctgtagtttcacttcagcatctctttccttaattcatctaaaattaaatgtaatagctttattgaagaagagaagtataagacaaatcagcagtcaaaacttggggcttgaggcctttctttactggcgtatgtagaccccagctgagagtttaattttgaccctcaggtgttagtgctgctaggtgttagctgacgtcagatatttggtagcactgattgaacagtctaagaactgcaggaatatacatgttgcattcaaaggtaaaacaaatcaaggctctatatctgcaaaggttttttttttaaatcatattcataggaaataaaataaaattaagccaaaggaaaaaaaatgcaatgacaaagatatctattacagcaaacatcaaattaagaccaataaaccactgagtgcatactctggagacattgtgcctttccaaatggcgtaatgagagtgtgagtacaactcacgctgtcactctcctgtcagaaaatgacagttgcctgtatcagttctactcccagagcactgactatcacagagtgaaaacttggatgtgacagcaccaactttctgccctccaagtaggagtctgtggggactgaaccagtccagaggaagaatcatcgctctagaaggagtgagtgtgtaaatttaaatcatcagcaaagcagaacctggttactgaaggcaggagagctggttccaaattatctccctcagttagtccccctccccaactctgacaaatgaattaatttacaggtccatttctgctaagttaaaatgcatctatcttctcctgggattttcttcttccatagaaatggagttttctctctccccagtgtcggctgaagctttcaacagaaaccaaaattctaaaataagaaatcctttaaaatatcagatccacatctccttcacctaagaaaaatatataaggccttttacatttaaaaaaaaatcttactttcaacaaatttcaaaatattggcacagttggagttatgtaaccatcaatcagcagtgtcatatctgtgtaatgtttcatatctcaaaacatccatttgctcttcgttgtagatcagatgttagctctactttttgagaaaattacacactaaaaacaaaaataaatgaacaaaagcaaacaaacaaacattgtaagtcctcaaaaggccaagttacaatgtgagcagaattgggttgaactcagaggtcctgattcaaattctaggtatgtgtcactgtcttgcactgcaatagtcattacctgggatctctggagggcattagcaaccatcattcaccaatccaacaagtttttaaaatatggtactttgacaacgtgagcctactgacaagaacctgcccacggaatcattctcatgttctgtggatatttattaagccctactgaacatataccattcatgaggctagggagttcagaactgagaacacagatggaaaaaaaagaaggtaaacaaataattggattgtagagtcagaaatatataataggaaacatactcaaatatcctttactatatataccttattgctgcactattctgcaatcagtcattaaatgcaacatatgatctctggaaaggaagcctataggggtattaaactgtgagtgttgctggaaatgttcttcacagagtgcaaaaaatcatcaacattcgtgctgtattgaatgccaacatattaagatttcctccaggtagcaaactgtaaagctaaagtttttgataaaataatgacataaaaagttaatgtcgacttgtctgccagatagtttgaagatataactgcctgagttttgcttttcttttgttgattagaatgacaagagtaatgaattttcaccattggaattgaccgtcctacatgagaaaagatatttgaaaatctaagtaccaagaacatactgctctgccaaataatgaatgcatgttctttcgtctgaagttaacaatcttaaattaactccaaaatatgaggacaaaaacttttgaaaatttctagtaagccttcagaatttgaagtgtgctgacccacatctagtacagagatcttttcttcgcttccttttatttctccatttctaatttcactccatgttcctaagaatgaacataagcatcctcttgcaacaaatgttttattttccattctcagtatagttgcaaatcactatgaaaataaacagaaacggggagatgaactgtattacatttctggttgtcttttctaaccatcaacccaaaccaaaaaaaaatacataatcttttgaatattcactttaaaaagcaaagaataacctgagtgattcaaaacggcgtatttatcaagattatttataattggctttgtaatgcattacgtatttttggcagatcacactagtgagtttgctgaggcaaagcacatagaaaaaagggatcatctagagatttagaatattctgtaataattcacccagaaaaaaataaacatttgatcatacaagacagagtcaacaattaagtcaaagaagagttgcacgtgagaaacagtcaaatgtatttatagagatttgagtgttgcttattttgtagctgggtgaaggtaggcatttgagatgaggcaactgattcaagcaaacagaaaccattgtttccggaaaatgcttccaagagggaggggcaaagagagaaagcagttgtagaggaaataggaaatttgtcaaaactataaacaaaaaacagtatataccttgtccattcttttgcaacaatgatgacatgattctccaatagacagtggcatatagtgaagcctgacttgtcagaggtcagatatattcaataacatattttggcttaacttttcaatcatttatgttcctttgtgatgttgactatatgtggatcagctgacggctaaagatggaatcattattctaatttcaaagaaaatggggcaaaagagtgaatagggaagatcacacttattagcactattggaagaataactacttaacttcttagaatgtatcagaagtattattctcaaattagaagcagtctgacatcctcagatggagattaaaataattataaagtgttcaaaaatctctgccatgggatctaaatttgcagtgtttgccaaacagaaagaagccatagacaagcttagacaattttgatgcagactttacaaatttagaagcattcagttgcttaacttggcttatttttgctgaattcaataaagacatattgattttctattgacagtgggaaagttattatagctatcatcatcaatttaaatattactcactgtccaatttacggtagtgtgtgtgtacactatacaatatcataaaaattaaaatgtgtttaatatagctttcttatttgctagtataagtaaatttttaaaataagaaaagctaaatattacatatggtttttctagatggttaaacaatgccagaccatccagtgtaaagttcagttcagtcaactattgtaatcatccagttgctaagccatgtctaatttccatttatttttcaagccaaatctccatgttttggctccatgtttatgtttttttcccagctgttgtgtgtattttgtaaaattgtgtctatcaggtaggtgggtttggttgctattttctatagtgtattatttttggattcagccttaagctttcttgttctgcattgagagttatgttgatatttcagcaagagactaccagaaaaagtcattaattgttcagacacagtgtaaaaaaatattatgagccaaaacaattattgaatttattttgcaggaaaccattgtctcaccacttttagcccttagtcaaacttgatccaccctctgaaaggctgttttaaaataattgtttctataggttaagtattgatttctcaagcctgcaataggcaccctcttagaaagggtatttcagggattccagtgggataaatagctacagttgtgcctcatcctccccttgatttcaaagattctcaaaaattatgtgtaaaaaaaaatatgaaagacaaagctatttatagactatgaaacttaaattgtcccttctgatgcattgctagaaatatgaaatggcaaatggtgatttttagaataatctgcaagacaaaagttttaatattcctgaacactttgagacttcagatcccctttcctaaaatcatgtttgtattgctggtgaggcatatattccaatcttatttttttcttatttttcaaaactctgagttaaaataaaaaataagactgggatgaaaacattttccccaaattacagaatcatctaatttcaaggcttaaaaaggacattgactcatcaagtgcaacattatattcctatttttcaattcccactccacaccatctggaagtccatccccaacttcaaggaaaaggaagtccatacttgagcatcactgaccattaaaatagttcgtgataatgtcagaatctgtcttctttgagtttccaccaatttgccgtcattcaagcccttgaaactgtatagaatagtctaccttccttccacataaaaacctttcacactactgaggtcaactatcaccttctccaccaccagcgagattagtgttcttgataccagatattcccaatttcatccactattccttataagatatcaggatgagttctatctttgttgcctttctcataaatttaccctaaattcttctagaactgcaaaacccacaaagtattgtcttactccagatatggtctgaacaaataagtgggactatcactttctgcatattagagtaggatttttgcatttgtccccataacatctcaatagtgattccacctaaatttactatcagctcaaatccctaagtcatacacatgctaccaagtctcactttttcccttttgtaactgtcttatattttttaatccaagaatgggatctcacaattatcattgaaattctagactatcaatatagtctaccaaaaattttatattctaattctttcattccatgttatctgttagttttacaaatattttgagtaactttatggacaaagcctttactcaaattacaactagaaattccctggccaggcatggtggctcatgcctgtaatcccagcactttgggaagccaaggagggtggatcacttgaggtcaggagtttgagacaagcctggccaacataatgaaaccctgtctctactagaaatacaaaaattagccaagcatggtggcatgtgcttgtagtcccagctacatggaaggctgaggcaggagaatcgcttgaacctgggaggcggaggttgtggtgagccaagatcgcaccactgcactctggcctgggcaacagagtgagactctgcctcaaaaaaaagaaaagaaaagaaaagaaatccctatagtatgatatttattcattaatttgtactcttcaagtatagtagcttacttcgtttaataatttgcctaaattccttttttttccatcttgtccaccaaatagtgaaaaggtatgtcagattccttcatacaatttaagcaccaccaaataaatttctgtgatctgtgaggttagtaacttgtgacaaagaaagtgatgaatcttgttttcatgttttcttttttcaggcaaaccatgctagatctttgtaactgttattttattacaagagattacaggacattctttaataattttagagtctctgctgtaatcagtatcaaactcagagctttggcttgtaaaatccacgttattttgctgaaaactagatagtgatttgcccttcaccagtcttctattatttgctgtgatttctcttagacctactagttctgctgtttctgaagtcttgcaggcaggcaatatctttgagttcaacccagttaaactaggagccagaactcccggagagcagcagaagagtgagtaggggcaggagtcacttacaacttcttaatccatcatggatttcagttcccacttactaataactgtttcaccttttgagtttttttcagtacaaacaagatggaagctaaatggccaatgaggaatcttttttttttctgtgatatccgtcttcattgaagttcttcagagagctttagtactcttcatagtttaaaatacaaaactatcttcttggttgtccaattcagtttctgcagcccccagttggttagaactttgacttccagcactcctcctatgggcttctatgatactatattcgctactgaatcaagggctgattcctcttatcctattatggacccaatgagcttttaatgcagaaattctttgaatgggtcttttgcaaacctgcttattaatttaagaagtttcctcttttctcctttattgaaatcatttagaaacatatagataaaatttcacttttaactttttgaaccatcttcctcttcagattcttagtgtataatcaaacctattccctttccaaaattatgaaatttgcatttctacttagaatactggaaggtggattttagttttcccagaaatataaagtttcttggggcaaaatatagaatactgggggcttctccacactcggggctttggaagccacactgtataagactattgtgtgtttttacccaagtaccactaatgtggaacagtggcactgtttactaaacggtaagttttttatattctaaatcttatgatcacagtgggtctgctttaagtttgatatatttataaacaaatgtattttcttctggtttattcttcatatattctaaaatatttagatttaaatatgaactatatgctcataagcttggctgactctagcaaaaagtagtcttctataggaaaattgtctttgtttcccagacttctctttgctgtcattcccccccattggtggttgcctagtcctcctattcttcagtttctcagtgctctcatagtcctgcctcctgtgactctaactcaatataatcacatatttattatattcacaatgagttataaatatctagaagttgttcttccctggacataactatgttaagaagcatcagatgctgctaaaggctttcggaagagaaatgaggaagttcattgtcaatcactcatttattcttttactcaataaacacttgtagagcctcccctatgtgccaaaacggtgtcaggaaacacaagatcattgcagatgaagttcctgaactctaacaactctccttgtaggagagagagataccagaaaatataaggggtgtgaaaaccagaaaagattaattttgaattacaatttcagcttagctatccaaaaaacgattacatcccattcagaaaagcatgtgaaaagggtatgaactagcatttcagattttgaagactgcatcagggtgtacttacggtgaagggtcccaagtgccaaagcagctagagaaaaagcaggtgctggatcatgagggactttatgcctaaggtgagagttggactttatctctaaaactgtgggcaatatctaaagcataattttcttggctcctagagacaaaatgtaggtggcttcttctttcctctcagcccccattttaatagaagagaattttgaaagaagataactaagctttatacttctacactatcaatgaaattacattttttagcattaagaaaggtatggacacgttagaatttaatgtaatatttgtctgatttctcatgatgtgagatttgtgggcttatgatagtgtctgtgtaaatatatatatatatgcaacattacacatgtatatgtgtgcattatctattaaatatatacttatcaaaatatccaactttcatgtttataaacttataattcacaggcaacaatggcaaatcagagtggatcttatttttaatctgcctagcagaaaatttatttagtatatgttttactataattatcctaataattgttccactgtacatagggacttttcccagagttgagtaaattggttaggaaataaaaggagctatactgcataaaaataacctaaaattaacatctgcaaataagccaggggacgtgtgtctgtctctgtgtatcataagcatttctagagactgatcatctgacttagtacttttacatagctatcctttccctacttggccccaagagaatgttatttctcatgattggtttatccattgtattaaaacagaaagaaataatacaattttctcttaaatttcccagtgcctcagttcaatttcctgctggtagatttctgctttctttttatatctaagaaattatactctttactttacaaaggacagtgcactgaccgactgaaatgaatgtgcttgtaatagaacagtgggcagcagcctgccaggcttggtgaagagtgcagcctgctattgctttccaaggaacagtttctcccacagctttctttcaccaaagtgtgtctattgccatcaagtcagaaaggaatgaatatttgcgtggttggggaaaacaaacctgctgttgaggaacaggttactttaagccggaattatctaatcagactgtaccaaaatcaccaagcaattgctagctctggacttagcttttataaagcaacgacaaaatgagttaataagttaaaaaaaatagaggaaataatcattattgcccattgggttattctgaaatatggcttcttcagcaaacaacagggcaaaagtatattatctgtgtttagggcccaagaccagatggatttataggatataaaatatagccttaaagatcccgagaggtttgaagccccagaattcctccctgcactgactgttttaataccctaaaatgtcctcaacaaatgatcagttgtttggagatgtgcattatgggattgtgggattcagaggctctagcaaactcttgaaacaactgtgttttccacaaggttttgatgagtggatttgatgaacagtctcagagcaatataaaagcatgtgagaaacaaagaaaaaagaccagagacaaagaaacaagaccagttatgttaggactttaacccagagctagtgctcctggggccacgcctctcaaaaaacttctgccatttcccacttttccgacctgccccaggcagaggatctagccaccagcagaagaactaagtgagcagattaatgccaggggatgctgctgggtgctgcaggctagtagggtaggtaagtccccatgaaatttcagaaagatttgtaggaggcttacaaaagtacacaaaatacaaacactgttgagttgcaagtgaatcaaatcaagaaagaaaaataatattgagttaagtgcggtccagaagaagcctaaacagaggacattagcatgtgtggattgctacctggagcattagtgatcagaaagagcatagtagaaacgctatgcccacaggaagactgagtgtgaaaatcagaagagccaaacctgtgctaaagaccagagaaagagaaagtaagacaagagtgagaataataatgatacaaaaaaccctccagtactaataattaatattaattaatattgaataaataaaataatattcaattgtaatattgaataaataaaataatattcaatattaatattgaataaataaaatcattaatattggatgaatattaattaatattaataatattaatactaatgccagaaatgtgctaagcaattaatatatgttaactcattaaacactttcaagaactatgatgtataatttttattgctatgttatatattagaaagctgagaggtgaagaagtttcggggtagagtatgctgccagagccatgatttgaatccagctctgccagaattcaaggcccatgctctttatcactcttagacagccaagtaggaagtgaaggccaagtaaacagaagaatgaccaagaagtgaagaacaaagtggggggtgaaggaagcagatccatcagtttctctagtatattttcactgatggttagtagtggtaatgggttatagtgcagaagaataatctcttctattatctcgataaccatcattttacatatataatatatatgtaatacataaatatatatatttttatatatatataagaatattgccacttctgtttaatagttttcaaaaaataaatttccttccaagttcctattttgggagaaattaatgtatttgcaaccgagggtagtaaaaatgatcaaattattgttctaaaaaaatactaaaactgcaaaaatacttggtcctcaaaatttaggataatactatctgatttccctaatgtatctctctttcaattcattcacttctttcttcaataaacctaccttaagagtttactatgtgataggtttgcaataaaccctttgtaatgcaaaagactaatacatttgtatacaattatataaagcactttacttgaaattaattttatacataaaattgtatttatgtgtatgttatgtatatgttcaaatcagggctgccataaatgccatggagaagttcatggtgctgtgaaagcatggagattctccatattcatggcagttaagaaatggtttccaaggggagtggtgtgtgctgtgaaatctgaaggatgcctgggagccaccttgttgagagagtgtgtgtgtggtgtgtgtatgggtagggggtgatatggtttggatttgtgttcctgctcaaatctcatgttgaaggaagggcctggtggcaggtgattggatcatggaggtagacttcccctttgctgttctgatgacagtgagtgagttctcatgagatatgcttgtttataaatgtgtagcacctaccctccatctcttttcctccttctccagccatgtaagatgagctgcttcccctttaccttctaccacaattgtatggttcctgaggcctctctagctatgcttcctttacagcatgcaaaactgtgagtcagttaaacctcttttctttataggttacccagtctcagatggttctttacagcaatgagataactgactaatacagaaaattggtactgggagtggggcattcttataaagatacccaaaaatgtggaggtgactttggaactgggtaatgagcagaggttggaaaaaagtggaaggcttaaaagaaaacaggaatatgagggaaagtttggaacttcctagagacttgttgaattattgtgaccaaaatgctgatagtaatatcatcaatgaagtctaggctgaaaaggtcttagatggagatgaggaacttatcaggaagtaaagcaaaggtcacttttcttatgcattagcaaagaagttggaggcattgtgcccctaccctagagatctatggaactttgaaccagagagtgatgatttaggatatctggcagaagaaatttctaagcagtaaaatgttcaagaagtgacctggctgcttctagcaacctatgtttgtctttgtgagcaaataagtgatctggaactggaacttatattttaaagggaagcagagtataaaagtggaaaatttgtagcccagccatgtggtagaaaagaaaaacccattttctgggaatgaatccaggcgagttgcagaaatttgcataactaaaaagaagtcaaagttaatggccaagacaatgggaaaaaatgccttgaaggaagcatctcctcctgtcacaggcccagagggctgggagagaagaatggttttgcaggctgggcccagggccctactgtcttgtaaaacctcacaacgctgttccctgcatcccagcagctccagctccagccatggctaaaaggaccccagatacacctcaggctactgctccagagtgtacaacccataagatttgatggcttccatgtgctgttaagcctgtggctgtgcagagggcaagagttgagacttgagagcctctgcctagatttcagagggtgtatggaaatgcctggatgtctaggcagaagcctgctacagtgacggagccctcatggagaacttctactagggcaatgtagaggaaaaatgtgggattgcagcccatacacagagtccccaccagggcaatacctagtggagctatgagaagagggccactgtcctccagacctcggaatggtagatccactgacagcttgcattatacacctggaaaagccacaggcactcaacaccagtccaggaaagcagctgagggggatgcaccctgcagatccataggggtggagatgcccaaggccatgaaagcccaccccatgcatcagtgtggcctggatgtgagacatggagtcaaagaagattattttggagctttaagatttaaccactcccttgctgggttttggacttgaatgaggcctgtagcccttttgtttcagctgatttctcacatttggaatgtgtgtgtatacccaatgcctgtacccaccattgtatcttggaagtaactaacttgtttttcactttacaggctcataggtgaaagggacttaccttgtcccagatgagattttggactgtagatttttgaggtaatgttgaaatgagttaagactttggggaactgttgggatgggatgattgtattttgcagtgtgagaaggacatgagatgttggaggggctgggggcagaatggtatgtttttatttgtgtccctgcccaaatctcatgttgaatttttatccttggtgttggaggaggggtctggtgggtggtgttttgatcatgggggctgatttccaaacccttgatgttcctatcatagtaagttctcatgagatctggttgtttaaaagtgtgtagcacctcccccttcactctcctccttctcttctggccatgtaagatgttcctgcttcccctttgccttccgccatgattgaaagtttcctgaggcttccccagccatgctttctgttgaaccatgagtcaattaagccttttttctttataaattacccagtctcaggtagttctttatagcaatgtgagaatggacgaatacagggggtagatagaatatttctgccagaaggcatagcgtatgcaaaagttctttagtgggtgggagcagagagcatttggggaactgaaggaagccaatgggactgaaagatgggaatggtgggagtcaaagctgcagaagtaaagaagagcccaaccagacagtaccaagtgggctgctcaaacatttctgccttttctcactccttatttatgaaggttgggcacaaacatttgtctctagctctattatgtgtttcagcaaaatctaccgaaactgcttcagtatccaatatttttatcttttgtaataaatggtagtaatagaatgctacagtacacaccttaaatgagcagattttcaccataagcatttttaaaatgtccatatagacaaggtggaatgttgcttttctgcttgtgttttaaaatatcccctcccaactgaatgattatggtgacctttgtttgtgatttagcttcaaattaatatcattaatatatttttgtcattgttgcactatttcatcaccttgaattcttacattttcatctttattggaatctctatgttcatcagacacattggccagtagcataaataatcatgttctgatcagtatttacaaacttgtaatatctgaaatttatgaactgaaattatttctatagcagtaaattttatgaattttattcattaaatgtatgtttaccttgcacttattatgtgaaagattgtaaaacttcctaggacacaatgaaaataaactttaaggagatatactaggttaaatacatgctgtggttataagactctgagcttcatggagcaagcactctatctatcctgctcatcactctacttccagtacctcacaatctatatggcacaaagcagttcctcaatgaacagttatttgaataaacagaacagaaattaaaggaagaagtggaatggatctatcacattttctttaaatccaggattggttctgattttatttctgctcctttgttttgtataagaatatgtgtgtgagtgtgtgtgtgtgtgtgtgtgtgtgtgtgtgtgtgtgtgtgtgtgtgtgtgtgtggggaggtgggtgggtgtgtatctaatgcttaatcaagagtttatttcccatgaaaaacacaaacaacacacagacacacagacactctcacacacatacaaacatacacacaatgataattaattcagaacagtgttcttgattcatacatttccatggttggaaagatcctatgtgtagattttccaagccagtgctttgcaatcattgccagcaaagtaccctattttagaacatatggtgtcagatttcacaaaatgattcatatttcctaggccttgtgtgaaagtaggtgtttctatttgggaattactgcttaaacaatgactattttgacaagaagcaacacattttttttttcttccagcacatctcttgcttaggtggaagctggagaaccaattactagtgtgattatcctaagtgtattcttacatgttttcttctctgtgaaaatgtttctattctttctgattataaatgttactggatgtgatgtgtgaatcaatcctatctgtgcagacacagcagaatgaaaggtataatgatgtaggagtgaagtgtcaatgaataattcatatctgacagcatgtagcattggattctatcaggcaacattccatggcagagaggtcctcaaaggcttcttaaattcatctgcatcagctcattgtgtttctgctcgggtggcagaatcgatcatttagaatgagggaaatgatactgagtggcactgcttgctaacacagatagaaaaatatgtagctatttttgtcaccatcaaacattaattcaacaaatgttcattgagctcttgcttggttctcatagggtgttcaaagttggaggatccacggagtataacacattctctgactccacagagcttatcaccattactatagatacataaaatattacacctgactatgattcatgttatgaagacgtccaaagttagctgagatacattccctttgcttcaagaagaatttgaagagtgtaatacatgaagaatatacttccatataatggtccagaaacaggttccttttaaaagtgatgaatatgagcaagcctttttcttattagagtcttagagaggtcactgcagcatgtggtgagatatttactaatgcatgccgtttttacctaggaaacaactttctatgaaatgtaaacacagctgtggagtttaattcaggatcctcatccttcttgtattaagctacattggaaaggcgttcaaatcagccttaaaaaagagaatcagttgacttcatggcagtagacccctgaaattttggaaaccagatttttaagactattacagttagaagagctgagttaaaaggtttgctttggagtaaaactggtttggtttgaatatcgctctgttatgtgaccttgaacaagttttcagcattactgaactaattcctcatctgtaaatggggctaatatttgaacacctatcaataggtggtataagaactaaagaaaataggaggctggatgtgatgcctcattcctgaaatcctagcacttttgaaggccaagcaagaggattgcttgaagccagaggtttgagaccattctgggcaacatagtgaggctctgtctctgaaaatttttttaattagctgggtgtggtagtgtgcagctacagtccctgctacttgggaggctaagatgggaggactgcttgagcccaggaggtcaagcatgcaataaaccaagatcctgccactgcactctagcctgagtgacagagtgagaccctgtctcaaacaaacaaataataaaaagaactaaggaaaatacataatataaagtgctttcaccattcctgcattttatagtgtcaaataatatcaaggctcctaggaaagtctctattcatttataatattaaatttcatttagcaacatgtaaatctacttaaaacataggcttatctacacccaaatcaattactaaggtttttcggtataaatgatttagggtttgtggcagtctgttatgtaagtgacttctagtaaaccatgcctcctggtaatcatgcccttccttgtgtagtgccctcctcttgaatatgggcagcctccctgaccaatagaaggaagcagaatatgcactgtgccaattccaggactaagctttaaaaaagtctggtagcttctgcttttgttgtctagaaagccccgagccaccatgtgagaaagtctattaccttaatagagacaccctgtgtttcattagacacacacccacacacacacacacacacacacagagagagacagagagagagagagagagagagagagatcctaactatattatagaaagacatgagctcaaaaaactcagtggcccagccaattcaagcctctaactgacccatcagctaaataaagccacacaagtaaccactggcaagaccagcagaagaaccatccagcagaacctagcccaaattgagaatagtaagcaaacaaaatagttttttgtttgtttgtttaaagacgctaagttttggggtgtttacttgaacagcaatgggtaacggaatcagggttatttccctttctttcattccccctttctaccagacacattttttagattttttctcatatgtcctcctttcactaatcaccatttggtagatccattaaagtctttttacgttgatctaaaatgtaactcttgagtcatttacgacagttatgacatgtgttaatcaaaataggatttggggaaacctgagatgtccaccctacttgctgcaatggctgaacattatatcaaatctggacttatgagtgccatacagcttcataaacattgaagcacctaacatttttcatgcttttgcaacttactatgacttgccgttgactcatcatggcctgagcatttaaaaatattatgaaatatatttgaattcataaaactctcattttccattaatctgttcttctattaggttttaatattacttaaaattgcaagaataatttttgtctagggcctgagttcaaaataccacctgctttaaaatgtgtggtattttcagaattaaaatagcaatgtatatctcttcaacttgattctcactgcatttctttattaagttaggcttttctgataataattaaccagttaagcagccctaaatataattaattttttaattgaagatgagtttgaacaaattgaaaagtttatcaaaatgggtgattttttagcctcatgatctagctgaatcactttatcacaataacatgcttttgcacaaagactacttaatgtgtttttgaaataaacgcatgtggtcccatgagagtatctttgatctcagacatgttggtaccatgtagaagactttgaatttgttgcttaggtttataatacaagcaagtgattcttctattgatactttgaaaatattgtctactctgattggaggaataattaatttaagtccctctatccctgagtaaccctctgttagtgttctctggagaataagaatcaataaatttctctctctctctccatatacatatgtgtatgtgaattcatatgtgtatatatatttatatacgttcatactatacatatacatatgtattcacacacacacacacacatgctatgtaaaattggctcatcaatcatgggggctggcaagcccaaaatctgcagggtggcctggcaagttagagacagagggaagacccactgtttccttttaaatctgaaggccatctgctgcagaattccttcttgctcaagggggtcagtcttttttctattcaggccttcaatggattgcaagaggttcatccactttatagagaataatctgctttactcaaagtccatggatttaaatgtcaatcttatctgaaaacaacctcatgggaacatcagtatattgtttgaccacatatctgggcactgaggccaagcccagttgacacataaaagtaaccctcatacccaccttgagatctgagccaattgagagagagtctcaggtatcaaatagatggagattaacagtagtggtgtttgagtagaggccatggcttggaaacgtgatcaaatggacttcctgctactcaaccttccccatagtaatgaccaatatacagatcgtcacccaggaattttgttatgaggaagagagaaaagtgtgtgcagagggcaggaagaaagcccaagctctgtgcattacacttttctcagtctcattatcccatgtcactaccttcctttggagaagagtgcctgtggaggcacagaggaggctccaagttacttgttacattattctaaaagaagcagaaattccttttaaacaagaccaggcaggtttgtgtggggagagagaggatcactccctaaaatagcattcaaatacgatttttcagaacaattctggtttctaaacaatcatcgtgatccagaatctgactgcctgtgcattacagacttaaaaattatgtaaaggatagtatttggcagtaatttagaaaacatatttctcaaagttttctatttagaccagtactccttttctctaagaataatgtgagattttgatcatttgtacagctttcatatttttcttttatgtaatctcttaaaatgattcacagaaacttaaaaatcctactagcaaaatagcccatcatgatcaaatgtagctgcattaccctttttaaccagaaagccagtaaaacatcatttacatagtattaacatattcatgtgttattcaaagatatatcatctaaaagagtgcacaaatactcagaatatttttctctctagcatcacagatatcaagattctgtaaattttttgatgagtttgtttcttgttaatataagctatgttttcagttgtattaagaaaaaataatcttgctttctttacatcatcactaacttctaaatcacccaagtcatactctcaatatcataatgcactattgttttaaaacttagaaatacagcataaagtcttcccccatcctgctttttaaagcctttgctcttgccactataaacttcagttttctaaaaaaagaaattgtaacttttaaacaagaatccaagaaacacacaacatcctttttacttctttgatgattcctcatttaggaaccgaattattctttaatcatcccttaaatgataagtgtctctggctctaatctttaatcatttattaaaataattaattcttcccacaataatatattaaacattttcctataattggatatattaatttctagttgcctttaaaatatacctatcatcagaccacgtctcaccatcaacatcactcaagtcaccatcactcctcactagagcaattgcaatctccctgatcctatgtttttgaccttgcccctttgtatctattctccacagcgaagtcagtgggatgctgttaaagtcgaccggctgttctttgtcttcttatgaccctccatagtattgccattaaactaaaaataaggcgaaatccttaccatgacctagcagtccctgaaccatctcgattctcgtcctctgaattcacgtgcaatgacttctcgccacattcactgcagtcttttcaacttacttgcagttcttttaacctgaccacatgctcctgcatcaaggttttttctcccccagaaagcccacccttttgtttactgagctccctgtgcaagtaacatctgaccagagatgccttttctgaatattctgtctaaaaagcacctccttgcccacttcccatacaatgatccttcttttcgtccttatcaccatctgactttttttatatgtttaacttttcattggtatttttgtctcccctagtgaaatgtaagcttcatgaaaagaggttgcttgtctatttgtatactatgataacccctgaatgtgaaacagtgccggaggtgtgggagacactcacaaaaatgttttcagtgaatgaatggtaaacagaaaatgtcttagaggccccatcttactttggaataaaagtatataaataaataatgatgagatggtaaaacaaatatgtttatcgtgtatggaggatatatttatatatttatagtgtataattagatatattaatttccagttgtctttaaaatatatccagcatcagaccacgtctcaccatcaccatcacccaagtcaccaccacccctcaccagagaaattgcaattcccctgattctgtgcttttgaccttgccccattatatctgttctccacagagaagttagtgggatcctgttagactccttgttctttgtcttcttatgaccctccatggtattcccattaaactaaaaatactactttattccaaagtaagatgcagccactaagactatataaatatatattcaagaagaaatgtattctgcttgggagagctgaaagaagctttgaaaagccaaaggagtttgagttaacagatacacaaaagatttttaagcaagaaatagcacaggttaaaacaaaacagtataggtcaatgtacagagagataaaagatatcttgcaccttcagaaaatctttaaatcttacagcatggttggaatatattcagatcagccttatttgtaagagtactccttggtcaagttgtctaaaattttcctccttctacattctttcctccacttatgatcaaaaaaataattatttccaaaactgatggttcttatggtttttcatatccagtttcaagaaacatgagcttcaaatttgtatggtgttatactaagctacatttatgtatatttacattatattttatgtattatatgtaagaatatatagcttatttacattcgttattttgatttgtaaataaatttgttgtaataaatacatagctctataaaggtcaaattaaaaatctcccctcatactatctttactcttaccctgccaaggtaactaaagttaatacatcagtgttgtttctgtccttctatatgtatatatacatgcatatatatttatacctattatcataaaaattatgtagttacagacatatttatatacatatttaaatacacatattctaccaatattggagtaaataattgtctctcatgttcgcatattttatttcatttttctttcatagtacacctgcaaattagctggagctaaccctatcttattggcaaggaaactagcagtgatgttgaagcaccttatccaggatcacacatgaagtggcagattcaggttttacaatgtcaagttccatgcccttttctgaggtcccagccccttctcatcctgccattttgcgatattttagaacaagtgcaacttagtgatgtacttgatacctggtcattgcatcaggaaagattagattaggctgagtgtgattgaaaacccaaatagtagcaagctagtaaaaatagaggcttatttctcttgcatataaaagaagtctagatcgaggatgtcttggtgccctatgttgaagagcttagttttctttgatctctctgctgtattgtgtgtggttttattctataggtgacgtggtccaaggtaactgctggaactccagaaagtccatccatatattaacccacaagaaagaggagattatcttcttttatagataattcctagaagatgtgcatgtaacatttacttatttctcattggccagaacttgtcacatggaaacagcttgttgcaaggggttgtggatgaggggccgtctattctgagcagtcataagtccatctaaaaaattatgggttttgttttcaaaaaagaaaataagcatgggtacattggaacaaagtagaattgtctgctaaagtcatgaaacagctttgggctatgcttattagacagaatattacttaacacaacaacatccatgctactacaatattcaagggtcaggaaactacatcccataagccaaatttgttctgtccccagtttttgtaaataaagttttattgaaatacaaccatgcccattttgtttacatattgtctatggttgccttagcactattgcagagtggaatggttgcattagtgactgtatggcccagagactctacaatatatgctatgcaaccatttacagaaacactttcctgatgccttcacttgatcagtaggctgaagttttaaaaatagactcaaattttaaaaactacctcccctcaaaagaatcccaatacatgtacagttgacctttgaacaacacaagtttgaactaggttggtccacttatatgcaaatattttttcaatatattggtaaatttttggagatttgtgagaatttggaaaagcttacagaagaattgcatagcctacaagtattttaacaattaataaaaagttgtgtgtcatgagtacataaaatgtatgataaaatagatactagtctattttatcacttacaaccataaactatatacaaatctattataaaaagttaaaatttataaaaacttacacaaccacttacagaccatacatggcaccatttgcaatagcgagaaatgtaaacaaatataaagatgcagattataactcttgtacatactatactacggtaataattttgtagccacctccttcctattgcagggaacttaagtgttacgaatatctgcttaaaacatggtgtgacactaatatctccccatgaggattcctgtcttcagtaaattgtgaacctcagtaaaaagtgacctctcatggttctcatgtgtttttcatcctgtttagtgcaatactgtaaacctttaataacagcatgggacccatacagagtgccactggtgatgctggaagtgctccaaagaagcagaaaaatgtcacaacactacaagaaaaagttgaattgcttgatatgtgccatagactgaggcctgcaactgcagttgcagacaattcatcttataaacagacaatgtaaacttacagcacaggtacatatagtccaatattgtaaatgtatttttctcatggttttcttcacattttttggcttactttattgaaagaatacagtatctaatacatagaatatacaaaatctgtgttaatcaatcatttatattatgggcaaggcctttggtcaacagtaggctgttaggagttaagttttggggaaatgaacagttatacatggatttttttttttttttactgtgtgttgggagggttggtgctcctaacagttttgtgggtctcaactttataggatattgctcaggagtttcaagtgagtagatatgttggtatttacaaacactgtgggcttaggaattatggttattattctcccagtatccaaatcctggcacattgcttactagttgggtaaacttgggtaaggtttttgacctccctgtgcctcagtttgccgtctgtaaaattaggatacaaatcctgattgcctagtaataaatcaattaacgtatgtatgtcacttaaatcagtgcctagtgcataataaattttaataatcatacctattattattctccccttttcaaaaatgaggatggctttaatttaattagcactaggagggagaactatagtcccatagagtctaaaattttcctacaagcaaataggataaagtagtgtaacagcaatgctcatcactctcttgcagtgattttcctgcagccctaattagccacacatctcacgcccatgatttctggtcatgtactcttttttcctccccattctgctacctatttttgccagcgtatctttacaattttcatcagaaagagaattctaaatataatttcccaggaaacttctcaggtttccattcattcttcattatcattgaaaagaatagtacatcaaatgctgctgataggtcaagaaagataaatactgagaaatgaccactggatttactaccacaggtgcccatggtgatcttgataaaaacagtaacagagaaatgatgagggtgaaaatctaattggtttggaagtgagagcaggaagaaaaaaatggaaacagtgagagtagacactttttcaaggattaactggataataaatgttgtgtcccatggggacccacatatgtgtgcaaatgattgattactacatagttaatgatcttctatctgtcacatggcaagcactctgtatggcagttgcagttgctgttaatttttttttttcaaaagctccaggaaaagacagctttctttggtcacatctttcaaagtctttatatatttaatgttaaaaaacagaacgcctagcctctgcttcagactcatcttagtctcagtgtgtaagctactatttgaacaaagatcagcaatccagtttgagggcttgatggggtgaaagtgcagtgggggtgggagaatgttgcaggcggtccctgtcatctgggtcagggtctcatacggaaacttgatcccttgaccttgcttgctctattctaaaatctgaattcttctcgtagcttttatttcaaatagtcttgactgctcctttcgaacctctgtcctcacaattgctgttagattttctctgggggaggaggaattatgatgaccttatagaagttagttttataccctccactggcatccatgctgacaacctatacattgttccagggttgaatgcaatttgattggaaataacctcaacagtgaacttgaaatatcacgctatcaaataaaaatagaaagaagaaaatctaaagtctctttctctctcacacacacacacacagacacacaagcacacaacatagaaaccatgctggtagccctagaatttgtcctttctgatttttaatttggctctgtttttgaagtaaacaagtgtctatcataaatactgtgaaatttatggtaggattttactcccttgtatcacaagccatgagtgcttctaagcagccagcctttatgcataaactgcagtgtgtgagagcttcaagcttatttgaaatggaagtggtgtttggtgagatgggaagaagggatgtattttaaactaataaataatcatcatccatgcctacttggaaaatagctttcttgtcgaatagtatttcaatatatagtatcttgaaataagactgccattaataatgtaagcatagcttgccatataaatcctgcaaatatgtacatacatgaggcctaaattactctctggggccacctttttctgcttaaattacctttaggaggaacccatttaggtgatattagggccagttaaggagagggataataaccatagtagacctagcttttctacttgctgacatccctgctatgccaggctagtgaacaaatgctcctggccatattccacattcataggtcagttttcttagtgactagtgaagacacagaattaagatgaggtcagattcatcctaactgtgacctacaccacagaagagactcctaaacaaacctactgtgtcactgtgggttctgtatctgaatttcaatcaggaggaacaaatctgtcagaatccttgtgtgtgccagtggtattacgctgacctttgaattacaaatagatactgagaaagaaatcccaggagcaggcaatatccattaaataacaattatgaaaagctgtttgccttttggaatagcttttcccataatgaggatatgagcaagctgggaggctggggagtggtgggactcaagtagggtttctaattctgaattattcatttctcaaatggagagaaatcgtcaaagctgggataggaagagaaagtcaaggaggcccagaagcctttcttaaggccaggatttatgtagaaagggccatggagacagggctaagaatctagaagagttagactaaaaatctggctcctttccttcgtgagaatgtacatcatttgggattgattcagtgtgatttttgatatgtctgagtcacctaagtaaattctgtttctcaaaaggtttgctcccagaaattttttttgtctgtcaacatttattatttactttggatttggccagacaatataatgtgcgttgttttacatggttgaaatatatggaatggctgggattcacccatatttcactttaaagtcaacatagggttttccctaaatttccatccttagaatgcagtacaccatgttgtctaagactccagactttggagttaaatggtcctgagttgaatacctaactgatccctaataagttatgtagcaaattattcaacaatttttactctgtcactcatctgccaaataggaataatcgtgcctaacccataggaatagggagaggacaaaatgagggagtatgtttaatgcgtagccaactaaatattgggttgggtatgcattaagcgtattttctcatattgggcacataacaggttctgtataaatgactctgtatttattattcaacttttgctgcagcaacaaacaacccttaaataccagcgatttgcaaaagcaaacattaatttattgatcccatttcatggtggctgcaggtctgctgtgattttgccaggtttggcttggtccagttggtttccacatgacccctatgaatgtgtaaccattctctagggtgcgctgctggcatagaggaagacagcagctcgagaaaggggcaataccaagatgactcaggtgtcttcttagaagcagtgtattgtcactacctgccattgatcaaaaagtcacatggccaagcccagcactattgaaacagtaaagtatgttctacctcttgcaaggcagtgaatggttaggaacaataatgcattatacatactaacaatttactattattaagtaatgatcatgaaatcacaaaattttaatttgttttcgcttttgatggtaatggggatttaaaagacgctgtactttaatcaatttcaatatctataatttttcactctataattattttttcttttatgagtagttttatgtactcatgaacttttattcatgcaacatcttataatacagttattactcttttgatgcacaaattgtaccaaatctgaccagatagagttgctttaagttggctcctgtgcccttccaatgtgtccccattcttctttgagcatttctttactctggcacaagctgtgtccagattatcatttttttattgatacgtaataagtgtgaatatttggtggggtacatctgatattttgatgcatgcatgcaatacgtaatgatcaaatcagcatatttagaatatctatcacatcaaactttattgtttctttgtgttggtaacatttcatattttctaactattttgaaatatacagtacattgttgttaactatagtcaccctactctgctatcaaacactagaacttactctttctattcaactgtatgtttgtacccattaatcaacctctcttcattccacacttcccttcccagtctctggtaactctcattctactctctttgtctatgggattgactttcttagctcccacatataagtgagaacatgcaatgtttgactttctgtgcttggcttattttacttaacataatgacctccagttctatccatgttgctgcaaatgacaggatttcattctttatttatggctgaatagtattacactgtgtatatataccacattttatttacccattaatctgttgttggacactgagggttgattccatatcttggttattgtgaatagtgctgcaataaactaggaagtgcaggtgacatgctgatttcctttcctttggataaatacctggtagtgagattgatggattgtgtggtatttttatttttaatttgttgagaaatcgctatactgttttctataatggttatgctaatttgcattcccaccaacagtgtataaaaattcccctttctcctcatcctcatcagtatttgctattttttgtctttttgatgatagccattctaattgcagtaagatgatatctcattgtggttttgattagtattttcctaataattaattatgttgattatatttttcatatacctgttggccgtttgtctgtcttcttttgagaaatatctattcgtatcctttgcccacattttaatgggattattttgggcttttttggtgttgagtcatcttccttgtgtattctggatacagtcctttgtcagatgaatagttggcaggtattttttcccatcaatagattgtctcttcactctgttgattatttcctttactgtgcagtttttttgtttaatatggtctcatttgtctacttttgtttttgttgtcattgcttttgcaatcttagccataatatttttgcctagaccagtgtcctggattgtttcctctatgttttcttctagtagttttatagtttcatgtcttatatttaagtcattaatctagtctgaatttatttttgcatatggtgtaattttcactctctattgaccggtgatagttgttgagtatttttaattgtgctcatagctataatcatcatcataattcagaattacttatgatagagtgataaagacattctttttataaatgcattctttttatatgagctcttttaataatagtattttagagtggagaaaggaaaaatttatatattatctttctttagtcagtgggaaatcttattctagaagaaaaatgatgctgcaggcagaatagcgaataatgttattagactaattcaccccactcccagtatcctgccacctccctagtcatagtttccttgaataatcaaaacagccgtcatcaactgagtacttacaaggtgacagacactgtgctaagcactttacagggggcttaccccttatttgagcaatactttatgagatatccactacaaatatctctaatacacacatgagaaagttgaaacttggagaagttaggtgacttccctaaagtcatgcagttaggaaaggactggataagactccagagcttccatgagtctcagacactgcactacctccagtggaaatacaaaataatcttatgtactctttttacaatagtatgtaaaagtggagaagcaaaaaagtgcattgactttattattacatagtacttaagttaagagtagataagccagaagagtggacagccaaaatgcattggccacttattgggaacaaggcattatttccatgcattaactcatttaatactcaaaacaagcttataaaatggatgtgatgattatcaccattttacaggtccagagaggtaaagtgaccaggtcaagattgcacaggcgggtaagtgatggaagctagctttgaaacaagactttctggtgtcagaatttcagaatttacactcttaggctctacacatccttgcctttataaaaaaatttgaaaacttaacctcaaaatgcccacactcactctacaccctaatgcatacctgtacatcctccaggtttaccactatttcaaacctgtctcacatccaaaggatttaaagatgaatttctgtgcaacttattttctctctttgcctcccaagttattcccatcctgtcaccataacaaccccaaacctgtaatacatagtcggaatcgttatcgagagaggcagaaggaagaagcatttgatgtatctcttcaggggtcctctctgacaactttatctcctcctagtgaactttgggcatcctgtgatctacgatgctgccaattaggctgtaaatggtgcagctgcctctgtgcactcctggctcgtgggaacagtaggatatctcttctccatatgcatgctcaccaagcacccagcatcgcaaatcagacgaagaggaacatctaagttacataagaaatgtattgagtaaacaggaagaaatgtggaatgcatctgcctatctctcctttgtcatgaagagaccaaaaactgctgcaagcaaaaggggaaatagaaagtttcttgggagctgggcacggtgactcacggctgtaatcccagcactttgggaggccgaggcaggtggatcatctgaggtcaggagtttgagaccagcctggccaacatggtgaaatgccatctcagcaaaaaaaaaaataataattattattattattattattttatatatatatattagccaggtgtggtggcacgcacctgtaatcccagctactcaggaggctgaggcaggagaatcacttgaacctgggaggcagaggttgcagtgagccaagatcatgccactgcactccagcctaggcaataagagtgaaattccatctcaaaaaaaaaaaaaaaaaagaatgtttcttggggtctaacccgtggcctcagtgtttagtacgtagtggatggacaagacacttcacttctgtggatctcagtttcttcagctggaactgagatgattatgaatctggtttgcattacagtattatgtaaggagatcaaatcaaacactcagaggaaaaacctggcatacaaatcatatgcatttgtgctccaggaaggaattgctaccttggtgtaagatatattaatatgtaaactatattgaatgtcccattctttagacacagtggcttcagacacattttatattttttaatgctacacactcatgtttatcttaatgtctgtaatactcagcaataccaaatttagaaatttaatgttctatattgatacaaaaaatgtgtgtgaaacctggtttcttaagaaaacacacaagtgcattgtcactctctgtgataatgattggattttcccagagatttctcaatctctgctttctcttgtgctcctaagaggactcatctaattaggtggtaatttaacttaggttttgatagtacaaaaatatgactgaaccaacacttagtttgggtaaagtgccaaatgctccctcttatggcaagccttaattcttgggggctttgctttcagggtttagtaacacctcagtccaaattattgttaagtcaatatttacaatgcttcaggtttgtgagatcagcaattccacaatgcctgttgtcaccaaatcttggcagcacctccttgaatattgcaaacatttacatgcgtgtgccaggcatgtgaaaagaggagtattgcatgctctgagagagctgcctagagaatcctatacccaaggttgttgcagatgtccacagtactgtactcactgaaccaatgctaatgcacagaaaaggctgcaacgtctcctgtacccagaatatcttatcttcctacgtacaattttttctcttagcattaaaaaaccctattcattatgtttgtatactcggttgcaaagaatgaaatgcttaaaggagatgtcaaatgcatcaaccgaaatattgccccaggtttcttgcgtttggaaaatttagcacactgatctaggcagaccttttaatgagacacaaggggactgactgacatcttttctgagctgacccagcctggccggcttgttttggaatcagagtagcatattcactcatctgtgtatttcctagtggcttcacaatgagctagtgctggatgcttgatgctagttgttatatctcctaagaatccaaaggtaattaaagtgttcacaaaggaatagaacacaagtttggaaccctgatctgggcacacttgcattctcaacatggggtctttgagacagatgttagaacatgtagctatcactattggaagtaactcattaccagtgaaattcaaaaaatacagtttgaggtcaaggtttttaaaaaaagaacaaatggcaaaggattcaaggatattcttctgctattactgccattcatttatgttcatatatgctttcttgaataagagagtgaagggcagagttagaggtatttggctggtaatctaatcagcataattagaacatccccaccacagcaccatgcctgtctttcttattcattcatgatttcccaaatgcatgaagaactctattatgtgcctggtgctactccagagattgaggttacagtagagagtaagacaggcaaatccctataaagtttattttatattgggaaaatttgaaaaagattaattgaaattatacacacgtacatatatattcacacacagacacacacataggtgtcaatttcacatgaaggtaactgacctgtagaaataaatcaggtgagaggtaaagaatgacttggggttgatgaaccattttaaaagggatcgttttggagagttctccagggagatgacatttcagcagagacctgatatagtaagaaaacaagtcatctgaaaatagaggaaaagaggtttccaggtaaggaggaatgcaaatagaaaagccgagaggctggaacacgcttgacaccccggagaagcaagaaggccagcatggcttcagcagaaggcaggagaaggcatctagactataatgaaggtggaagataagcaggcaggttaaagcttttgattttattctcactgaggataggaagtcacgggaggattttgagtgaggatgagcaagattcctgtgttccattatgaacagttcagcactggcatgacagcagggcatcacacaaatggactggactcctgcatgtgtgtcctaaagaaggagagaggtagagaaccactgctttaggaaactccactaaacatacttgaatcagaagggaggacagagtagacaaaaatagtttttttctttgggcccatttactatttgctaggctgtacttaaaatctacttatagttagagagaataaagcaattcactaaatagcactgtatttgtatgcccacaatataatgaaaatgtgatccctaaaaggaaacagacatggcataaatatcaatatgctcattaacgagttattacggacagagtgcacacatgagtgaaaatataatttaaactttggttttctgaccttgtctaatgccttgaaagcaagggataattcaaccaattgcacattactctcctcttgtccagcttcccctccatgaaactaaggcttgatttagtttccaaagaatctaatttcaccaagaatgcgatggaatgcctctaatgacgccctccacttacactttcactcggagccagcagcagcgagcaccaccagattattatgaagctgaatgaaatagaggcattcatcagagctaaataaaaataaacagttgaaattgcctgtcagtctcagggggaacatgaagggttgtttaaagatatcttcccttttaataagaaattttattactttgggggtgtgttatgttctcattctcagagtaatccagctgccacatcacctttgttgttatctgaacctgtagctctggtgctgtgagctgttgttatgcacaagcatgaaaatagatgcttgatgaacatttcaaggtggtggggctgaaaccaggcatcacggcagaattttgaatcagctattgctacttctctgtcttcattgctttctctctaggctctcctattacaccaatgctgtgttaaattcctgagattaccagctccctgggtttctctttcttggatttaataagtgaaaaaaagaaaatataaatttaaaagggtaaggtgattgtgtttccatagattgacacgcttggcaaaacaagatcagctgagtttaaagaaggaaaatgggaactatacaggcatacctcatcttattgagcttcactttactgtactttgcagatattgcatttcttacaaattgaaggttttgggcacgcctgcattgagcaacctatcggcaccatttttccaacacaatgtgctcactttgtatctctgtatcacatttcggtaattcttgaaatatttcagtttgttacggtgatctgtgaatctgtgattactgattttttttttttttttaagacagagtctcactctgtcacccaggttggagtgcagtggcaagatctctgctcactgcaaactccacctcttgagttccagcgattctcctgcctcagcctcctgagtagctgggattccaggtgcccgctgccatgcccagctaattttgtatttttagtagagatggggtttcaccatgttggcaatactggtctggaactcctgacctcaagtgatccacccatctcagccttccaaagtgctgggattacaggcatgacccaccgtgcccagctgtgattagtaatctttgatgttactgttgtaattgttttgaggcaccaatatgagacagctaacttaattgataaatgttgtgtgtggtctgactgctccactgaccggctgttcctccatttctcttcatctcctcgggcctccctatttcttgagacacaatattgaaattagactaattagtaaccctacaatggcctctaggtgtttaagtgaaaggaagagttatacatctcttacttaaaatcaagagctagaaattattaagcttagtgaggaagacatggcaaaagccgagacaggcggaaagctaggcctcttgcaccaattagtcaagttgtgaatgcaagagaaaagttcgtgatggaagtgaaaagggctaccccagtgaacacacaaatgataagaaagcaaaacagccttattgctgatataaagaaagttttagtggtctggatagaagctcaaaccagccgcaagagcctcttaagccaaagcctaatccacagcaaggtcatcaataacgaggcaaaaccctccaccagcaaaaagattacaacttgctgaaggctcaggtgacagttagcatttttaagcaataaagcatttttaaatcaaggtatgtacttttcttttagaagtaatgctgttgcacacttagactacagtagagtgtaaacataattttcataggcactgactggaaaaccgaaaaatttgcatgacttgctttactgcaatattcactttattgcagtggtctgaaccgaccccacaatatttccaaggtatacatgtcttaagtaattatgtctgattacagtcttaacctggagcagcatcattgcttttaaatattagataaaattacaatgcttttcattataattgcttcttcccacttttcatgatgcttctgtaaagtgcattgaaagggaaatacttaaaggaaaaacaacacatatttgataaactaggataattaagaaaagtttgacttgagggaaaaaattgtcaaggatggagagaaaagccaattattaaatagaaacacaactgagaatgcaatccttagccaatcatctgagattcaaaaagtgtatcagcctccttgagcctggaaaagccttgattttctttgtgtgtttcaagtatatttctttgccatatttttgttccctcacaaacatggggggctaaggaaaattataaactacattttgaactgcagggggcattggaagggctggccaactctctgaaagctgagaatcagaaagacagattttcaaaaggaattatgcataagtggtatgtattacaagcacacaattccctttagtgcttctggaaagagccaaagcatgaaggaggaacactggcattgaatgctgctagaacttcaaaaagaaattggccttgctttatgtaattcttattcatctgtaatataaaaacaacccatcttctgttaacaggtcctttctttgaatgtcctggtaattactctaatatatatagcatatcagattggcaatggaataatctcccacaaagcctggttcatggtgacaagttacagtcttgatgatgccagttggtatgtattcagaaactgtgtattgtattaggcttgtgagccagaggcaagcccactcactacagctcttgccaactgttgatttatttccagctattcggtgttggagcagatcactggaactcaccaatgagtcctgctcttgtgcctgagagccaaaactgcaagggttggagagtgcaattaatccatctgtggctttcctcagggcctcaccaattcttgtcagtcacttcagacccgacttgaaaacaaaacttccctcccttattctggaaatttctatgaaaatggtaatctgggctcttctgccttccctttttcatccatcattctcagtaggaaatcttcaaatccagtggagaataggccaatcctgagtgttcagtgatctgttattttcctcattcaaggaatttaacatgtcctctttgtaaagttaccctgcacttcaccaagcccctcaatgagaagacctcaggtataccagtgcatatcaccatggaaactgagcctccagatggaggaaagctgacttccacagacaaggctatcaggaatccacaactcaaccttgacacccgctgcttgtactgatgctctgaactcatcttggaaaattaataaaaattacaaactcatgagagaaaaatagtggctgggtctggttctatgaagcatctgaagagctgaggtaataaacaactaattgctttgttgtatataaatatgtatcaacaaatttgttcttgaattttctgctttgttgctatgtttttttataattatagattttaaaaattattctttaaagaatgtcaccatagagcagatcctctatcttagaataagaacctttctgagatcaactatgcaggccacttgactggctatatgaaggaaggattacatgagcaagacagagatacaagcaacctgaccctatggaaacatctgtaagaggaagaatgtagcatgtaagcctcctccagaatgaccgtcctcacttgccttcctggttccatcacaacccaagttacagttgcttagaaggacacaagaatcagaccaaagttgtactgccaccaagaatgtgtacctgcagttacatgtctctttctcacaccccacagccgccacagggaaggggcagtttgttggcatgccatcaggatccttcatacatcattggctctccataaatacagttaattaccaggtcatgaacaatagcttttaaaagaagctttaactcatcccttgaagaattgttgagacagacttaagacatcatgctgattgtgaacacactgttctgctgtgttcaaaccctgctgaaatgccctcaagagccggaaggctgggaggattgagacctgtatctgaatcaagtcgtatggaaaagggattgaagatggggcttaatgagaaaagacaagggctacctatataaagttcagtatattaaaacacatttgctttcattggtcatgtccaacaataatagcagatattttttgtaaaacttctaaaaacctttatggatagacataactaagaatagacaaaactatggatagacataattatgaatgtcgtcattgttcttaacttttatttcactgaagaattattataataagccctatataaacaaagatcctgtgtggtttgtttattgttacatatcttcagtgcccagcgcaaggtaagtactcagtatatgaattaattaatgctagactctacaataacttaatagagggctatgggatggttgcctaaacaaatgtcttaaaaggcccctacctagtgattgatcaatatggatgatactcccttagtattgatatttaaataatatggaattacctacatttagagttgataaggcaagagagggtcaaatgacattacgttttaaaatcattttcagtgggaaaataatgccaaaatgattatcataaacctgctaatctaagtatttccgtaatcgcagaggaatgattctgaatctgtcaacttattgtagggttttgtattgagagaaaaaaaaaagctttgtaacttaattggataattggtttgttattggctgactgattcgctggtttttgaatgacctggatggatcacccaattacaccaagaaagtcaatctaaattaaaatatcaatgtcaatgaaaagttcaattaatatgatagcagattatagattcattttgtgtaaaattttgatgcaacagaattataattttataagcataaatactattcataatatagtgggataccttataaaataaatgcatacagtaaatgtaagactgtttattggtgtcacagcacaattttattatttactctagattattataaaattttatagtcgacttgtgttttcatgtcatgttttttattactctgtgatttatagcatgtttggtttcttatatggcaacacaactcctagttattaatagtgtccctgtggagaaatgctgatttatgatgcagagatttcaccaaatttccaggtatatattttagcaacaatcagtgactacctatatcagtgatcacaggtttcccttgccaactctggtctcttgactgtggttacctcaaacactgatgagaaggaaagctggctcagtaggagcaccataatggctgactagcaatgtctgctataggtgtcaggtggggagaattggcaccctgtgcattagtactctcctatatacactaaccaacacacaataagcaaatatgtgtgttggtgattgctttattgactggaattaatttagctttataaagtacctaattctcaccccactcactctagtggagttgtttatccactagaagaaaacaatttcttcttagtcttcaaaatttaaaaggcaggtaaattacactgcatttgatttgaaaattagcttaacccctaaaggagatttattggctaataacactggaagttcatggtgaatcagatttcagggccagtttgatcagtggcccaatgatgtcataaaggacctagtggcttcggttactcttccctgccttctgcactatcagcttcctgctgaacctgttacccatagtgataaagtggctgcagcagttccaggctttataaccacatatcacatgatttgtgaatgagtgagcaaagcctgctctagcattctaacaactaggctgagatttgccctttttggctctcttaggtctaataactgtggctgcagggggtggaggggtggtttgtgcccattcatactcagagtgggcttagcttcccatgaagttcataagctgcatatccccacaaaatctagaaactcatgagaaaggaaaaggaaaaacaaatagaggctggttaggcaaacaaagttgtccactccatcacatcagcttgcctttaagaggtgaagttagtctcagaacttcagccttctaatatgtaaaatggggataataatagttgataagactattatgagggcaaaatgaagtcatatgaaagtttaggatagtgcctggtctatggtaaatactatacaagtttgctattagtatttttaatgacacttatgtataactaacttcccacagatacctttctttttacacacacaaactggcatttgcatgcaagaataatagcaggggaaagttccccaaacattagccgttcatatttttataactttttaaaagtagcaaatgataacatagaatgtgtcatttctctctttaaagaaagctttacaattaaactgaaaataatttgccctactatcatacagtgcaaaaaacattagcctcaacatcctgatattaccatttgctgactttataattagattcagcttcttctatattcattgtattcaaataagattgcacttagtgaggcaagtttagcgttttgtcttcatttttttttttaattggagttgaaaatggaccatgctctattgtcaaattaaagaaatctctttcaagcacacaaatctttcttaggaagcactttggtgcaagcattttcaagccaggtatggaaactagacatgctgatggggaaggagagtggcaaatctttagaatctctttttctctgatgaaaatttggcttaaaaaatttctcccttgccttggttgatgttttagacacttttctttgattacgtatgagcgagatgtaggttaggggaaaaatggatatatgggggagttattatcaagataaagaggtagatctcacattcaaagaaaaagctgagctggttttggaataactgaaacgatggggtcaagacatctaatgccattatgagcttctgtccatcctccaaccctttgccttagtgtatcaggtttattctcccagaccaggtttatctacttgatgctggacacatagctacagtcagctcttttccttctccttacattccatgatagaagagaaaaggatctcttccttacagaccccaactagaaataattccaagaaatgagtcaatgggatcatcctcgatcatgtgtacagacttacaggtaggaatggggtctattgcttggataaagcaatggaggaaggatgctgagcttaggaaaataatagccatcttagctgggaaaaaaaaacatattttttttcctcacttaccaattttgtgagtcagtaagccaattgtggatttgcacagagctgaaccatgtattcacagagttaggaagttagctagcccatcctccacaactcttcagagtgcacatggggccatttacttagtgaaagccctgctataaagaagagccaccagggtttctctcaccagcttatacccaaaattgtctttgaagttcagagccccagcccagaaaattctctcaacacaacacatggcattctcctgcattctattgacacttttctgaatcctgttccaggataagaggcaggaaatgtaaagaatgtaatggtgacatgttcatttgcttatgtggtgcatataattgctgattactttggcacttagatgtatgcgttaacatttagcttgtgaaagatgaataaattaaccctgcagcaaccataactatggcatttgcttacttattaaaatgctttttttgcattttacaaaattatttttaaaaataaataaagttggaatttaggaacaaatctcacatagaagaacatggaacagccgggaggatggagttatggttactttacatctgaccaccagattgtctattaagggatagttatccactcatcaaattcagatcgtaaatatccacatctcatcaagcattagagtgtgaaaaaaaactacagcattatgtaataaaatttcactgtctgcttgaggtctttgataataatcaattaataagaaaccttcatatctataggactgtgctggacactatgactgtcagcacatttcagccatgcatccagcgttatatagtgcctccctcaaggaacatgcaacgtattgtgagtcatatagcatactagtggaagatccgggatcaaattctaagttgtaattttggaaacaagtcagtatatactttatgtgagctagattggtcaagacacatttcttggcagacagagggttcaaaatggatcgcagatgatggatagtcaaggagagattctttcgggtttctgtttttatgattggtatagacatggaggcttgaaattgcatttcagtcagtgtgaatagcctgaaccaaactacagagatcatcttagaagctgtatgggatgcagagagcgtgatgcacagtgaatcaatttggaggacagaatggaggatgatgagatccagacaaaaagattttcatttggtgcaacagtttgctgggcaggaaagtaacaagagcaatattttttttgaaaataagttattctactgtgtgttggaggtgggaagaggcagagagagagacagagaaagagagagagactgaaagagggagagggtgaaagtcaatttgattgtcaagagtcaaaagtaacaaacctgaggcttaccgaaggcattttgtaataaagccttaagttaaggtagtcagagacataaagagtaaggaaggtcataaatatattttctaaaaagattaatagcagggcttgacatttagatgtaagaaaaactgagagctctgactccacaatttttgaattcagagacaattgagaattcagatctttctagtcatgttggggcaccttctagtgccttccatgtgtctggcagttgaggggagctttttcctctcagtttcagcataactggaaaactcagcttctgaaatggttccatccatttttgcctcagggagaaataaatgccaagatatgaatgagaaatttcttgcacctctgaatttccatctcccagcttcttttttgctgtttgctttgtttcacaaagtctgataaagtgagacataatggatgcttatctctacaaaagaaaaaaagaaaagaaaaaaaagagagtgggtagagtcgtcaaagaattgccttatgaaataaagtccagtagaatcctaggttataattatcactgggctataattgtagaagaacagtatttctttaaccaataatttttgaattgagaattgttttataaagagtttatgttcttatatacatatagttttcaatatctgcgtatgtgaaaattaattgaaaatatgtccacagagttgcagaacttcacagccctatatcttcatgctgtcttcttgtaaaacatgctgaatctttttttactaatttccgtaaaataattttactgaaaatagttccagttagtacacactggtagtcagtcaaaatgatgatccaggtttcacaaaccttgaagtttggggcttttttccacatttcaagcttcagcaaattagtgaagtctgaattcagtttgggtatttgatttaagcccctgatcaatagcctgactaaaaataattaactgtgacttttccactttttggaccgtgtcagctaaatttaaaaagaggtaagtactatttattaagttggtgcaaaagtaattgcggtttttaccattaaaagtaatggtaaaaaccgcaattacttttgtacccacctaatagaagagtaagtcaaaaaatagcctgcgtgtatgggaggccagtgtagaagaaatggtcaacttaaaagcattccaaagagtcactactcctggctctaagctcatttctgtccctagtcaaccatgtggtcttcaacaaggtactcaacaccagtctgtcttgatttcttcacttgtaaaatgagagcattaaaagttaaatgatccaccatcggatctcttgtaatattattttcagtgagatcatggcccttgttttgtaaaccagttgctggctttggagttgtgatgaggcaaaatcaaagcaattaccgccctttgccctctcccatcagctgcctcaccctgtcctcaggcactcaggtatagaccatggatcctctttctccctcctccgacttgtctacatacagggtcttaccattttttgttcatacttgtgtgacagtgttcatcttccaatatacaaagtatctttgtggtatagaccatgtcttatactttcttgtgttttctacacaatctactatagtgttaggtgcacagaaggtattcatcaaaagcctaatgcgtgaacgggttggtttgtttcattaactttattttcatttgaagagtttttggtttattgagccaacagaaattccaacaagaattcatcaagtacaataaagaaacaattgaccattaggaaatgttaagaacacattccctttttaaagttgcaagacctgggtacatactctcgctatagtccattctgtcatatatgtgtgaatacaataatgctgacttgtaatgcttgcttaataaaggtgtcttctttttaaaagcttttagagtggggaaaatgggccagtatgggtttgtaagaatgcatacacatggtggagaaaagttgttttcctttcgatttgtaaaatcactttctactgttctcagagataagccctgacacataagaaaggaaatgcctggtagcattgaattgttgcatgcctagagggagcagctaaagggccagtgctttgggctatgtaggctttaagaaagccagatcgtgtatttcatttttgtgatccagataacttataagggatttgctgtcatgtacccacagaaaaaggaactgtctaaattctcatgccatggcataagagaacgatgtactttgcaagctgttatgaccctaggagactcctcagtacaacaatctcatttgcagaagaagttcggagaagcctcttatgattaaataaattttattattttccacttaacaaaattcattcacactttactgtagagccaataatggtttaaccttaaaatgacctctttagtaataccataagtggaatttctacttgaatataaatgttgtctgtttaaaaaaactggctgggcactgtgggtcatgcctataatcccagcactttgggagggaggctaaggcaggtggatcacttggggtcaggagttcaagaccagcctagccgacatagtgaaatcctgtctctactaaaaatacaaaaattagtcgggcatggtggtgcatgcctgtagtcccagctacctgggaggttaacgcaagagaatcgctggaacccaggaggcagaggttgcactgaggcaagattgtgccactgcactccagcctgggcgacagagtgagactccatctcaaaaaacaaacaaacaaacaaaaaacaaatgaaaacaaacaaacaaacaaaaacacctgggctctggggctctggagtgagatacagctgggtttaaatctgaggttggcctttactggctgtgtgtccctggacaggtcacctaatgtctttaaacatttgtttacatgttaagtggaagatattctactctctaccttaagtgagacattccgtgaatagcataacagcgccatgtggttttacatatggtaagtgtccatgtcagtctaaatgtcttaaaacggttgcaattcttttccagttcttctaattataaaattaagcaagacagatttttaaatataatgctttgatggcacattaaaggttgaaatgtccaagacggaagatgtgattgtttccatgtaactgatatgaggaaaagggttgataacctttattttggatgatgaggtttagcctgggattgctggcattcttggaatgtgacaattccaggcaatgtttacagttctcaggtgttctctgagatagtattatctggaggtaatcttttgttgattgtcagtagggacaaatggaattaatttagcatcgatctctctcagcctctctccaatcttcactcctacctccaccaaacacagcatctaaccaaaccaaccaccaagtaaagcaagccagccaggtgatgtcttcggactatatagtgtcatttttaacccaccaatgtttaaggagaattaatatacagagtccctagaatttgtcagcacgttaatactgctttgagcaacccaaagaggctttggacatgccgaggagtatttggagacaggaattgagaggaaagtggactttgaaaagtgtttcttttaatgttctttgaaatcactctaaaattctttgagaaatgcaggtaatgaatgaaggatttttaaaaggcactgtggtagttgtcttgcttttctttcttcaatttaatgtgatacaatgttaagactggaattcacttggagttctcatatttattcaaattgcagaattttagggaaaaatttgaacaactaaatcatcttagggctctaagctatatagttgtaagaaaaagaacttgtgtgtttaaagttatgctaaactacttagcactacttacattaaagtaatgaacgataatcctggagtacgtagtagagttaaattttatccatcctattgttagctttttcagtgaggtcaccaataaaacctaaattgagaatctggtaagtcattacttcccattcgcctaagaatttttagcagcagtatccttggatgttcagaggatagacctaataaagcttattatcaggttggatcaatgcaagacagacagccaagtatattataaaagacagtagatagaaaggatctttaataaataaagtcaatttcttccagtcggtattcaggactcatcatgttgagtagatgccacctattctctataatttgttttagaagtactctggggacttacatatgagtacaaaacaaaagaagaaaacatactcattgggactaaaaaccaacaaactgaaaaacagactttatttgtttttcatcactgaagaaagagctgaatttcatgaagagtgtaggatgcagtatctactcagaggaggcaataataaagggatgattgggcattgcaggaggaaacctcatctagtgggagaaaacgttgtacttttttgataaaagaaatctaggcgggacattgttaaagaaaaatgacaagctcaggcattgtgttgctcttcatgtagaactctacaacttttaaatggaactgttcttttcaaggtgatcaaaaattagtgaagaattttgcctactatccttgcaaattcaacatttttattatattgacaaatgcaactaattacatatatgtcatagattaactataaataaattacgaggctgtgtgatggaattattttgtccaggcaggaatttgtgaatgggtgaaaactgagagggtgcatatataatacacagcttccccgtatacattggcttcaatgtctctacatctctccactccaggaatagatttgtagtataatcaactagaaacagaagccaaatatcactgttcatggcagcctgtcacatcaggaattcatttgtacacatgacaactcctccatctcagaaccgtgggtgagaaaggcctgattggcagcaattattctctggccactgatgctttctgcgtggcttcctcagaccttcctcccatgcacaaagacataaagtataccagaaacatttttcacacaggcttaagaaaatgattgcagcctttccccacatagtacaaaaggtcagtgtatctctgagcttcattcctcttttttttgcaggtaaggacactgtcttgctggcagcttgatagccgctacctgatttcctgataataggaaagtttcaccttctgctatggctatttaaaatgtttacttttgtactaacgcattagaaaccaactaaattctgtgggtttttcttttttttttttctgttgtttgtttgtttgtttgcttttgagacagagtctccctctgtcacccaggctggagggcagtggtgtgatctcagctcactgaaacctcttcctccccagttcaagtgattctcctacttcagcttctcgagtagctgggataacagacatgcaccaccacacccaactagtttttgtatttttagtagagatggggtttcaccatgttggccaggctggtctcgaacttttggcctcaagtgatctgctcacctcggcctcccaaagtgctgggattacaggtgtgagctacctcacccatcccaaattctgttttaatgttggtttagatgtagctttgttaactatgtataataatggaaaccaagaaaaaaacagatacgctgcacttcttataatagagatcagatcaattgctgagtgcctaaagttacaaaatagcttacataatattttatatgatacgcaatagaatatataatgtataatatattatacagatataatttctgtaattaaaattatataatctcaatggtgaaaattaacaattaaaatataacaataaacttgacctgtatcagttatcattaaattgattggggcagtttaggtctttctccaaattttactttggtctccattcattaaatggacattaactagggacttcaaagacccaagaaccacactcagccttggggatagaatgaagactaagagatgatgactgctgtcagcattaatttcttccacattatttagcccactaagaatgagatataattcaaatttctgaaacttgtagatgtgtggacacattttcataaactttcttaataaataggcctgcaatgacaaaatgcacacaaaattttgaatatgtaataactgagtcctatcctttatttcaagagacaaagctaagaattagaaacataaacaaattgtgtccatcttaagggtgataatgtacaaatgtggccatttccagtagtcatggagtaggcaaatgaattgaagaagtatgattttgacaaccctggacagcattagaagctcattgtccaaatatgagacaagttagacagacttacaagcagaaaaaaagaaaaagttgatagcctcactatcaaaagaaaagattcatgatatgcaactctcttgctagcaagtaaaaaagaggaaatacattaaattattagaaaatgttaaaagtaatgagcctttatctgttcacagagtcatcaaaagttatttctgtgtaggaagtgtcaagtagcatggataaagagtattcgggaaattctttagttgtggtcttgaagactgttgaaattattagcatctgagaaactattataaaaaaagtttacattaattcaggtggagcaatatggggcaataggataagaaaggagtaataatattggtctaatgtgtggagaaaatgagaatacttgatgaagatatcacaggttacccagagaggcttgaagaccagctgctgggagatcaggaacctgagcagcaaggatagctcaaagggaagtcattttacatggtgtgaactggtgtaaaagatcagggaaaaatagaaatcatagataattaaccaatcttaaaatagagcagactgggcacggtggctcatgcctgtaatcctagcattttcagaggccaaggcaggcggaacacctgaggtcaagaattcaagaccagcctggccaacatggtgaaaccccatctctactaaaaatacaaaaattagccgggcgtggtggcaggtgcctgtaatcccagctactgaggaggctgaggcaggacaatcacttgaacctgggaggcagaggttgcagtgagccaagattgcaccactgcactccagcctgggtgacagagggagactccatctcaaaaaaaaaaaaaaaaaaaaaaaaatttagagcaaagcatcaggaagcttgggagcttcctgagtgacagccagggtgaccttacattctgtttgcccaggacatctctgatttacatctgttttaccagcactcaaaaatgctgtcatttgggatgataaattatatgatcatacttccaggagagtaaatggagtgaatgaagaggaagcctctttcactagttgtctctggacaaaatcccagttggaattattaccaataatgagttagttactcagagacatatttctatttccccaactttctctttaccatgaaaaacaaactgtacaataacacaaaagcccaagaaacccaactacattattctgtacctggaaaaatcagtacataaaaagaaaacagtttctaacacataatatatgcaactgcctaggtactattcagaaagcaggtcccatgtactggttaactcacagatccacaaggaacgaggtacattttgcttccatttacttttaaccatgatgatgatgtttcatagcttgacaattatagaactataatagctgactgtaaacccaaagtaacttcctcaagtagtattttaaggttgtgaaaatatttgctgggcttttaaaagtgagataatgtttctctaacacagtgacatgtacagatctggattttagtgagatgtgctactgagtcagttatttaaaatcgatatttaaaaatatacgtttttctccattaatttaataattgatgatttctatgcactaaattgttagggaattacaggctgtttttaaagaaattgctttcatatgtggtcatttcatttgatcattatgaaatgtctggaatattaggggaaaaacaagttataattatcttatcaaacaaaatcctatttttggtaaaattaaatgactaatcggggtcactttttgaagtaaaatcaggtttttgttgttggactatgaaaacacagtccttttattctcatgaggtctttttaaaacattttgtacataaatttgcatttcaagctttatgtcattattataaaaaataattgtcataatttggacagagccatgctgaaatggacctttgtgtcttccacgagggcaaagtttgtgaagaaggttaacaaagtgcgtggaatgcttcctaaaaacacacccacttggcagacaaacaattacatgtgaattataaatacatttttaaagcaaatctgtggagcaccgctataagcaaaattttctgagcctttatttaatgtatttatttgaaatcaatgattttcaaacttattctataattcagctaatttgctggtcttctagtagccctttctagttaacctgaattatttagctagccggtgatggtcacattattaggatatttctcttctagtaggggaaggcagctttcctttctgtctttctctgccatgctctttaaccaacagagagaggaataaacaggaagggggagaaggaggaggagaaggaaaaggcagagaggggaaaaggaaaaggggaaggggcagggtagggggtgggagagagagacaaagagagagagagagcatgcactccactgaatatactcaagagccataacttgtagcagggctgttacatatggaagcagctaggcactatgggacttgggggagcaacattcctgtggactatactgtgagagattaatgcacggggttgtccaaggctatggccctaaacattacacacacaaaaaaatgttcctatcaagaatatccacaagcaatagcctcatgttcatgttatctggcttagtctcgtagacaccctatattgccttgcatgctaggtcccagtcaacaatgtagtgtgtgtgcatattagagaagaattttcctccatcctcctcctgaatatgtttttttctgggccatttacatgaaccagctttcattcacagcctgcgtatgagggagaggatcagatttgctcacgtgcaatgaaggtgcattaattgacacagggtagtagaaaatagtgacattaaatagttttgattgcactaagtgctactgagacaaaagtggaaattattcttcccgtattctgaggaagctaattaaaaataaaaaagcagatattctttctttccccagtaaaacaattactcttcgtgctatacatttacatttggtaagagctgctaatgaggttgtttacgtttgtactgtcactttcatactaagtcgcatcatgaataggaataggtgtaccttgcaacttgcaccatcacctagcagtgagtccacaccatgccttcggaactccatgcatcatgttgcactgagcaaagcaaaggaaatatttcagagcaggcatatttaattaaccatagtggacattttggttgtagttaaatcataattatcaccaccagctgctcaaattttgtccattcagcatacatttatggagtgcctactgcgtacttgggatgaaacttgcttttgacaatgctctaggatttctcatgttgagaagtctgtgcctttcaggaaattacctcataacgatgggaatggcaaaccagtgccctgagagagtaaatgcaccttcaggaagtaattttctcacctcacccacaagacatttcaaataatggtaatcatgagcactttcctaacactgaattcataattccatctgtgtcatataatcatggcaaccatggggatccttttcttcttttacagatggaacaaagggaaagcacctcttattccagtaaattcaaaagctgaacttatctaagctatatacatatgtgtgtatatatatccacacatatacatatacacatacatatacacatatacacaatacatagacatatatactatttattaatatatactatatacacacacacataacagtcagtttccaatttacaaatgggttaaactccaaaattgatatggtaagtatttcattaaactctaaaacccacttttttatcaaaaattctaacgtacaaaaattatgttgttaaatcagcatataaagcaaacattcttatttgcacctgcagtcctctccatcaatacatgtgtaaatatttgttatatttatagtatcatgaatacataggcccacagaaagctcatattcagaaattagtttatttaagagttttctgcttaaaatatttcaacaaatatatgcaaatttcatcttggttcttcctctctacagtaatctccatcctctcctttatcaggccctccaactccttagtagtcagcatttctctagggctttcaactgcttttactagactattagaaagccatcattgaccaattgcctgcccaccttaagaataaattttccttctttgccaaggctgagaatccagtaaaagtcttgaggcttgcttttcatacagttcaacatcatgcgtggactatttcaggcccattgaactacctaaactatactatttaaattccccccccacttcccttctccttcttcttctttgtctctccctgcttcatgtatgtggatagctgaatccaaagggtccttgctggaactcaacagcaatcatagtactaaaccacaggaacgactccactcttataaagcactgttctttctccaggcttcagtgcccccaaacccttttccctcctttttttttcctcctcttctcctgggaatgcaggaaaagacaattctaatcgggagatatctccagcatcagtatatcacagatttgtctggctttccatcacactgaggataaatttctcgtcccttaccacatcttgcgaagtcccatgggctctggtccagcatttctctttgaccagagctcacaccatactccagatccagcttcagatccagccacagtgatctgctttctgttcctggatgatgcccaactcttggtctctgaggacttttgcactaactgttccaaccacttctcagcatcagtgtcacctactcagaccacccaatttaaagttggccccctctccttcccaagcatctttctattaccctgtttacttttttcccaccaccatcagtgcctcttttaaactgatttgttatttagaatccatcaccccacctggaatgtaaattccgtgaagcaatgagccttcattcactgtggtatcctagaatctggaataggatttagaaaaggggcaccaaccaaacattcattgtaaataggtgaataaggtgaatctactaggcagggcatggtgcctcatccctgtaatcccagcactctgggaggccaaggtgggtggatcacttgagcccaggagttcaggacaagcctgactgacatagtgagacctcatctctacaaaaaatacaaaaatacaggcatggtggtgcacgcctgtagccccactcactttggaggctgaggtgggagagtcacctgagcctggaagttcgaggctgcagtgagctgtgattgcactgctgcatttcagactgggtgacagcaagaccctgtctcaaaaaaaaaaaagaaagaaagaaagaaactacgaaactgggcattcattatgattaacatcttaacctgtatcatttattgggccttcttactggtaatatgtatctcaaatataataaaaggggacttggccaggcgaggtggctcacacttgtaatcccagcactttgggaggccgaggtgggcagatcatgaggtgaagatattgagaccatcctggccaacatggtgaaaccccgtctctaccaaaaatacaaaaattgctgggagtggtggcgcatgcctgtagtcccagctattttgaaggctgaggcaggagaatcgcttgaacctgggaggtggagttcgaagtgagccgagatcatgccactgccctccagtctggtgatacagcgagactccaccacaaataaataaataaatagataaataaataaatattaaaggagacttacgtgaacatgtcactcagtttaactttccctctagcaaccttcatttattcatgagcttcacaaagatttgatttgtgagcattgaatacagcttatgggcatgatcaattcttactaaaactttataggcattttacaaatacccttttaaagttcacaacacggaaataaacactggtttccccattacctttcttgtttctctacaggtttctactgcttttctccatgcagcaatcaacccaaagcctttattcataaactccattatccatatctctcctacattcaaaacctgtagcaaataaaaaacaaatctggacttaagaaaatagagactttatttgaaaggacttttgcaataacagggttactgcgataagggaaggggtactattgcaatagggaaaatgcttactccgtgaggtatgaaagcaattcaaaggtcaggcagaaaagagcttttcttttacagaaaggagtaagccaacctggaaggagccaggtatgggggagtggggagagcagatggcttgatcggacagttaaacaggagacatctttctttgtagatgattttcaggagggattattatgactccaatacttgcttaacctaagaagtgagtcaatttcagggtcctgtggtgaagagtgaaacttaattgaagtttggttaagtcaaattaacaagcattttgttctgattggtcagtggggaccaatagttcagctaatcgtgtatgagacaaagaatgggaatttggaaggtctgcatctggccttgccctaggtaaacaaggaagtcattcccaacccttatctaagtcatatggggaagggtggttcttgcagtaagccatttctaataagacaaagagtacagggatttctttcatcattgctgatattaaggagcacaggtctcaggtaaggtttaacatagccacttccaatggctttccagttcatttgaagtaaacccattattttcagtggtctgtaacagaggtccccaaccaatgggccatgtggcctgttaggaactgggccacacaccagcaggggagccgtgagtgagtgagtgaaacttcatctgtattacagccactccccattctcacattaccacctgagctctgcctcctgttagatcagcagcgggattagattctcataagagtgtgaaccctattatgaattgtgcatgtgagggatctaggctacaggctcctgtaagaatctactgcctgatgatctgtcactgtctcccatcaccctcagatgagactgtctagttgcaggaaaacaagctcaaggctttcactgatttctgcattatggtaagctgcgtaattatttcatgatatattacaacgtaataataatagaaataaagtgcacaataaatgtaatgcacttgaatcatcctgaaaccattccccactctccttggtccatgcaaaaattatcttccacaaaactagtccctggtgccaaaagggctggggaccattggtctataagacaccatgtgatctgacttccacccactctctgagtcatttccatcccatctcaactgtgctcactggcctccttaggttccattctaggattctatgttcctgctcaaagacttctgggcttgctcatcctctgcctgaatgctttctcccagataccacatggcgttgggtatctgcaaatgtcttttcgcaatgcccgtcttgaccaccttgtataataacacaatcactctcataacaattcgcccttccaagctcctcatcctgcttcatttcactctgtgggacttatcacaatctgacatgttgtatagatttggaattgttttgtcatctttcaccgttcattgaaatgtgagctctagaaagatatagactgtctctttgatttactgctatacttttatctttatcacctataactgtttgttagattatcgaagaagcaaacaaatgattacataaatgaacaaatgaatgaatagaagtaattatattgtctcaaattgagaaacttcgtacaaagattcttcgaccgtgcctaagaagttatttctcttgggagatcaggataaacgaggaacaaaatgagggacactaaaataggaagccataaaaccctgttgtcaatttccagcactagaaattaccaaagaaatgcataacttattaaaatttaaatgaagtcactagcaagattgataaatgttcctggcgttctaccaaaaaatgtctgttgcatcacactggaatggacctaacctatgaagaatcgtggtgcgtctataggctaaagatgaaaatgtcaaggatatctctaaatactgttcgttggaaaatccaaaaggaggaaatagtaattaattatattaggataaatatatgatttgtcttcgaaatctaaatagactggattaatcaaatgtcacagtggcatttctaataatgattgtgctgtgcaaagtccattagtgagctatacttgccaagagaaaagttacagagaatcaattaaataaacaaaattatcttcccctctccctctcctccagatagtctatgaatcttaccattttgggtggtgcctggatcctttgaaaattaggaaaacatttatataagatgctctcccttgagcccccaaatcactccatgatgtttaacactgtagagttatctaatatctttgaaaaggagagactttaaatgataagagcaaattaaaaatggcttagtatgtcagaaaggacatggcattctaacactaagtcctctgtattaataaatgcacctgtcatgttcccaggattaatgagaaatatgttggcaggattcatttgaacagcgaatttgcctggttatacttacagatcatcttaaaatcgcctgcttgagcacagacaatgacatcgtaaatatgtatttgaaactaaatttaaatttgagagaagcaatatccattcattaaagaggaagaaacaaatgcattacaatgaatctcagataaatgaaaaagcctgactctagagctatgaaagggtttagtgacccttagtgtgagtgtgaagatattcttattcaaagcaaggctatccatcaatgaattctttcagagacactcttatctgaaggcttactggggataggtttaattcctatatactgagtctcttagaactgagaaatctcaagttaaaatggatcaaatgcaggattttgttgtagggtgccctaaatgggaaggctgggctggcgagtgctttgaggaagcttcctgattttatcctccatgtgctacagtcatcaatgtcttgcccaagactttctggtttcacaggaaatttattaactgtggcaataccagagagacttttctgtgtacatttctttaacaaaaagcaaactggtgaaagaagctggacagacaccaagaaggatatagggatgatttcatttacatgaagttcagggataggcaaaatataactacagtaatagaatttagaataggggtgtagagggtcgaaggtggccctcaaaaagataggtccatatcctaatcccccagaaactgagaatgtgaccttatttggaaaaagggcttctgcagatataattaagctaaaaatcttgagatgacattaatcttgcattttccaaataagctgtaaatccaatgactagtgtccatgtaagatacactgaggctgggcgctgtggctcacgcgggtattcccaacactttgggaggctgaggcgggcggatcacagggtcaagagatcgagaccatcctggccaacatggggaaaccccatctctactaaaaatacaaaaagtagctgggcatggtggtgtgtgcctgtaatcccagctactccggaggctgagacaagagaatcgcttgaacccagagagtcagaggttgcagtgagcggagatcgccactgcactccagcctggtgacagagcgagactccgtctcaaaacaacaacaccaaaacacacagaggagagacacagagggaaggagaagacaaaggcagagattggggtaatgctgccacagtccagcaatgcctggagctaccagaaactgacagaggcaatataggcttgtcccctagcccattctttcactgtggcagcatctctccaatctctcagagggataaagccttgggaatggatgctttaattttggacttctggccttcagaactgtgagagaatacgtttctgttatattaagccaccaagtttctgttcattcgctacagcagccacgggaatctatgcccagggaacaaaaagctgtcacataaggaacacgcactttctgcgctttgccatgtgtatgataccaaaaagtatatgaacaaaaatgaagtaatgggtttttcgggggctttttttttttttttttttttttgagacagtctcactctgtcgcccaggctggagtgcagtgatgcaatcttggcccactgcaacctctgcctcccaggttcaagggattctcctgcctcaacctcccgagtagctgggattacaggctcacaccaccatgatcaggtaattttttgtattttttgtagagatggggtttcaccactttggccaggctagctcaaaaatcctgacctcaggtgaaccacccgcctcagcctcccaaaattctgggattacggcatgagccaccacactcagcctgaagtagcgtttttaaaagtcaaaataaatcctcaaagttcaacttaagcatggcattaggctgatatcttcttgtagcagtgagtatttataaaacgatttttataaaatggtgatacttctgattttttgtgaggaaagctttttaaaaatataatcacacattttaaaatgcaccagaaaaactaggtattggagggaaccatttctgaattgtttatgaattgactaatcaccctgggtttgttttgttttgctgcaacttcaataataattattaaaacctaagtcaaattatgatttttcctgagtaggatttattttatgacttgatgtttctgtttgcctacatggagcttttcagctgcaaaataccccttgagataacatcagacagcttgggcaactccctgatttataagtgtatttatttattaattcattcattcatttctattacaccttaatttactaaactaaaatgtatcttaacttgtgtgaactcagagttgaaactcacgaattttcaaacatttaaggcattattagaaataatccatttgatgtatgggatagtattaattaaacaatggtaagtctatagttaattttatttttatttctgtaaacacatcttttattaaaaacaaagagattttctgtgtatgtcatacatactttaaatagaagtgtctcagagcttataaatctccaaatttaaccaaagaagaaaaagaagttgttatataatgtgatatttttttaaaaaaaaacctagacaaagattaaatactaccccaaacaacacccactgtatgtatatgggggatggagggttgtcattctgatccctgttggtagaaatgaaaattagcacaacctttataaagagtgatttgtcaatattattatctgtcagaaaaccaaacgcatttaccctttgacccagtaatcacacttctaggaaatattcttcacatgtactcaaggtacaaaataagcttgtacaaggttattgattctagtattttttaacagcaaaagtttaggaaaacttaaacatccatcaacgtgagactattcaaatatggaacaactgaaaaagcttcttttatattgacatagtgtgatttactgttaagcttcacaaaaggtaagatacgtaacaatccctataatatactatttttaaaaaacaacagtcctgtagtcccagctactcaggaggctgaggcaggagaatggcgtgaacccgggaggcacagcttgcagtgagccaaggtcacgccactgagcactccagcctgggcgacagagcgagactccgtctaaaaaaaacaaagagcaaaaaaacaacagtcggggctcagtttgttcatagggctgattgatatggtaatagtaaaagaaacgtttttctgtgtatcctttggactctttagaattttgagtcatgtgattgttttatgttttcaaagtcaataaagttaaaattataagaaagatagcctaagtaataaatgtgtggaaatgaatagagaattttttaatggacctaagtatacataaaatatagtataagataaatgcagcattatgtgtaaaacaacaaaccagtcaataaaaggggctggaaaaatataagccagaaccctatgttactgatctcactgagttcatttgatatggattgaaaaattttaatgctaaaaaataaaaccatataaggactataataaaatagttaccaaatatgcttataatatgtggagtaaataaaactaaaaatacaggaaaactgaaacataagggaaaagactaacctgtcgattacatcaaaatatgtatatgcacagtgaaataaaattttaaagcaaacaaaaaaacctgcaaaatatatgacagacaaaatattaatgtttattcagcaaacatttattgagcagctactaagtactagaaaatgggaaatagagatccacatcaatggtactatttttgccctgatggaggtcttacaaataacaataatacaaatattgtaatagaaaaatatttgcaaaagacaaaaacaggaaatttacaggaagaaggtcaataaatactgtatattttaaatatttaactttaataaaatcaaagaataaaaataaaaaatctaatatcagattattggagatggataaattaagcattgttcaagaatgggaagaaatggatactttaatgtgttgtgttgggggctatataatggtacagtctttttgtagggaaatgacactgcacatcaagaattaaaatgtgcatgaattttgctggaacaatttcacacctacgattttacaccaagatgaaaaatgatcaagtgaatacaaatgttcatgagtagggatgttcattgcagcattgtttacatagtgaaaaaccaaaaccaagcctccgtgtgtaatactgaagggttgataaaatgaagcaaagtaaaaggaaattccctgaagttattaaaagggagatgaattagatatattcattaactgagaaagacatccatgtcatcgttaggaaaaactagtttcaaatctgagtagtatccatggggaaatctttgcccgttttatgtgaaataagtaattcaaatctacaagacaaacaggttcaatgggtaatccaggcccctgtctctctgcctgtaacaggcaggcacagaatcaatcagagtaagcctgtggaccaaagagaatcctagacctcatgatactccatcttgggggtgctgaccaccccttgcccttctgaaaaatcaagaatctgtgaagtgtttggcgcacttagttaaatataaactttctccatgactcagcaattccattcctgacatatgtcccaaagaaagggaacattaccgaaaaaagtggcctgtaatcccaacactttgggaggccaaggagggcagatcacaaggtcaggagatcgagaccatcctggctaacacggtgaaaccctgtctctactaaaaatacaaaaaattagccaggcttggtggcgggcgcctgcagtcccagctgctcgggaggctgaggcaggagaatggcgtgaacccgggaggcagagcttgcagtgagccgagatcgcgccactgcactccagcctgggcgacacagcgagactccgtctcagaaaaaaaaaaaaaaaaggtgttgcagtgttgtatacgggacagtgagttggcagtacccaaatgcccatcactaaggaatgagtagaggatggaaccagggcacaataggcagcttttagaaacagtaggttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagaaacagtaggttaggtgcacatgtaagaacagggatagtgctgagaaaaaaaaaaatcagaaagatatctgtaaaacaacaaaatttatgtaagtttaaaagtgcatacaacaactatagacatttaaagatatacattaaatccattgaatgttcaccagcttggggtggggaagagagtaatgagagtgggaaatacaatggcatacacataggtacgtatttataaagagggatattgcatgggctaatgatgatagtaggccatgaaagttatataattaactccttgttcctggaaaataaaaaatggaaggaaggaattaaggtgggatggaagaaaggaagaaatgcagtgtgggagggaaggaggttttaggaaaggagaaagaaaggaaaaaaggaaggagcatgttgcaaagaagtataaagttgcaaagaagcacagataggtatgattccatttatataaaattttgtgtatatatctgtgaaaagggtttgtgtatacgtgtgtgcatgtgtgtacataaaagagatgtcttaaagaatactcattaaaatgagcattttaatgctcacctatgtcacccctgggagtgagattttagatgggttttacttttcttaatacttcttttgtattgcttggctattccagatgggaatgtgttatatctataatctgaggttgaggggttggtataattttgggttgtgggtggaaataaatcatccaggaatagcagatcctctctcttgctctcctgacatgtctttcatataaacattgtctctaatcatttttactcacccttcaatgtgtcaaatgtaaagcaggtgtggcagaagcaatagtgatttagttacaaaatattgaaatatactataaagatggacaggaaatccataaggtgcttcttctgcaattaagaacaatatctaatcatcagaaacaagtttgctggcttgaaatcaagtgataaaatgatgctgagccacaagagattcttgccctaattcccctaaagctgctcgttctcctgtttgctttgattgaacggcttctgtttctattgtcgcaggcagggatacctagcaaattctccgctacttcaggcaggtttaccctagctaagtgaaatgaaatcttaagcaacctctggggtacttgttggctttaataattcaagtgatagcacccactttcttttcagaatatatatgccttcctaaactgtctcatgcactgaatttttctattttaccatctttgtaaatattccaataatgttattacaaaataatggataactatgtccaagatgggtaaatttagcttaaatccaaaatatataaatcttagtggttccttgtaatctcatggacatggctgaaaaggggaacgtggttcaaaataatagtccccataagtactttcaggaaattccaactaacacttactaatttcagagtaagtagatactagctggcatccaattagctacagtatttacatattctatctcactgaatccacctaattaagaggtagtatctatttatgagataggtataattagccccgttctacagatgagtaaatttaaggtcatagaagttagataacttgaccaagaccacaaagctaataaagaagtgcccaacctgcagttcagatttaattatttcatagtatttagtgttccaagaagaaaatccaggcatgagggttttttttctttgcacttgtattttgcaggtcacagtcatataagtaattagccttcaccaatctcactatctacattttgtcagctagatacctccagcaaaagttgttccatgagaatgtaactttttataagaccacatctttaaaacgatattatcacatagtaaattagtggaatttttggagcctagctaatgttgctcagccattgattccctaagttgtttgggagagaagacattgagtagagaatactcctttgggctcatactatatattcatggccataaagcctccccttatatagtttattacttacctcttcaattgacctaaagtccactttttgtgggtggtaaagataattatgtcagaaatgacacattaactttagttgggatcacacacacacacacacacacacaccataaaagggcaaaacaaagctattgttctattatattgtcttaattataatagaaataaacttgaatgtcactgaaaatcataagctcccttacacacataagcctccaaacacatgcacacacacacgtgcacacacacacacacacacacacacactcactcactgacctccaaaatattttattcatggcaaagaagaaatggtttttctgtctgacttatcacaggcatttcatgcagagtcaaagaaatgtgacatatttttctgaggataaagtacaaaaatggttgtcgctttggggattaaaagcaaatatgtcacctttgtaaaagtaattctcaatgaattagaaaaacagaacatttctgtttcttttcagatactcatccttaagctgagcttgccctgtgctcagctgggtagcctatctgtgagatcaccatgtactcagaccaaataggaagacttattttcttgggggcattatctcacaattcgaaatagaagatttcaaggaagaggaccttaaaatattttcccaaatcattttgaattagtataattccctttttttcgaaaagccctctggttaagagtaagagtgttagaggaataactcaggaaggaccagaagccaatgatctcttagaagtggtcaagccagcaagtgcttcattgaagttgggactctgggtcaaggatttccatctgtgaggtcatatctgtttcagaataacttattcacccaccagtaactgacccgaaaaactagagattaatttttgtcacatttttattggtgtggggagcacagagcaatggccaacagattgcattcttgatagggcatgtgtagagtaaaaccctattaaaacatggttggttgttggatggatttgttccatcctaagtcaaataatttcctttgaagcttaagtacacagagaaaagttctgataagagacagcatatgaagcagacattagtcctgtccatcaaacatctttcatgaaggagtcccagcatacacacgaaacaataaactgctcttaggaagcactgagtcgccgcaaggaactgcgctagaatcttgctttaaatatttcccagaaaccacttatattaaatcttaattttattttgcaaaaattggaaaaatgagaaaacaacaaatcggctttatcctgtgctttggttctagcatggtggcagtatagcatcaccttggttttctctctcatcttacagacattaagagcatataacacaaaatacataacacaaagttgtgtgcttagagatctgtgcttttcttcagctgggacaaaacatgtatactaaattgagaagacaggaggtaggagaactgcacgctaggttctatattaagttttttacccacaaccacatttaaccctcacagtgtccctatgattcagatacgtttttattcttattgatgaagaagctgaagttcaaggacattagatagtctgctgcagttcccacagcctgcatatcactgacccaaattctttgtgttgcgtcatggtgaagggctccatcctctagctctctaaacctaaattagaggtatcatccttgactcttccctcacttgacccattgccactcaattagtcgtcaagttctgtggattcgtttttctttcttttttttctttctgttcgttctgtcaccaggactgctgaaacagcctctagtccgacagtcacctgcattaacgttccaaaatgaggatcagatcgtgttatccctgtacttaacgtccttcagcgtgctgccattggccttagaatgaggtacaaacttcttgatatggttttcagtatcaccagatattcgttccctgcttgccacctcacctatgtccttaacactctatgctccaaacacaattagacctttttcaatttttcaaatgctttcttgacttgggccttttcaatgctgttatccataccccaaaccctctccaattaccttttctctctgtccacacatccttctagtcctgggaaaattttcacatccttggaaagccttcatggttttcacatagcagtagttctgaaattgcagtcccttgactaatagcctaagcaacgactgggaccttgttaatgattaatataaattctagagccctatccctaacccattgaaccaggatctctagggtggtaactaaagtgtatgttttagcaagtacttcaggtgattctggttctggttgaagtttgacccacttccctctaggtgaaccccaatcctcacgagagtcacccagtactgacacctcaagctcatctccagaatttatattaatctccagagattttgagttacttggtctagggtggggcctgagaattggattcttgttacttatgtttttaagtttcccaatatgactctaatgtacagtcagggatgagatcttcttccttaggctaatttaggaccagtcttgtacttccctttcttgatacttgatccctttattttcttctggtattgtctgacatcctcggtagacagagtttatgagggtaaaaactgtatctgaacagttcaagcacagtcccagaacaataattcagatgtagtagtcactcaattaaaatgtattgaaaaaaatacatgttgaatggatatctacctaagatccctggcaaaagattactggctaacatgacctcaaccacccctgcaaagaggttttcattgaaaagtccacatttgcttgtttaggtcatcactaaatcactaacaaccccttctaaactttagactctttcacttttatcaacagggagttaaaatattaaaaatatcatcctccttgtcaccgttaataaataccatccacttgttccacactggaaactacatgtagttcctatctctccatttttcttctctcattttaattggggtgctacagagatgtgtagacttaaatttcaactccataaataaaaattgagcaatatgccttcatggagactattttctacaaatcttttcattgtatatcttaactttatagctattcaaattatatgctgattacacgagaagtgttttgttgatacaaactcaatattcaccttattcaatccaagtatttgaccaagtatgttaaggtttcagctacagtttcttatgagggtatgtaataaagtaaagaataaaaaggtaaatcattgatatggtttggcagtgtccccactcaaaatctcatcttgaattgcaatccccataatcctcataatcccatgtgtggagggagggacctcgtgggaggtaattgaatcattgaggcaatttcccctatgctatattcatgacagtgagagagttctcacaatatctggtggttttaaaagtgtttggtagttccttctgcattcattctccttcctgccaccttgtaaagaaggtgcgttgcttcccttcaccttccgccatgattgtaggtttcctgaggcctctccagccatgctgaaccttgagtcaattaaacatctttcctttataaattacccagtctcgggcagttctttatagcagtatgaaaactgactaatacaaagtaagtataaaactactaaagggaggtttagcgcctttaaatctaaaaaggaagtctgttcatacagtagtagaagtgaagaaggaatgctaagaagaacaggttttggggagaagttctaaaatgcaaatttccactgaagaaagagaaaggtaaaaaaatgacttagtagagagcaactgatcaccatggtaacagcaaaatagcacacagttggaaagggctcaccatggagcagagtcaggagacctggcctttcctgttgccctttttttcctttctggtttggaagaagggaagttcaagttgtgagggctggcagggaaataccaccagcaaggtgagcctccctggactgtaccaggagtgcagaagcctgtccaggctggttgctgctcttacctcctcagctgagcaactgagctccttggtagctggagagaggaagcagagaaaggtgcttctctgtactctagtactacaagtctataagtccaacaataccaggattccaaactccttgattcttcaatggtttaaggccatctattgacaaagcaactattggtggactttttttttttttttttttttttgagacagaggctcactctgtcgcccaggctggagtgcagtggcgcaatctctgctcactgcaacctcagcctcctgagtagctgggattacaggtgcatgccggctaatttttgtattttcagtagagacggggtttcgccaggttggtcaggctggtctcaaactcctgacctcgtgatctgccagccttggcctcccagagtgctgggattacaggcgtgagctaccatgcctggctgagttttggtggatgtttttagcagtaaaagcaaagaatcaactaaccccaggatagtatatgaggagcaggaccagctacttaattcagaggcccagtgcaaagtgaaaatgtggatccccttgtttcaaaaattattaagaagttcaagacagcaacagcagggcatgaaaccaagctcagcgtcctccgatgtgcaagccccatgcaactgcacaggtctcacatccataaagccagccagatcagaaacctcaacttagaaaaagagggagataaagaaacagcacttgatgcagtggctcacgcctgtaatcccaacactttgtgaggccgaggcaggtggatcacaaggtcaggagattgagaccagcctggccaatatggtaaaaccctgtctccactaaaaatacaaaaattagccagtcatggtagcaggtgcctgtagtcccagctatccagaaggttgaggcaggagaatagcttgaacctgggaggtggaggttgcagtgagccgagatcgtgccactgcactccagcctgagtgacagagtgagactccgtctcagaaaaaaaaaaaaaaaaaaaaagagcaaaataaagaaacagcacttgattctctacactgatcttcaacagatgtctggtttcctttacctctgttccaactgtgatatactctcataataaatctgcatcttgaatttaaagttctactttcctaacagtctgaatttgcttaagttgttgaataatatgttgaagttgtattcatatggttagtgaaagaaaagtaggttgctggtttgtaagccaaggggacaaaagtgctttctgttgatgaaccgagaaaccaatggatataaggatattataattctctgcaaggatattataattctctgcagaataagaaattgaagggtacagtagggaaggaagatgaatgccttgccagtagagcttatattcaggatataaatccaccgagtagcagaaaatattagttccttatctttgtatgctaaatccagcatagagatatggtctggctacatatagcctaaaaataaaagttggattgagtgaatgagtaaacacttttttcagacgggaaagggatggacaagacttgagaaggtgtgttgttttgctattattttaagttgaatgaatgtagtttaaattgccttagtttatgacagatttttccacaaaatacatgcaagcccctgtgaatatgttacaaatgtgctgagatgttgatgtcaaccccctcatccctttgccctgtacacatttttatcattttctagataagctatgctatctgatgagctatgctgtacacatttttatcgttttctagatgagctatggtgtacgagaggttgttatgcaccgactctgacttgtagagatatataggaatccaagcgggatgatctagttactgcctatgtttgatgaagtaggctgtgctcctttgtagagtgtgataaagaaggcagaaggaaacatttcacgactctgccttggagaaagacaggtagacatatgtcaagaagaattgcccacatggctccagtagacaagcagaaaacttggaaataccaaaggtggatgccgattacctaacataggtgaagaagggaagccaaccctgtcactgaacatttgtcagtgcttattttgaaatactattttcagaatatactgccatgggccaaaatgagttgaagcctagagaaaatacagccctctgtgtcctgtgcatttatcttctcccagtcctctcgcttgcagaatgttcagaagaaggacttacactgatacaaagcagacgagagccctgttccttactgctttgtttttatataactaatacaaaaagatattatcataaaagtttataaagcatctgttctccagaatttctgttgaggaatttaaattcttgcacccatctataagttacatggactccttatcagcctcctctccctcaacatcaccaccatcatcatcattaacagcatttgttcattgcccctgtattactaaatggagcaatacaggttaaaaaattttccaatcattagaaattttaattgaggacattaacattgacacagaagaatataggaaatacatagtaacaaagttcaatgaaaacttaaaatttttctgaaacatgatatttatcatatgcgtaattaacccaacataaccattaagtggtgaagaaaatgggcccatctactttgcaaactgcttctgcctaatttgttgatggctctttgcacaattttagtatttgaaccttttaaggatctcttttttgggtttcacatacgcaaatttacaaactggttttaaacagtgctctattttaatgaggaaaattttagaactgcaattagtttttgttcaaaaaagggtgggggggatgacaaatagttaattgagttcctctccaaaaggatatgaaagataaaactttgtccttgattacatagaagactatgtctttgtagtttaaaacattttgctattgatttttggttctgttgaaatagtatgtaagaaatggtttacactagtgtattggaaagttagaaattagcttcaagagggcaggaaacggttgtccctgagtgttgatgctgttgtagacaaataacacactttcaaaaactatttttatctaaagtcattttttcatagtataactcaaaaagggcagcaaacacttcttaaatatgagttacagccttcttcaataatgaacaaaaattgtattcagttgattttcttacctatggaccaagacgtatttcaataaaaaacagccaagagtgtttaaacatttccatttcgaaagattcaatgaagtgaaaaaaaatgtgcctgtaaaaagaaccagatcttccaaaaggaattaatttgtttttgaataatgcactgatcttttgaaaatggcaagttccaacgaataaactatgagattggtatcataactccaggaatggtattcaaacaactgggggacttggcatcaactaaaaagaatggatctggctgtcccagagctgcttgctgagtgttcatcttttatttggtagaactagaggaatacagtgaccttacaggagggactagggggcgggcatagtgataggagtgggaggagctcccagagtcttaagacagcagctatttgccagctggcaatacagcagtattttcaatattttcactactggtatagccaaaaggtgcttactgggtgatgtcaacttctgattctcaacaagggaatgtcacttactcatcagtgatatccagcccacactggcttgggtttgtgcagccaatcagatcaacattttcccatcagcgtgacatcaagcgtatgaacacctttcccatgagccaggtaccaaccattactagtatttgttatagaaggaaaaactgaagtccaagaataacatttcactggccagcatgccctctgcttctaccaagacttcagctagtcctaaatgcaagagcatggagatcacatactctactgatcttgaaacaaaaatcaattatcatcaaatgaaaataaaagtaaacgtaattagtaccttgttttcccccacaaagcttatattttatttctcttactccattagacatcggggccttcttatttattaacagtagtgaatccctgctctaccaaatatatgtataaagttctctgggagaaaacggaatgagtagctgtttttagggcagccatagtatgagttttggaactacataattcagataaaataaaatgttgacatggtttttcatttaaacactgcaactatcagagtcactatgggtactggatttattaaaacctcaaatgtttaaaaactgttggcatgattgtatgcatattttgatagagttacatgtagaagcatgttaataaaatatcagaaccaattataatagaaaccacatttaattaaaatttcctaatacaaccatattcactacattatttttacctttggtgtcattaattccctcctgactcatcccacttactaatttagaagacttaataataagaacatcactgttttctgtttcatactgaaataaggtgacactaattgctaaaatttttatcaaccactactgaggacctaggcaagtgaatattttgcctctatgaatttctcatgaaagcattttgagaccagcgttttaaagactattatttcaaaaacaatgtctgcacaagccatgaacaaatgctgaaataagatatttttattagatgttcttgttgaagcaagttggaacaagaagtggtaggaagatatttatctgtttgcacaaaaacagtaaactagatttatttgagtaatacatttatcaaaatcctgttgggagtatatgggtttgggtattcaaaaaatggatgtgagtctctctgctttccagcctgcctggtcaccttcctgcctggagacagtggtggctacatgtgcatgttttatatatctgaatattagcagtcatttgtcccaatcccacaagtgctgacaagggtcattgttggagtcatcggcacccctgcaccctctcactttgttacgctgatgttagaaatgtcacatatggaaggaagcagagcatcagacccagacgtgggcactactggagaagcagattggggcatttactaacatatagggccttcaggcatttaactcgatgaagctgagcacgatgggtgacacaatctgtttccaattccggatgaagtattcatatatacttggaccataaatttaaaacgcgagttgtctagccattccagaaaagtcacaaagcagtgtttgtatcagttgaaagaagaactatgcagttactgatagagaagatctccccgcatccagaagatcagggaaggactatagaatagcactcgtgggaatttatctggacgttgaaagatatgtagggtgaactactataaaaaacaacatcatactcacatctttgtcactcatctatttattccaaaaactcaaaaattcagtgaacactgtattagcttcctaagactgccataacaaagtaccataacctgggtggcttagaaaaccagaaatttattatcctgcagttttgaaggctagaaggctgaaatcaagatgttagcagggttggttgctcctgagggccgtaagggagaatctgtccccggtctccctcctagcttctagaagcctcaggtattccttggcttgtgtatcagggatccccagtcccacaggggcatagaccggtaccggtccatggcctgttaggaaccgctcacaacaggagatgagtggccagcgggtaagtgagcattaccacctgagctccgcctcttgtcagatcagcggggacattagattctcttaggagcgcaaaccctattgtgaactgcgcatgggagggatgtaggttgcacactccttatgagaatctaatacctgatgatctaaggtggaaccgtttcatcccaaaaccagctcccaccacccctcacctccagtccttggaaaaattatcttccaggaaaccggtttctcatgccaaaaaggttggggactgcagttgtagatgaattctccctgtgtcttcacatcatcttctctctgtacgcgtctgtctctgtgtcaaaatgtcccctttttataaagactcctgttgtatggcattagggcccatcctagtgacctcgttttaatttgattccctctataaataccttgtctcctaataaagtcatgttctcaggttctgattacaaggtgtctttttttgcttgtcacaattctacctataacaaacacctactagtagccaggcactatatgagccactcacaaatggcacagtttctgccctcatggtgcttagtaatctagcaaatataataatcattaagaaaaaaaatttaaagaacaacaataattgattgattgttacctctatgcttaagactacgctaaatgctttaaaagcattttctcatttaatcctcaaagcaacattttgaagtaaacacggtattcactatcattagaaacagcttggtggaaagttatatttgacttgagtgtgaagaatagacttgcaattcttcagtcaaagaagaagacacatcaggaaaactgcgtaagttgaggacagaaaatgtgtgtatggtgaacagaacgagctcaaatctggttttaggagactgaaatagacaactcttcagcatggtctgtctggctgcctctctcttcctccccgggctcctccgatctgcagcatggggttcaggtggcatcccccctgcacatatgcccatgcaacccagaggcggaggacattaacacccatggtgccattcttaaccgatgggagtgaaaacggatacatcatgcttcctctttttgtgccctgggtggacagttctgagacaccattcagaaggctctcagaaggtccctgcagaatcaagcaccaggtatttatagtggtggacagctcagtaatgcatcgttgtatcgtctttctctccttttctattttactctcctgtcctgtatttctccccagaattcccatctcaaaagactcgcacaaaagccttggcctcaggttccacttttaagggactaagatcattggcatcagattttattatcccagatcagagatgaaaacaactgactcatcagtgtctttttcaaagccaagaagctgtaggcatacccagaattagcacccaagtctcttagcactcaagtctcttggcttcctgaagaacatcttccccataaaggaggtcatccagcctaaaaactctcgataatcattttcccgtataaacaccttcaagcaccttgcatgagggaaagcactttttgctcctttctacaccgtcacctccagcacggaagattggtagctgggaccccattgccagcgcttaaaaatagttttatctggagtgaagccaaaaaggcaagtcatggaagtaaaatacaaatgttctgtctcttattgtctttccattacatggaatacatacacacacacacacacacacacacacacacacacacacatgaatttcagctgaggagaacacacacacacaaacacacacacacacacacatacatacaaatttcagctgaggagaaattaacttgaaccaaaatgaaagagaagaggagtagggacttctgactcaaaggcaagtctacttcaattgcctgtcactaccagattaaaagttgaagcacaagagccttttgagacctctaaaattgttctctgattgctggagactttcctactgtagagaaataaatatattaatggggtacttcttcctcccacaatgtccaaagtcctgtgttttaaaaaatttatgttatagaatatttttatattgcagttctttttttttttccatctttctcctgagcaaacctttttttatatgaaggtcacaacaacttccataatgcagacaggttgtattctcttaattgttctaaaagccacatacatatgagcaaattgctgtctagattaattatagaaaatgttcaaaagaattccattattattgcagatcccattaagaggctgtaatgtatagataataattctgtttactacaatcgacatccatacacatcctggaaatatccagaaaaagacatacaggatattttaaaacacacacattgtcccattcctttatttgaccatttcccctgattttatgatgcattaatattcagtggttttgtgatttttctcattttctttctcccttttccatgggcaccattctacccctccttcggatgaagtatgtgccagtcacacagccccacagagaaagttgctgtctagctagcttgggaatttctacacttaggcagactcaggaaagtgctaggagaaggtgggtcctacaaagtgcactcctattttactactaaatgagttaagaccccagaatcttcagtctttgggaaacaatcccataacagagcctttcatgcaattgaagagcttctttcataaagagagacagacggaagaaacatcaaagaaaatactctgcattataacctcaagaagatttagaagagggaagccatttcaaagagactgttttcaaagtacatgcggccctgggggagaagagcaacttcacttattcttctcccttatacaaacaagttttcagagaagtccctctgatgaagtatatcgtactatgctcacgaacagctgtctctatgtgtgagaaagaatatttagaaacaggtagctatttactctagcaatgctactgtgtgctagtgagtcatggatgcaacaatgctggttttgattttgtctgtggaataaaatccaaaacttggtgttatcaaaagctttgcaggcctctcaaccaggtcttatgtattttctggcttgaagagatgggagtcagacctctatctcaggattcctcaacctcaacagaaggatcagattattcttcattgtggggggctgccctgtgcattgcagaatgtttagcaacaccctggcctctacccactggaagccagtagcacctactcaatcgtaacaatcaaaaatgtcttcagataatgccaaaatgtagctaggggtggagacaataaaatcgtctgtgattcagaactactgttttatattaagaacatcatgcttggaaggattttgttttaaggcctgtggctgagtgtaggatatgccaagaacatactgagttgtctaaagaagaactttctggccaggcacggtggctcatgcctgtaatcccagcacttttggaggccaaggcggccggatcacgaagtcaggagatcgagaccaacctggccaacacggtaaaaccgtctctactaaaaatacaaaaaattagccgggcgtggtggcgggcgcctgtagtcccagctactcgggaggctgaggcaggagaatggcgtgaacccgggaggtggaacttgcaatgagccgagatcgcgccactgcactccagcctgggtgacagagcgagattctgtctcaaaaaaaaaaaagaagaattttcttagataaaatttaagctgacaagaacagtagtaaagaaatattgaagggaagtgcagaagcattgctcctggctctcacaggtggacaacatgcaggtggacaatataacccagtttgctgtatttgtcagagggagggattcttattctgctctacttcctccctcttagtccccattcgaagcaggattaactgtcccctggcatatggtggttcagggtcagccaaagagcattctttccctaaaggccctctcagtaactattgggaaaagccatcttatatagccaatttagggctagaaagaaaagaattttacagagtttgcagttgaatgacagaagacagaaggaatgcaataacttaaataaatctgtagccatgtctgtggagcacggaggaatccattagggtataaggtagcaaggagacctctcaaggtggaaaaataaaaataaaaaagattagaaggaaattgcaaagtgaagaaatgagcctttctcattacttgaaagcataatctctactcataaaagcaagcagaaaaaagagacatattagattttcttataaaataaaagtaggagggacaaaaatgctgcacactcaagtgtggtgtgtgcacagtgctcaagtaacttagaaagaaataaaggtctttgacttcttggcactatattagactattcctctgttcttctaagagcatgtggctctgccagaggcaggagctataagaagggagacagaaatgcaaagaggtcatgatcttttaaaggaaatatatctcactattttttctccatttgaaaatcatgttttatttcaacctattcgatttatattttcaagtcaataataatgtataaaacatctaaaagggcttggaatgcattttataaatagtctgggaattgaagactgaaagccctaagttttctgaattcactattttaatatctctaagttccagtatctagcttgttaaggataaggtgaagtttattcacgtttataatatatttaatttttgcatccaaactatcaaaaggaagttcacaatgcttttaattctgatgcttttgtgaggagcaggtacctttctgatttctgctactgtgtaggtatctagaaatcagttatcttatgatcttatgatgtgtttatttgtttatgaagatatagccatcagcattgattgtgtggcttcactactgaccttgcctaggggaatttggacatcaaactttggatttaaaaattatttctgtggaggttaattagctttttgttagtggtgtttcctttgaatgacattcaggggaaataggagagtctgagctgacacaaaattttagatgactttgcaatagggaaattacttttttatggatgtgggtacactaatgctgttaactaacactaattaactctgcctagagacagtcccagcatctgtatgaaattagtatggttctgtcctacaaaatccacactgctaagggaggaaataaataaaggtttctgaacatccgtggaaaaataaagtgttttctgtggcactagtaaactgaaagtagtatttaatcctagataatgttttcacctcccatgcttctgtccccatcctaccaacttgtgaaaaaataggagtccaagtgtcttgttcttccagtttccaggcacccaatgtggtcctctcaataagtctctgcatcatcttcagtctctgactgagctcccagcagttccatgttttcccccattctatcctccctccaattatgtttccgaatgtgtacacatctgcttaagaaagcaaaagaatctaaaagtaattggtgtctttcttggaaaattaactcatttatttaaccagcattttattcagtacttggatgtgtccaggaaatacatgagctttggaacatctctttctgaatcagcagcttccacactgagagagtatgccagagtgaaacctagcaactgccaggaactaaatttaaatcaaattgtgtataacttaatcacaagattacgtgttatatttcctcaattgtattaacaacagtcattctaaggcaatgtttcactgtcacgggaggctggagcccagcatgccctcctgttccagtttccttattcttgccttggtttgggagctcggaatctcgatcacctgaagaccactctactggagcatcaggagcatatttggctcttgttctatcatcagagtcagccaccctcctggctctgataccctaagggcaggagaaagggaaggacaaaagtcaaaagacaggaccatgatgtaaactctaatactaaccccagcccacccactcctcaaataatttgaccaccattggacagagctgcaatacactgaaggctttatgccttcttgtgacgcttagtccctgtattagtccattttcatgtaaagaatgcctgaatggggtaatttatgaagaaaagaggtttaatgaactcacaatttcatatggctggggaagcctcaggaaacttacaatcatggcagaaggcaaaggggaagcaggcatcttcttcacaggggagcaggaaggagaatgaaagctggaggaactaccaaacacttataaaaccatcagatcttgtgaaaactcctgcattatcatgagaacagcatgggggaaccacccccatgatccagtcacttcccaccagatccctccctcaacacatggagattacaattcaagatgagatttaggtggggacacagagtcaaaccatatcagtccccttagcagacagaaacctggcactactttggaggagaaaagctggcttactttcagaaggcaaatttcaagctagaaacctggaggaatgggagaagaatctggctttacatcgttttctcattaatcagaatcttaggacttcagaagataatctcagctgtctgtgtgacatatccagtatttcatttcaagtactacattgaacacgttgacaggaatttattcattttgaaatgtaaacaaatgacacctaaagaaaattagggctggctggtttgatgagaaaagcatgactctgcagtctaaaggtgactttgtagaggctcccaatttgaatacagggtggtcctgtcctcctggtgctacagctctagaattcttaatgcacagacagaagttgccaaaagtgagtgaagagaaactcacatattgtcttcttttctcttgtataatcaaagaaatgcaagcatgagcccctgaaaagttatttacctcttttcctattatagttggaattctagtgaaattagaatagcaattatcacttaaatagctgtaataattgaagactaggatgaataagttgtaagtggcctgcttaccttcaaatgtaattcctcacaatttgcagaatgagacagtgaacctagtgtttcctttatgataaattaatcattttaaaaatgagagaaaatgctatgattttaaaacttagcatgtcttatttttaagttagtgtttcaggtgatctcagaatgttattcataatggcaccttacgatgatgatgccttcctggaaagacatgcagactgacatttagatcagtcatttccaaagacagaatatctgttaactagagaaatcctgtcccctgaactaggatagagcattgcatgaaggaaactgtgaacattgaaaatctccaagtttcaaaaattgccatgtggaaaaaatactgtactgcacagctttactttattttgtgcgatagaaacgtttcttgccaggtgcagtggctcatgcctgtaatcccagcacttgggaggccaaggcaggtggatcacctgaggtagggagttcaagaccagcctggccaacagggtgaaaccctgtctctactaaaaatacaaaaaattagccaggcatggtagtgggcacctgtaatcccagctactcaggaggctgaggcagagaattgcttgaacctgggaggtggaggttgcagtgagctgagatcacgccatttcactccagcctgggcaacaagagctaaactgtgagaaaaaaaaaaaaagaacgaaagaaagagaaagaaggaaggaaggaaagaaagagagaaagaaaagaagagaagaaagaaagaaacatttttaaaattctaactgtaattgtaaaggcataaatagaatctgatttaaaagacttaattgaatttcacacacagtgaatccttgtgaaatataagaactttttctaaaaaatatttatcttaatatatagcatgatttgcttttttttcatttcagaattggttttcttgttgaaagttatacagtaatattcgatcttttcttcaacatattaattagatttctacttaagctaaatggcaggactgttttcagtacctcaaagagagcaagggtattttgctgcattcactttctggaactctgctgcacttggcctgtggtctttctgtcaagctggttgtgatagcaagggatgctgaatgcgttcatgagttcgagaacctgggttctgagctggaagtccacatcagagcgtgcgctaagtgcaagtgcaatgagtcagaagctaatgaaaagggtccaaagtgtgcaggcaacaggggcactgtggctcctaggggcatttgccagcttggcaaagtgcttatcggagaaatgaggagtttctgacaacttgggctagtcacaggcttcatggtgaaacttattatcatcaacagcaagcccacaatagattaccgaggacagggtattgcccttgtgatcagcaagtatcacacaggaaaggtaaatgttgttgtaaaactaaaaaagtaagcccacaaaattttggaaattcttcctttgcagtccccaaacataatcctttggaatctgtctggaaagtcttttccatctgaattactaaaagcccttctaagagaaatttgaatcttggcgttgtatgagctgtgaatcactgacagacatctacagatctacagaggtacagttttctgtctgtgcttatatctacagctttaactgtataaagtgactcaatctaagccactagctcttgagacacctctgcaagatcgtgtataaacaagacctactagaattactctcaatgactttcaaattcggtactgttttattgtagaaagctgttacagagaattaaaatctccgaggcatcttcgcataccacggtgccacccatggagtgatgattgctcttaaaggctaatttgattatgtgccaccattaatggtgaaatgggaacgtttgaaaacactgttagattccagtacaacaatttccctccctacccgccaagcttacttgtatttaagttgcagaaaacatccagtgtttcttatttaaaggcctggcactctcttggcttatatgttgaggcacatgcctgagtcacactttgtgtctgatgtgcaatgaggtccccttggaaattgccacctttactctcttgccactttgtctccaccaatgagggtttcccagcccagcgcatatactctgacgaccaggccacaaacaagagcatgttggaggtgaaaagaggatgaggctctagaacagtgtcagacatttgcaacactgtatatgcttagaataggcagtcaacatgttaggaagaaacaggtaaggctttggagtcagaaaaaccggattcaaatctcccacaggccaatcacttaatttcttaggtctcagatttctcacctataaacagaagaacaaatctttctcataaaggaagctgtaagaactggaacagaaacagaataaagattattatggacaaccaataaatggtagcaatctttattactatcattacagaaaggtttgtacagctgctcaaaattatggtttggggctcattgaaattagaaaattctgtagagaaaatgtccttattgagatagcctaggacaaaccaatcttagcatctatcactgcctaccttccagggaggagtagacagcagagggaagagagatcagctttgtataatggacaaatcaaagataaaccagatagagctaacgaaatgcattctacctaaaattaaacccaatattctataactctctactaatgttacagtgtctacattgtcttcctttgttctggtttctgacttctgttctccctctccacatcttccttccattctctttctgatcatgtctatgcatctgtcaagtttatctgctgatagtataatctatgattccaaagacttaagaaggatgtaaataaatactgctgtgccaggcactatattcaccaggtgtttcatataaattagtttaactaaccctaacaacaaccttgaaaacatagcattagaaaataagggaactgggcagggcgtggtgtctcacgcctgtaatcccagcactttaggaggccgaggcgggcggatcacgagatcaggagacttgagaccatcctggctaacatggtgaaaccccgtctctactaaaaatacaaaaaattagccgggcatggtggcgggtgcctgtagtcccagctactcgggaggctgaggcaggagaatggcgtgaacctgggaggtggagcttacagtgagccaagattgtgtcactgcactctggtctgggggcagagtgagactcaatctcaaaaaaaaaagaaaagaaaaagaaaagaaaagaagggaactgaagctgttttccaattaagaagatttctgaaggtctcacagaggggagcttctgaagccagaaacttaatcgggacttacctacctcctgtgcagtgctggtgctgagtgactcgcttagctgaaacccctaaattagagctccatgctttgttttgttctgtgtcctggttgtttctctgagctccttgtgcatccagagacagcagatcaaaggcatcccttttgctgcatcctccatagctctgagacaggcctgaagaacctgaagagaatgttggactagaagagggtccattatctcactaaacgcacactaatgacctaaaaagaggctttgagattatcctttcataattttgctcagtgttctaggactatgtaagcaaatacaggcttctttgactggaagtaaattagtctaatgatgttttgtggcaatcccttccaacaacgtcaaaataatctgtttgtcatgacttgaccttattttgttataatccctgtgatatggtttggctgtgtgcccacccaaatctcatcttgaattgcaactcccataattcccatatgtcgggggagggacccaatggaggtaattgaattttgggggcaggtctttcccgtgctgttctcatgatagtaagtctcataagagctgatggttttataaaggggagttcctctatacaagctctcttacccaccaccatggaagacgtgactttgctcctcattcaccttctgccatggttgtgagggctccccatccatgtggaactgtgagtccattaaacctcttttctttataaattacccagtctcgagtatgtctttattaacagcgcgagaacagactaacacaccctgtggcagagacttgatgttatttcccaaatcttagtttgttttcctctttggcatgcaatgagactatatttcacggttttccttgcatttaggtgggcatggatgactaaattctggccaatggaatgtggctccagtagctgaaaggtggaagatctctaacatggaacatgctaccccttcccaccttcatgaccttcactgttctctgattagagcaaaagataaatttctattatctcaagctaagatctgagaaatacttgtcatagatagcctacgctgtctaatgcaatctatttcaagaatataaagcagcatccctcaactgggagtaattttgccaattagggatatggaaatgtctggacacacttaagattacaactgaggaaggggtagtattggcattaatgggtagaggccaggaatgttgctaaaaattcaaaaacataggactgtcttccacagtataaaatttttcaacccaaaatatcattaatgcagaagttgaaaaaccctgcttaaagttaagtcctctgggggaaaaattgattatctggtacacactcgataagctcttgattgactggcttctttgagaaagaacttaaaaaaataatgctatcctcatgccgacaatcttttaagcaggtatttattaggaaaaaatttagtcatagaagaagtcactgtttgtgtttcaaattttctatatataggaaattgtgctagttaattaaattggcagatttagtaaaacaaacatcttttattcacagaagtagtgtagtttacttaattgatgcacttaaatctggaggttggccattataatattagcactatgtgagaaatatgtatgctgtttaccaaaatagttaatctgagaagttgaaggaaaccttctaccctgattttggagctcctgctttgtctgcagggatttaccaattagaacaatgtatgtgatgggaattgaaatgaggccaccaaccccttttaaatgtgatattggaacagtccctggttgggaaatatacatttcagtcactggttcgcatttctttttttttaaattttttaatttatttttattttttatattgagatggagtctcaatcttgttgcccaggctggagtgcaatggtgcgatcttggctcactgcaacctctgcctcccaggttcaagcaagtctcctgcctcagccttccaagtagctgggattacaggcacctgccaccacacccagctaattttttgtatgtttttagtagagatggggtttcaccatgttggccaggctggtctgcaattcctgagctcagacgatccgcccacctcggcctcccaaagtgctgggattacaggtgtgagccaccgcgcccggccactggtttgtatttcaagtggcaaactaaaacgaacaaatatgatagaattttctagtttattttttttatttttttaaactgttgtgtttcatgtctttgctaatcatttctagttttttttgtttttttgttttttgttttttgtttttaatagtaaggatttcctctgtcttgaatgccaggaaacaagttatttccatcctggtattcattggatatttgtaagatctttattcttttgtgggatcagggagaggatgggcacccaggcgtgaacctgagaaatttctactgggtttttctggagctcctcactgtaacgtggcattgtccccaaggccagctcttcttccatgtgattttgctactcacacacgcagcaattaccatgtggcattagctgaccgtgctgggcgcagcattattattgtcattattttttcttttttgagatggagtctcgctctgttgcccaggctggagtgcagtggcaccatctcggctcactgcaagctctgcctccccggttcacgccattctcctgcctcagcctcccgagtagctggggctgcaggcgcccgccactacaccacacaaattttttgtatttttagtagagacggggtttcaccgtgttagccaggttgaactcgatctcctgactttgtgatccgcccgcctcggcctcccaaagtgctgggattacaggcgtgagccaccgcgcccggcccgtttattttaaatatcacatcctcgtaataaaaatttccctcaatgttctttgaggcatccacttaaataactcaaaaatgttttttgcattctttaagaggtttttataagccagacaaccttaataaccatggcctcaatcacagacagtaaaaatatgctttgcatttctcttctaaccctaatacctaagccagctcctggtaaaatgttatccgaacctttttactcaattcatgacaggtttttgggatatattctactttccaggcactgagttaaattctggagaccagaagaccaagacgttgtccctacactgacattttatctaatagtcctgttttcagattccttgccctaagctcttcctattttttgatttctctcctccagttctcattccatatcagagggctcctgtggatgctccatgctctacgggattgcactcttccacctgcctcccatctctccatgtaaagaggcacccaaaggagcttccactctattgactctctggagcgatgttttgcggtggccgctatgactttaccacattccaggacaagcaatttaaacctcatgcctcagatcccccacctggaatgtgagaatgatagtggtattcacctgttagggttaccatgaagatgaaataagtgaatgcctgttagttaactattaagaacagtgcctggcacatgataaatggtgttccatgttgatgttgatgctgatgttctcatccctaagttctccctttcccttttcagccagggcaattaatctgccttatgcctgatttcctcaaggctaggctttctaagtgtgggatgatcatgcttcaaataaatgaatccatattaatatactaacaggaaaagacttgagaacttccaggcacactttctttctcctctagtttaaaggaggtgagcagaagacaaatatttgtttttatccatcactacaatctgatagaaatatagaatttgtgtattcaaatatgaaccctcaaatttggattatacagaaaataacattttaagattcttacttgtattagtcagcattccatgaaagaaacatataaccaagatagatagataatagctagctaggtagctagctagatagatttagatatatagatagagtacaaagaattggcctacatgactgtggagactagataagtctgaaatcgatagggcaggccattaaaaaagagagaatggagactcccaggctgaagctgatgctgcagtccacagggagaatttcctgtcccccaggtaaacctcagttctacctttacatcctttcaactggttgaatcaggcccacccagattatggaaaataatctgctttactgaaagtgaacagattgcagatgctaacaaggtctacaaaataccttgccagcaacacccaggttagtgcttaattgaatgactgggtactgtcgcctggtcaagttgacacattgaaatgacaatcacacccctctgtgtcagatgtgtgattttgtatttattcctcacagaaatcccagggcgaggattactcctcatttcgtaagtgaggaaattatgctttcatgatctgaaatactgtgtaactcaactaaatagtaggaaccaggatttgaacacgtgattatttggctctaaaacctgttttacatgcattttctataggaagtttagtttttccttccatattcttgatctcctgcttgggacctcagtctttgtaggcatgacgcatatgtgtaagcatcgatctccaagtacataaagccacccacacatgagttattttggactttcctattgttgtatttatttatttttctgtttaacttcattagtatggaaaaatccaagttcactaactgcatttgttccagctgtaatctgtcttcattgctgattggtattttactatgcaggagaggttagaatattttactatgcagagtaatttacacacagagttgtcaccgtatcaaagccaagtttcaaacacccaagactggtccgcatactgcagttttggtaatgagtctgcctgcctagtaaaggatacctaactttgaaggatttttctccttaagaaaaaggatcccaatacctcttactggatcatagagatttccatatgttcagatccaggtagttttgctcaacgtacatatgatctacataactatatattatatatatattatacaagggcacagaacatccaataatccaattgcacacaccattacctcttctgaggcacacagacttttcccttagatcttcatactgtttacctaaaaatatttcatacacctgtacatgaaatcaaagactgctttctttaataaagcaaagggatgattttaaaggtaacttttaaaaatagcctgccagtatctgcttttatactctagaacagagtgagtgatttgttttctgtttcttgttcccatttctctttcttgccctaaagggagttggtaaaattttctgtggtttcacagggacaattttatggtagctaacagtaatatgaagcccatctatgccagagggctttgctacactggccccatctgcggagagtccaacattgattctgtcacaggcttctgtcttgagcatccaatttgcctctaagatatttcagcgtgtggagagttgttttcttgacaggcagccaaggaagccaagtatgtgattcattttcccagagagaaaaagaaaatcttcccattaattacctctcacctatttgtacaatgcagatgaagggtttgtttctcaatcaaattatattttattatacatgaagaagagactatcctttgtttcatcgcactagataatttattttataaaattgttattaactattaataattgttattacacagtgggccaatattcttttccactaaacatggatgaagtaagacagcttgcaaactcaaaacacacacacatgcatgcatgcactcaccagaaaaagagctcttgcctctggcatgatatcatctgacaagagcatagggtgctgtgcatattatttttcaggttctccaaataggaactagagcagcctgtcatatcaaatctgaacttgtccagcatttctaagcagagtcctccactcccaccttctccaatcatttaagaaatctcctttcctggtactgttcaataacagatgcactacttacatatactttttatttttttggaggcagggcctcactctgtcatccaaagttggagtgcagtggcacgatcctagttcactgtagccttgaactcctgggctcaaggaatcttcctgcctcggcctcccaagaagttggcactacaggcacatgccaccacactcactaattttttatttttttaatttttttttgtagagatatgagtctcactatgttactcaggctggtctcaaactcctggcctccagtgatcctcccacctcggcctctcaaaatgttgatattacaggtgtgagccactgtgcctggccatattttttctttgaatttactttgtacaatattgttaagctcctttttctggccatttggtctcatccaagaaatagtaagcttcttgcaaagaagaagcagacgttctcttttgagtattttcacacatccttcatgctcacagcatataatcaaagaatacaattttttgtaagacctcaacaaaattaagttccttgttcttatagttaaattagggggaagtgactgaacaggaaagctactgttaaggatatcattcctggaccaagtgcttagacacatactaatgaaagcaagtcccagcccattctagctctgaccttatctcatggaagttaccaaatcactatctacagaagcgttaaaagtccaaggagatcaaaagtatataagagctgtttcagaaaaaccagcatcttcttgaaccagagggaaactttggagacgtcatgaatttctcagaagagccctagctctagagactattatctcttgccagtactaaaaaggcttagcattttaattcagattttctatactgagacaacatatgctaaccatatttggaagcaattaaaatggtgacacccactgccatgcgcacatgtcctcattaactttgtgaatgtgttacaggcaggtaggaaagacagctagcgtctcgaaagaaaacccccgtaagtggaattggaatggcaaataatgggaacaatcataatgcaaatgtacattagaaggtcattaacaaactggtcagattacttgcaacctatgtaaaaatcagatgtaccagtacccaccaggacatatgcagattccctcccattgtagtaaaaaccatcttgagtgtaacagattgactgggtgtgtcaggctgagaggcattagcaaagctgctgtgtgcatggaagaaataaagaaggacttatggagcatgcaattgcaagttctccctgggcccaggactacatcattaagagatggctccataataacacacgctcactccccattcccatccacagaaataaagtcatggtaaacctttagcagcaagagcaaccttgaaggggaaaagtggaccaagaggcagctaaaggaaggtgatctggaaaaaaggtccagtgccaccattattaccagatgaaagggaggtaagctaaggacagaaatgtgcaaaaggctgcagtaggggtggtgtgaggcagctttcttgccaactaatcttatttaaaacctatctatcttatttgatatatcttattaggtatatcaaataagatatatcaaatataatcaaatgttgtatctgtcaggcctctgagcccaagctaagccatcatatcccctgtgacctgcacgtatacatccagatggcctgaagtaactgaagaatcacaaaagaagtgaaaatggctggtccatgccttagctgatgacattaccttgtgaaattccttctcctggctcatcctggctcaaaaggtcccccactgagcaccttgtgacccctgtccctgcctgccagcgaacaaccccctttgactgtaattttccactatccacccaaatcttataaaacggccccacccctatctcccttcgctgactcttttcggactcagtccgcctgcacccaggtgattaaaaagctttattgctcacacaaagcctgtttggtggtctcttcacacggacgagagtgaaaatatcaaacctatcttattagatacatcaatttgatatctaataatatatcaaacctctcttatttgatatatcagtatcacaggttttcttttttcttctgagaatctataagagagcctgactcttcaacggtctccaaattttgcttctctcaattcttctctctccttctctcctctattgaccctcatcagaaaatcaaggagagattggaccatactgcttggcgtcctacctttacaagaaaatctgcctcagcaatcagtagttcaagacaaatgtggtgccacattttgtctatacacccctgctaggtccccaaatgtcagcgtgattctgagtctcaaatctttgtagttccaggtaaaattgctacatcttttctccctaccagatgcctcctgtcgtcactgttgacccagagctctggctcagggtgatgtttctaccctgtggttggcttgtctttcctttagaatgcatccagagttggagttggcaaatgtagagtaggtacatattcagaaagaaagcaagacagcaaggaaggaaggaataaaggaatgagggagggagggagggagggagggaggaagggaaggaagggagggagagaaggaagggagagaaggaactaaaaatagggtgactagtttaggtatgattgtacatattttaattgccgcaaaaagatgcttccctctcctcaattaattcttctaccctgattcctcattgtatatgaaatgccatcattaaaaaaatagtttgttggttcttgtccctacaactaatactactaatactcttctataacaactactactaatattcatgaaatatataaataaataaaaataaatagtaaaaataataaagacttcacaatttagattacgtacttttgatattaaatagaaatttacacttttcataaacagactgtctttttaacttcattgcaatatgcggactaggttttattatacagataagaaattgagactcagaggagttaaataatttaatgaaattcacacagataataaattttatagttgaaatatataagcagttcttctgactttaaaatatgatccttcccacccccatatatcaagttgcatgtttttgcttgctgccttttaaaaagtagaaataatcctcggtcaaatgctgcacatgaattcacattaaagtgtctgcactctcctgctgataaagacccaaatgtggcagaaatggtacagaagaggaggcagcttgggatttggcagtcttgtgaagattcagccatggctataaacaagggtatgtggaatccaatgggagccttcttaactaccacatcccaaagaagtaacagagagctcaagcccttcagcccatttcacagatggagatgctgaggccaaggctattagacacgtccactatgctacgttagatcggtgacaaagctgattctcctgacttccagtctagtgagctttctatcatccagtcctgtccctatgtgatcagctgcataaattctgagtaaaacaactgactatattgttcaatatccactgtaacatgcaacttgctcatcagaaagttaaggctaactttttccccaacaggaaagtcagaaacaaatcatttttagtaataatgaagctctgttagaagtaccactcaccttaaaaatatgtttaggaattattaatatactctcagcattctgattttcctggctttctgaagctaagatgttgcaggagagccttcgtggctttgatcacaggcaatcaaagaggactttgtgtagcttccagggacacgctgttgctggaaaagtcggagctctgctatgcaaaagaaactgctacagaaatccccttcattcttaactccagatcgaattaggatcagaaggctcttgttcgctgcccaggagtctgtggttttaattttcttatctgcatttttctttcctgcccgttccaggtagctgtcacaaaaaatatgaaaagggtgttaatttgttgatcgttctttgctgcttctcactttcatgtttacagcaaggagaagagcaattgtttctaccagtagctttagtattttgagttctcatgtgtgtaataactatcttggtaggcccagaacacacaatctcatccaattttgaaatttggattttatgccagatggattatttcagtacggattacaaatgcttatactattctgcctagcagagtttgggtcataaaaatcattaaatgtaaaacattgcacaaagttgcccaaattgtcatgtctctggccaaatttgtggaaataaaaggagccatgcatttgggttatttctacagtttggaaactttgactcttatcttctcttaagctactcaggaaatttccagactctaaaatctgagaggaattgttcagacagacaaaggtggtccagaatggagactttcctgatgccaaggatggcaggacccgtgagtgtccacttcacccctgtgatcctacctctcgtgaggctttactgatgaccttggcttcctctttgatgaaacttttggtggctgagcctcttgaaactgacttggacaagcttggacaaacaaccttcttttgaatcaacagagtgtaactgaaataccgttggaaaattcaaacaatactctgattaatgccagggagaaacaatatgtaaataaacccaagaacttaaatgaatacttaagaaacatacaccttgctttcacagtgttagctggaactcaggaaaggggtgttggaaaaagtggaggtggcatgtctcttttattttattgtttgagatgaaacgggattaagcatgtttaaattctaagggagaaaaaggttgctgtaaattgtgactttaaaaagactgacattaaatcacagaatatttcttcagtgggctactgaaatttatgtctgtaatcactactcatgctttctattcttttttctttgagatggagtcatgctctgtcgccaggctgaagtgcagtggtgcaatctctgctcactgccagctctgcctcccaggttcaagcgattctcctgcctcagcctcccgagtagctggaactacaggcacgtgccaccacgcccagctaatttttgtatttttagtagagacggggtttcaccatattggccaggatggtctcgatctcctgacctcgtgatccacctgcctcagcctaccaaagtgctgggattataggtgtgagccacccggcctggcccatgctttctattctttcttcaacaactgatactatctttcttcaaccaactgatactttctgccttcgcctcttctcagggtctgccttgtttaccttaacccctgcaggaagccagatcacaattggagatttccttcctgatcatgtaaagagaacacaacaaggatttgggagattaatctgatgtgtaagagctagacatatcctactcaaaaggatgctcttactccctagccaggaccatgcataaatggcatgcccatattgctctgagactttcttttcccttatcttcccatggctgtgcagacatcagttgagactatattctttcttagtactctaatacattcaggcaggttacaatcaagtcttgcagtcctgggagctcttttgtctatttaaggtaactgtgattctctacttttatttattatttgtttggctcatagtttagctctcagggaacaattttattttcattattcctaagttcttgggagacaccttatggtatccaacaaagactaacaacaccatgcagcagtgcaaattcactctaagtaaaccgatgaaaaatagacctttaatctgattgaggtgtagaaaatggctacctaaaagtgatactttttccttttgattattttgtatggcagtaccttgagtagggaaaaaatgttttctttttctctgtgtgtaaaaatcaccaaaagttactttgaacatcaaaagaacaccactttaaattgcatttctggttgttcccttcaattggcaattctctggtttatatttgtgtgtcatctcttttaatgtcctctctaaacctgttgctcaatgattcattaaaattgataacaccctacttcagatcagccaagtcctttcacttgaactttttctcatagtcactttacaattacaatcattgagtaaaatcttaactctcttgagtgaacatttatgattttctgaattagccggaatgatatcaatacatgtgttagtgtgcacatgtgtgtagacagagaaaatgagagagaaagaaacagggagaccactgaaggaaggttatcctctgtattttattcccacagttctttgttcaaattgtgattaaatcacttatcagatcatgcaatgatgtcactatctgtatttgtccttgcccttacactgttttacccagctttgtgtttcaagggcttggcacataggcagaaatttcaaagttgtttaacaaatgtttgataaagtaattaatttcaaatcagggcccaagtgtggtacccaatccatgttctagtgtagagagatgttaaaattaaccatgcaacctaacataacagtcagcacacagaagtgcaaaatagttccaagaataattgtgctatgtgtagctcttctcttttctcgatttttattttttttttatttttgaaacggagtcccgctctgtcacccaggctggagtgcagtggcgcgatcttggctcactgcaagctctgcctcccaggttcatgccattctcctgcctcagcctcccgagtagctgggactacaggcgcccgccaccacacctggctaatttttttgtatttttagtagagaaggggtttcactgtgttagccaggatggtctcgatctcctgacctcgtgatccccccgccttggcctcccaaaatgctgggattacaggcatgagccaccatgcccggactctcttttctcaattttaagaaatacaaagtttaaaaatgttgctttgattggctaatttaccatacaatattttgtgtttcatggacccacttttcatttcataactgtcaaggacgcacaaaataccagattcaggctaaatgccaggaattaaagtcagaacaagtttgaaatgaaaataataataataattggtaagtaaccaggcagcatgacataagtattcattgagggaatcagaggccctggattttaaccctgtactctttctacctgtgggatctaagtcaagtgtattagttgtctattgctagcaatctattgctaagttatctatcagttacccaaagttatctgccttttctccaaaatgcagcagcttaatacaacacaaatttattatctcacagtttctgagtgaggaatctgggcatagcttaactgagccctctttcttgaggtctctcacaaagctacaatcatacacaagagtaaagtctcatctgcagtttcaacagcagaggcatctacttctgagtttactcgtgcagttgttgacagtattcaagtcttgaggatcgttggactgaggatctcggttgcagttagccagagggcacccccagtcccttgccatatgagcctttccaacatactctcttgttttatcaaagggtacaagctcagaaagcattagagagactctgccaccaagatacatgtcacagtcctctataatcaaatcacagaagtgacatttaaccactttctctgtattctgttgtctaggagaaagttactagccccactttcaagggaaggggactacacaagactgtgaatgccagaaggtggggatcattggaggccaccctaaagactgcccgtcacaacaagtgactacgtttctctaagccgactttcctcttctgtaaaatacaggtcaaagtgtctcctacctcatgggattgatgtggaaatcaaatagtacatttaagccctgagcatatagtgagtgctcagtaaatgttaggcatcattaggtaattacaacacaccacaaaatgtcctatgctgtccttatcccaaggactataggagtacatggaaagaacagataacaagatcttgaaaaatatagaccaaattttcagaacaagtgaagtctatcctgagacctgaatgaaggagagctgtaatcagatgaagaataagaagcaagacaatagaattccagggaggaaaaaaaaaaaaaaacctagctgagagagagcagtagtgccagctagcttgacaactaggaaggatttcttgccccctctcctcagaatgtctgctttgaaaagtggaacaaagacagaagtgatgttggaggtgtgcaaatgtgcatatgcatgcgtcaactccaccacaaggacacatggtacacaggactccacctgatggaagttggttggcctttaataaatacagaaatctctagagagtgggaaagagaaggatgaaagtgggaaaaggagtcagaattgtcatctctagatgaaaaagttttctaagtttccagggatgcctcctctgggagtgagatgccacctggctcccagctcctctcaaccagtaggtccctggaccaggaagaggcagacccccagaagaactcccttggctcatccatcctcaagaattttatttttataacttataacttatgtacacgaatttctatttttttaacttctattttaagttcaggggtacaagtgcaggttgattacataggtaaacttgtgtcatgggggtttgttgtacagattatttcatcacccaggtggtaagcctagtacccattagttattcttcttgatcttctcccttctaccaccctctgtccagtgaaaggtcccagtgtgtgttattcctcaagaattttatgacaccgtttaaatttcccaattctaacactggccaaatttgatattagcctgaaattcatttcatagcttccatattttgaggtaattatattaattttcacttgatttatgttttcctttgaatcactgatacatttagattgctcaaaataaaacaaaatattatttcttttatatatatatttttttctgagatggagtctcactctatcacccacgctagagtgcagtggctccatctcagctcactgcaacatttgcctcccgggttcaagtgattctcctacctcagcctccagagtagctaggactacaggtgcatgctaccacgcccagctaattttgtatttttagtacagacggagtttcactatgttggccaggctagtctcgaactcctaacctcaggtgatccacctgcctaggcctcccaaagtgctgggattacaggagtgagccactgtgcccagcctaaatattattttaaagtacacgctgaagagccactttcccactcccatgtctgtccaccctcttccaaagcataaatggtaaccactttaacttctctccaacttttttctttgattttctcccaacattttattttgaaattttttaaagcatgagaaaagttgcaagaattctataaacacccatatgcccttcagtgagccatcacttgacaccattctgccacatttgcttcatctctctctgtatgtatacatttacatgtatttatttgggagttaggtacagaaattctgatactttacccctatgattgaatcctcctaaagaaacatgcagaaatatctaagaacaccttgaaaaaaaaaaagaagtgaggaagggactagccccatccagcgtgaaaccatcctgtaaaggctctataattaaaacagtgatactagagcatacctagacagacataccagagaaacagcatagaatacgcagaaacagactcaagcctgtttgtggaaatttagaagcaattaaggtgccatctcaaagcaatgagaaaaaaatgttctttttaataaatggtgtggaggaaactggatagctatttggaaaaatgtaacctcagattcactatgttcataaaatacactccaaatgtgcaaaacatgaaaccatacaagtactagaagaaaccgtgagtaaatttctttagaatctaagttcaagaaaatccaagtacaatttcaaaaactgataaatttgactgtatacatgattttaaaacatcacatggcaaaaaataaaatgtgtacaagaaattcatccatgaaaccacttttagtccatatgtttactgaaccacgcagtgaggtttattattcagcattgattaatgttccgtgagttcagacggagctaggctcttttctctgagattgcctttaaagatgggttgagtgactcagtaatatacagtgttgttctgggtccaggaaatggatgttgtacttgaaggatctgctcactttgtctccaatccaagtatttaacatccttctatgtttgtgtggttctctctctttctacttaattttgcatttaatgtatttctaataaaaacatgagactcaattaaagacactcagtttgagtttggaagcatcagaagacagaaatgcttttttttctgattccttttgaacaacagaaataaattgaactcaatcatgtttgcatgaatgattctatttttgtttaaggaaatcttgcatccaaagactttgcagaattagataaattccttgtcagagttttgcaactaatttatttttatttgaaggcatatggttaagagtctttccttgacaaaataccatgaaattaattttgatgtatcactgtaaatgaggccattgtaccttctccatgattaaatattcacaaacatcacccagagctttcaaaaggactctgtttccttctctcagcaaaggcctggcaagtaacaacagtccatttcctagtgatgagtaaatgcaagaaaatatgtaaagatccaagaatttgtcaaatgaaacaacggcaatcaattttctaccactcgacctgtggaaacatgtaaagtccccaatgagattttacactataaacataactgttggataacttaaaatatggcagtttaataaaaatggtcatgttccaacagatcattcaaccagcaagctctgaaaccttctatatataaattcatatatcaagatgtatccttcaagaaatatgtgtcttctagtaggaatgtaggctgttgaaatttaaataagttattttttatcaatatgattttgaaatggttctagaattccaaaggtagaaataggaaagtctgttttctttattgcaatttttaaaaatttgcttcttggctgataagatactaaatagcagctacattcacaatgatttcagaaatgccccccaccatcacccacatttactcacagtttgttcccttttaaaatgtgacgattgctgttttgcagtgacaaaaaaaatgtattgatgttctaatttaaaaaaaacataaattaacctgtcaatgattgaacatcattaaaagagctgatcaatataataaaaatcaggtctccagtttcaagtcatggcatgagagagccatttaatgtcctaggaactcaattgcctaaattgtgcagagcaaagttttaaaaggttgcaaattgtcttaaggacaagaaaagcaccagaaaggatagtttggaggaacattgagtaagccttccaagaaggccctggcaaaggggcaatggaagagactgggattaaccaggtgtctgaggattgagtacacatcgccctggtagtacagaaaggctttctgagagaaacaagagcagtaaggtgtttaagggagttggtttctacatcttcagcttccgtagtcatcttccctaaaatctatcttcttgagaaagtagaatatttcagctatctacttggtgaattgcccttccctcccttagcaaagaaaaggccaacctctcaaccccctgagtcgtctgcagtgccttgtcacgggtataatgactcccctgtgattggtaaccatggttcccatgtaacaaatcttttagcaggttgagcactttcaaatattttcctatcaaacattaaaggagtaactaattgaattggctaatagattgttaaagatactctttgatgacagtttgctgtttgattttggcatgtggcactgaagagtttcaaagacattgctctggcagaagtctctccattcccacctccttatttctctgaacaagatttctgagctgcctcatggggtggttgtgaggatttcagttaattaataggccaggcacgatggctcacgcctgaaatcccagcactttgggagaccgaggcgggcagatcatgaggtcaggagattgagaccatcctggccaccatggtgaaaccccatctccactaaaaatacaaaaattagttgggtgtggtggcatgtacctgtagtcccaactactcgggaggctgaggcagaagaatcgcttgaaccctggaggcagaggttgcagtcagccgagattgtgccactgcactccagcctggtgacagagggagactctgtctcaaaaaaaaaaaaaagaaaaggaaaataagggcagcatgaggagcagtggctgccatgtgataaggaccatgtgggggattgatgctattattactcatactatcgttggtttatgttgcttgatgaatcgtgtactaataaacaatgtaatagtcacttaatccagaagaagttttttcaattgaaatcattttggtcacagaaaactaaaattaatgcatattataaacagtgtgtttgtgtatgtgtgtgcatgtgtgtgcatgtgcatgtgtgttgcacaacatatgacagttatctataaaacatctccaaatcataaaaacactttatggtaaaattatggtggaagaagttcaaagagaaaggtgataatataaaaagagtgaaaaacaacttagtgtgtatttttaaatggatgttggtggaaatcaaatcacactggcgtttatattctactgcatattttaattgagtaaaataattacttttaaatgccaatattttgaggatgttggaaattatatatttggcagtatttaaaatcactataaaatttgtttacatattgttcaaaattacttttttggggagaaaagaacaaaaatgtctgaagacctctgctttgtaccatataaaatgaatgcacgatgttcctttactcttcctaatcttcatactactgtcagagtaaccagctaactgccctggcttggtcttatctctccctagacttcttcaattctacactgccttttggattttaggaaaaatctaaactcttcagtgcagtttacaagccctacaaatattctcccacatccctttcctgtctctacttctgtaattttgcatgacttcaacttctatccacacagaaccactggttatgggaactatccttggtctctccccctcccttattccgtttcctctccctagaatgtcttctgtttctcatcacattcagatctctgtttaaatgtcatcttgccagagagacctacctggaccatcctatctaaaataggagtctgtctccatcactcttaaccccctcattccgctttatttgtaatcacagcacttttcactgcctgtcattatattatatttttaatgtcctttttctccaatgtactataattttcatgaaggcagcaactaggtctacctttttcactcctgtacccctattgcctcaaaaccattctggcacattgtagacagccaataaatattttaaatgaatgcatacataaataagaaaatgtctaatttgatttttgtgtccccagcacagtttaatttcgcaataaatgtgtactgacttgaagacattacaaaaggctgcattattgtttccaagagcaatatctagtttctttatctgaagatattttagtaaatgacaagtggtttttgtttctaaaagaagcaaaataaagaataagaactttactagataatcaagttccttttacattctatgactttatgataattcaagatagatagatgcattaaaaataatcaccttgtacagtctgtgaattcatattctctgaaatatagttcctccacagaaaccacttggagatgctaccatatctgagagaaaaagaaaaagtcgttgctttgttttcaaattaatcatttattgtttccatacaatttattttcttcagtgtcttaagcacaaaggatcatttctgcttttaccctttcaagtttcatttctgtgggatatttaacaatgcaagagacttgcaaaagaagtcaactctctccaagtgactgcaaaaagatttgaaatccatcctcttggtatgatggaggtaacacctcaaaaactgtttgcttcttctgaatgtagtttggaatcttctcaaaggtgggaagatggttgtaattattaaagatggctttataagagaaatgcatgcatatacacatatgagtgttcgtgagcacacatatacacaccccacacaaacagataaagtgggagaattaggagcacaagtgagtcactatcagcaaaatttcccaagtgggaaacctcactgaagtcagttcatccaaacctctctgtctgcccagtgcaacgcacttccattcagttctgtgctgcctcctgacctgcctttgtagactagcttcttgagctgtctctatggttgctctcagccatttctaaataatccactctggtagtgtgggggagatttgcttcctataatcaaataaatggagtttttcaaggagcagaatagttcacaaaaaaatcaatagcgtataaataaagttgccttcatgggagataaacaaatacatgtgctcaccctcaaagtcatgttatgggatgtaaaatacttcccagacttgtgtctcagatggtgatcgcatctgacaggaatatttgttcattgcatcaatgctaaagtaattttatttcatgtttccagagtggagggtagaaaaccttcacgtgacctccatccttggcacctgccatgaaatggtaaaagccaacttgaattaaaggcttgggttgccccagatgggccggcaaagccttctttaatgtgttagcatgagatttgaagtgagtatatgagaagaaaagctaaaaacccaactaaaacattagttattcccaaggtttggatatggatgtgggaaaagaaggctctaactgatgtgctaaaaacagttttctctttcacgtctccttctggaatgtgccccttttattttgtcattcttggctcggctccccacttttcaagcctcctcagtcgtttcattctgcctgagtatttcctttccaatattttggctgaatgttcagctttgtaagcagaaatgcaaagtgagcgctttgaaacattacccaataaaatccaattttaaacagttagagctacaacttcccccatcctctgggaaatgagcctacagtttctttgtgcttcaagcagaaatgttagagccagaattactgcccaggccagagtctcgccaagaccatcagataagccacctgggcaaggtcttacaggccacacttaaaaggggacttcttggaaacatcaagctgtctttggaaattgttaagcataggtgactttcatattgtgggtaaaacataaatggagaatacatctagaagtatgaacatacttattctctgaaaaaaaactcacattttcttaagtgatctttaagaaataattgttaataatgaaaatgtcgggttgagcatggttgttcacgcctgtaatcccagcactctgggaggccgaggtgggtggattacctgaggtcaggagtttgagaccagcctgaccaacatggtgaaaccccgtctctactaaaaaatacaaaaatcagtcagccatggtggtgggcgcctgtaatcccagctacttgggagactgaggcaggagaattgcttgaacccaggaggcagaggttgcagtgatccaaaatcacaccattgcactccagcctgggcgacagagcaagactccatctcaaaaaaaaaaaaagaaaaggaaagaaaaagaaaaagaaaatgtgaagaccaaaacaagcattgttaaagtctaaagtaaactttccctttcataaaaatgcccacttaataaatatttaaatgaatttatgaaacatatccttaaggttaataatactaattttcaggaccaggtacagtggctcatgcctgtaatcccagcactttgggaggctgaggaggaaggatcacttgaagtcaggagttccaaaccagcctggccaccacagtgacaccttgtctctacaaatataaaaaaagttagccaggtggtagcatgcacctgtggtcccagctacttgggaggctgaagttggagaatcagttgagtccagttgagtccagttgagtggaggctgctgtgagctgtgattgtaccactgcactccagcctaggcagcaaagagaaactctatctcaaaaataatcataatcataatcataatcataataacaataccagttttcagacagtatctgatttttataactctttctgaggagatcaatactacaatgcctgcttcacaggtaatgaaactgaggcctaaaggaaataggctgtttacaaatattctatgagcacagtcactacaatgagttttaattgctttctatgtctttagacctaattttgtcttggggtcgtgctagggaaaaacatttgacttgatttctttttatatttcacttaatattctttatatgttatgaccttgcttaacttctttcacttattcccttttctttagtattggcaatgtaccaatctcttcaaatatgttttcaattttttttttttttttttttgagacggagtctcactctgtcgcccaggctggagtgcagtggcgcgatcagcctcccaagtagctgggactacaggtgcatgctaccatgcccggctaatttttgtaattttaatagagacggggttttgccatattggtcaggctggtctcaaactcttgaccttaggtgatccacccgcctcgacctcccaaagtgctgggattacagtcctgagcaaccgtgcccagccgatgttttcaacttttggttacacacagactcaccctgcatacaagtatgatatggttacttagtcatatccatgtgtccccaagagaagagaatagcatatataagttgttccaaaccactagaagatttggggtgcaatgaggaagacattaaagacataaaattatatctgtcaataggatgaaattaggactgtcaccagctcatattgtgcctttgtgagaattagaaagcggtacccctctgaatgaacacagcctcactttatgagttggacttgacaccttcttgccactgaaccaccctcatgctgagagaaacagtgatggaattcacctaaagtgaacacagttcagagtcaattctaataaggatccatgcatgaatttaatgaatatttatcagttatctatgtcagatagttttttaggctctggagatccacgatgaataaagcaaagtcctttctttcatgaaatctatgttcttgttggggagatggaaaattaacatggtaggttctgaaccatgctatgaagagcaatgagatgtagagtatggggaaagaaaacaggcagtctagagtttttgagtgtgctctgacttggataggcagggaggtctctttgagaaagtaacattaggttggagagcaggcaatttaaggagtgtgcaagttggaggtccctgcatgccaggccaagaaagcaaagtacaaaatgcactgaggcaggttctctgatgtgtgagaagaatcccaagaaggcaaaacagatgagagcaaaatggtggggaattagtaggaaacagaatgcagaggtcattagagctatgtcaaagaggcaatggtgacaagaatgttgagttcaattctgagtaagaaaggaagacaataaagaactttgataaaaggaggctgggctcagtggctcatgcctgtaatccaagaaatttgggaggcccaggggggtggatctcttgagcccaagagttcaagactagtttgggcaacatggtgaaaccctatccctgcaaaaacaaaaaaattagccaggcatggtgtcacgtggctatagtcccaactacccaggaggctgaggtgggaggatcactggagtcgaggctgcagtgagctgtgattgtgccactgcactccaccctgggcaagagagtaagactctgtctcaaaaagaaaagaaaagaaaagaaaagaaaagaaaagaaaagaaaagaaaagaaaagaaaagaaaagaaaagaaaagaaaagtgctatgatccagtatatccattaaaaggatcactctgtctgtagtgtgggaagtggaccaatgggccaaagtgcgagccagaaggacagagtggaggctaagccataattctagaaaggaaggccagtagcctggatggagtggtagtgatggaggtgcttggaagtggggcatttttatttataagcctcttcagattaaataagcctcttcagattaggccaataatgttctggagcaagtttgtattggctcacaagagccaactgttaaattttcaggaatgttgcaagcctattgttaaacacagccattatgaaaaaattgaattacacaaacttacaattaaatatcttatattaaaataaaagtaaatattaaaaatacatagtaaatataatagtaaaactaattatttcactgtattttactattacctatgccttacagttttacatctactatatccatatactaaaaatgtcatacaatgatgtgctactgtgcatctcttttaactgcactgagtgacattatgttagtaaatggtaactggcaatcatgggaatatttaccccttgtaaatctacatctataaacgctaacagaggttcatgtgattgtcgagcaaaacaatccttttcctcaaaatgaaacattttcttcatcacttaagaaagtgatgaagaaatgttaataattcagatttaacttaaaagtgcaccatgtcaagtgctgaagctaaaagaggttttagtttaatgaatataatttgcataagaatgggaaagttttaaagtagcccacaaatttaattacaacaatttttttgaaaaaaaaattaggggattaggatgcaactttatttataaaactatgttcaaatttcaactataagctggatacagatatacaaatttagcaaaaatcaggaaaaaatgttcatatagctagaatatagcaagactcaattggctatatagaatttatgataaatagcattgtgtattttattattatttataagttattggtatacattctaatatcagtaaaatttatatataaacacacatagagttttgagagctggttcttaaatatttaaccagctctggataaggctctcctatgttggtatttagaatttgaaaattatttacacaaaccatccatggtaaatcaaagcatagaaaaatctcgaaatatatggcagatattcatttagtagtagcaaggccccaaggaacagcactgcaaaagcatctccctcagtcaaaatgtaaccgcctgtagaagtaaaacataaatttcactcatatttttatataaattaagttcaatgccacatgctacttaaatgaaaatacttctaaatctaaaccattaaacataataccattttccgtggcattttttcacatttgtcttgttcatcatgaaaattaaccacagatattgctggttaaatagttgccattttgatcttctgaggcttacagtcacacagaactaggatgtagttaaaggaatatattaatctcacggaaattcagatcccatttgttttcatccaaaatcgagtgaggcaaataaactaaccctattccactactagcatatccacaaatacatctccaatggatagaagttattctctcccaatcctctgagaacttttttccttatttaaatatatcattgatatccgtggggtaaagtcaatggcatatctctcttaaagtgatatttatgatatttaacatttaacaacttaaaacttctctatcttaatacaactcaaaaattaatctactggccaactcaaagacagattgttaataatcatgattgcaatctacttaagttgcccatttaggatgcatcacttgaagaaaatcaacagttaattagctattattgttagccccaaattacagttgccagcgccagtggttggggaaaaacagtgactgcagcaatggaaggtggataatgtgtgccattatcaatttgacactaaaaatagtgttgccttcagcccctatgtttgaaggtgctgatgggttttgtacctttctcccaaacttccatgcctatcccccaaagcctggattcttcacatctggaagagaaactttcccaggatgcagaactgggagtttcaggcaaactgggatactttattaccctactttaggtagaaatccaaacgcagtttaaattacaacggtcgttcaaagagttcatggaaagtgcttattatgagaaagaattacgcaaggatttcaattgtttgcaccaaaataaactcacattaacttattataacaaatatgaacacaatctagtttgagtcactaagaaggagaagacatctgtttgaaaagagctcctatatgagtaacataaattctgctaaaattgaaggaagaacaaacatcaaatttatgatggagcttaggtggaagaatgatgaaaatcactgatgctttacaagaagtttatgggacaatgccccaaagaaataagcagtttacaaatggataactcattttaagatggtatgagatgatgttgaagatgaagcctctagcggtagagcatccacatcaatttgtaaggaaaaaattcatctggttcgtgttctaattgatggtgatcaacaattaacagcagaaacaatagccaacaccacagacatctcaatttgttcagcttacacatttccgatttaaaaattaaaatggagcaaattttccagttgatgggtgccaaaactgttgtgcccagatcagctatagacaagaatagagctctcaatggaaattttaagcaagtggtatcaagatcttgaagcatttatttgaagaatttaataggagatgaaacatggcttcaccagtatgatcctgaagacaaagcataatcaaagcaatggctaccaagaggtggatgtggtcaagtcaaagtaaaagcaaactgctcaagagctaaggttatggcaacagttttttggggatgctgaaggcattttgcttgtcaattttctggagggccaaaatgataacatctgcttattatgagagtgtttcaagaaagttggccaaagttttcgcagaaaagcacctgggaaaacatcaccagagagtcctcctccactatgacagtgctcctgctcattcctctcatcaaacaagggcaattttgtgaaagttttgatgggaaaccatcaggcatccaccttacagtcctcatttgcctccttctaacttctttttgtttcctaatcttaaagaatctttaaggggaacccatttttcttcagctagtaatgagaaaaagaatgcattgacatggttaaattcccaggaatctcagttctttagagatagactaaatggctgctatcactgcttacaaaactgtcttaaacttgttgaatgatatgatgagaaataaggtttatatttttattttatcttttaatttcatttttaatgaattttttgaagttccctcatgtcccataggacaaaagtgtaggctaaagataccgtggctatgaatgtcatgatggtaaatgaaatcacaaaagaattgtgaatagaaagagagaatggtaaaataaataaatgagcaaacaaacccaggaaatatcaatattatggagcaggctgaggaagagaagctaataaaactagaagaaattagaggataaaaagagagccaggaaacagctatgcaagttcagctaagttctgtcttgcaaatacatcccatagctatatctgtgagcagatgaaatttcccttggattgatgtaatcggctatttgaaatcttatctgcagtttctcagaaattttcactctgaagagctcatttacattgaaaactattcttcagaatattgagacacataaatactttggtttaaaaagaattcctgtgccattcctgagatattttgattggtgttaagatttcctctgcttatcctgttttgcatgcatattctaaaatacctacctctcagaagggaattcaacagataaaatttccttctgagtggtggtattatttaaaaaaatacaataattattataagtagttcatttgtgctgtagaaagtgaaaaaataaatttataccgcaattatgtactttgtagaattgaacagttccttcaggtacggactggccaactagggatttaagcactgtttacaaattactgggcgaactgccataactcagaaattctgcttttctggaaaaggggaccacatttaaagtaataaaaccattgggaaaatgtagtgattatgacatgtttgctataatagtgtcgaagtcatgcatcttggcatttgctttcttctttcaatccagggagagattagaagttgaaaatcggtattaaaccatcttaattgttttcatgggcatccagagcatgtaaaaacagccaaaactgctcttcagaatcctcagactcaaaatcactttttaagtttaggatgaaaactcaattcaaaatatacagatccaccctcttacatataggtaacatctccagaaactatctttctctactacagttacagacatgaaaaataccttcaagtggtgaaaactgaaaaagctcaggccctttaggataaatgaagtttcaggacactcactagatcttatgactacctaacccattgttcttacatcacagcctatataatttatttattctgttgcctatttatttccctgtctaccctggtagaatgtaagctcacctggcaaggattttgcctgttgttcactgatcatctgaagaggtgcctgtaggtgttcaatcatttgttgcagaaatgatactgaatatgacaaacaccacagcatgactagtggtctgactaatgtccttcctaaatgaaaggccctgagcagtggattttgggggaaaacaatagggcaggcttccaaagggtgccactgctgccaagattctccacctcctaccttcctttttttgacttttctgctgactagggcttcttccggcatgaaataataagaaatgcccagcctcaaccattcaccaaacttccttctttcctcagcactcaagaaacctctagactcgatggccagagaaactggaaaggacttgaagcccagggttacaaaaagtggtatttccaacacattatgagtcaaggaagctttggggaatgggatgaggattgattaggtccccaatcacaatcactcatcttactccttggggaaaaaaacctctgagttccaactaatcaaaatccagatgacaacttggaaagccacacattcaatgcattcatgagttggaacctacttatatggtatcgcctcttctttcacatcatgctaatcaagttttcctattcttcttccctgtccatgctacttaaaactgcaaactatctcttacttaatccttctagttttctctttgatttcttgttaccagctgccatctcttaggtcagatgcatattttatgtatttattctgtttattgttttatcttcccttgttctgctagactacagctctatgaaggcaaggaatgtatcggtttttgttcacctttgtatccctagggcccagagcagtgcctagcacatggtgaacgtccatcagttatttgttgactgaagaaatgtataatctaattgacacactgcattctccacttataagctattatgatacaacccttcatccacactgtgatgtaatgatttatagcagtgaaatatgatcgacagtgctaactctcacatcctcattcttatagcacttgctcatgggtctcatccaccacctgcatcccttggcccttcactcatctcttcactgagtccattgtattcttactttgttccttattcgacctaggccctatcccccttcacgtcaagtttcctctcaccaattcactgagccttgctgaccttggccttctatcacatattccctgcagtttcccaaacctaaataattgaatccatcctgcacatgagtagccaatcaccaccagagaaaatataattgtgtggatgctattacaatagtatggttttgaacttcagcttgaacctcagtgctgcttggcaaggtttatacaatggttaattttatatgacaacttgattgagctaaggaatacctgggtagctgataaaccattatttctgggtgttcctggagaagatgagcatttgaatcagtagatgagtaaagaagactgctctcctcaatgtgggtgggcttcatctcacccattgagggcctaaacaaaacaaaatggtagagggagggcggatctgctgtctgcttgagttgagacatccctcttctcagcagtgctcccagttcttagacctttggactcagactggcttttccggggctccgcttacaggcggcagattatgggacataatcagattatgggcagatgatggaggctaaaaacagcctccataactgtgtgaaccaatccctcatcataaatttatttcattctatctatttatatcccattgattctgtgtctttgaagaaccctgactaatacagttggtcactgacatgttctctgtccagttttctacttccctacatggacagttccggacatttacacttcaagcctcttacaagagagaatagaaactattatgtgtgaattcccttaactttcgcctgctcccgtttataaacctatctctcctcatactcatgcagttaggtcttctctgcattcccaccatgggtggcctggccctctcctcagatactggccatatgaacctcataggataagagcaaaggtgtggtttctactgcagacagcacagaatggaaaggattctaaagcaattgtcaatatacagtaccattatatcaagttttataaagaaaattctattatttctatgtctaactcatcatcctcgaaaaacaatgtgataaacaaaacactccaaatttctcattgtaattgaatagtttatataaatccctaaaaatatgttcctatcctttgctccacttctaaaaattgactccaaggccaagcacggtagctcatgcctgtaatcccagcactttggaaggctgaggcagatggatcacctgagctcaggagcttgagaccagcctgggcaacatgatgagaccccatctctaccgaaaatacaaaaaatttttcttgcatgcctgtgctcctaactactcggaatctgaggtggaaggatcgcttgagcctggaaagaagaggtttcagtgagctgagatcaagatcgcaccactgcactgcaacctgggtgacagagtgagaccctgtctcagaaaaaataaaaaatatatataaataaaaataaatataaaaattgaccccaaaataatacagtagacagatttagattatatgaacattaagattattgtttataattttctgatattagaagtaaagcttttatatacatatgtatatacctatatatgtgtctacatgtaccaataacaattgtaaacaataatttaaatgtttgtacataagaaggattaaataaattatagtcaatttatataatagggttttatgtaaccattaaatagtatgttagatatttaatgatataaaaatgattacaatgttgttttatgaataataaattatataaaactatatagagagcttaacaatgttttgaaaatatacactcaaaagaaatactccaaaatattaagcagagttatgtctttgtgatggaattataggggattttaagtttgttctttgtgtacgatattattcacataagcgtaataacaaatgacattttaaaagtacatgttgaagctcacatattttgactttctaaattagaaggggtgtgtgtgtgcatgtttaatatataattaggcataaaagtcactttggcttgttgatgtcaggcaaattgtatttcatctatgagaaaaaaaccagagtgcttttacaaaaccctaaaaatacatcaagaatgctgacaaagagttaaatattctggccttgaaactatcctcattttcctaaaatacatttcttaaatattcatttccttctgctcacataaagactgataaatctcattcagtcctaattgcattggtttgatgatcaaaacaggcatttcctcttcctcatgacaggagggggttttttaagcagaccaagcacaaaagccttttctgctaatttccccattttgacatgagtgaatactatctgtctttccacctgaaccagatctcattctaatgggcattaaaatcccttttgaaaatgtattaatgctctagttgtaagatacctttgggaacgtgctgaagtgtaaagtctgaaaaatcagaaatccacccttgttttgcgtgtgggaggcagacgagacaatcatttattgcggagagaaaaggtatgctctattggcctttacaaaagctgtaattttattttgaagtcctcaagttttgttctcctggtttatggttttatgctaaaattatggctttgtaataggttgtgaggcatactttatgcactctcataattataagctattacagttcattctttgtatcaggatggttttatggacgtttaaatgaagtttccgacaatgaagctatggttctaataggactacattatggctacacctggtcgtatgcagtctcttggattttctaccatgaactattgggaagaggagggtgggatttcaaacagctgcttgcctcacactgagctctagcacgatatgtggatttatcaatccatttgtatttaaataatgtatatgcttgttccctcactgagccacaaagccatcaaagagaaagatcatcctagtgattttatattctttttgccaaggaagacacctgaaagtttaaaaacataaaacacagtgagtcacttgtccttttccccaacgaggaagataagaattggcaggttgttgcttactctccaatgtttacttactagcaatgatctgttagcatgtgccaagggtcatttctcacggcatttatatttactatggttttggttatttcttactgaaatgctgttgaagatggtgaccttgttcgcaatcgcttgcagttgagcattcaatgagaacacacttctccagctggagggagcgttgactgagtggactctcagaaaaggtgtaattaataattttaaacatcccatgtggcagtagagtttctttttttttttttttttttaggtggcaaagggaccaaggtttcagtagctttctgaaggaattcgactaaagtcaatgataaaaatatgaaagtgaaattaagcacgactgagtgtcaaattcccacgttaaatgacctccaagaaaaggaagaaactccaattaagataacaaaataaaacatacgctaagaaaagattacatgctcccacaaagcaaggatgtgagaagcggcacttagggctcctgtagccccttaattcaggctctattatgcccacgaattagaggacatatgctcttctatcaaattgttccacaccactggggaaagtatttatttcatcactgtgagctaagtatctttaaatcattgctgtgcaaatgcagcctccaaagaaaatttaatgtattctttaaaaagaagtcaacagtatcataaaacgtctctcccatatttagttgtagaatccgtttggcttccctctttaagactcccagttcttgcatattttaacacttctataaagctgtaaataggggtattgcaggctattttcactcaatgctttagaattcactaatgaagatgagagtgaggatttccaaatataggaacagccctcagtggatgaagaaatgaatcctgccagattgatagttgcccaacaatcgtatctcagacacctgacctaactctcgcctacaacataggaagggccagtgatgtaggtctttttccccacagggaattatttcattctcatcttccacatcataaaaatgaatcagttgcaaaatttgggacattcaaacaaccatttgactgatgtcacgctaaaggaattatctggttaattacttggccacgaggatcgattttgtagttgtggttgtattcatattaaagctgtcttcttctacatatacatagcccaagtggatcttataaaaattatatatgtacatctccaaaagagggcacaacatttcaaaccaattaggcataatattcctgggctaatgttcttgttgattacattggttcatgaatggaaagtgcaggataagacctatggaacagctgtgatttccccaatatttgcttgaatttacacatcagtgaaatcaggagtaatactaagaaagaaagggcagttagtttctttgcttagagctgcttgtgttagctttagaaagtatagatagagtaaaaacaatattggagttccaaaaaaaaaagaatgagtaaaaatgtactcctgtacttcaggaatgcaataactccattattcatcatcaggaagatttctaaaggctggtccattgttccatatgcattaattgtgactacacttagaaaattgcctaatattagaaaaactgcactctaaaataggtttcccaatatctctgatatgaatcaactggaagtgtattaaaacaagacaaagcaaatttctaacttcttcacttggaaatcctgacaatctgtttatctatttgtttcaataagctctcctttccctcatgttctgtgattcctctcatgagagaaatttgggagcaattactctaaaactactcggaagataaatatagctcaatagcttactaaatctgtaaagcatgatgaaagcttgaatgataaaaatgtgcttttaaaaatagttgtaataattataacagttaagattcaattccagatgcctttataatgagaaataaattccaatagctaatacttttaattatttgctggaaaacagtattctcaaattttaaattaaagaaatgaattagaatttatctatttcttcatttaaaggagagcatttccaaactataaattttagctagtaataattttttttggtagaaacagggtctccctgtgttgcccaggctggtcttgaactcctgggctcaagtcaatcctcttggcctcccaaagtgctgggattacaggtatgtcagctactgtgttggacccaaatatttttcagtatctttttatccagtaataagtgttacttgaagaaaacttaaaattgagatagacataaacagtaaattacaaatcttctatgatcaaatttcctaaaattaactgctacgaacattttattcaatatatttctaaacttttttaagacatagaatcttgattttagtttcttaaatctcaattcaatctctttgctttgccttcttatgtggttgtagcgtaggaaagaacacaatggcaaatagcagaatagatttgtgggaaatggataggaaattaataatatttttgttttctgattctccatataatttgtatataatgtatgttacagcacgtattttcatttttcaaatctttcaactaccacctaatcttagtttacaatggctaaaaaagaaaataaaagtattagtttgggagttttttttttttttttacttttatttatttacttttttttgagacagagtctctctcagtcacccaggctggagtgcagtggcacgatctcagctcactgcaagctctgcctcccgggttcacaccattctcctgcctcacccacctgagtagctgggactacaggcgcccaccaccacacctggctaattttttgtatttttagtagagatggggtttcatcgtgttagccaggatggtctcgatctcctgaccctgtgatctgcccatctcagcctcccaaagtgcttttttaaattttttagtttttatgataataccctccaaccaggctgttgtttagaagaaagtgaccacaaatctgctgtgagtcatctctgccttgatcaatgtccttcttctaattagagcatccattatcagtgaggaccacagggaaggcagcatatctcagggtatgttattatgacagaggtaagcatactcaagctcttccaaggtcagagatttattttaataagacctaattttcaaagggccttatgagaaacccaaattgcttaggaaataagaattttcttcctttcatcgacaggaaatacattgttaataattttattgtggaaaaattctttctccaaatgccttgtacccatgagtgtcatgcaaccctgagctttgtctattgcattccttggaactgaacaacagtagttcaggaggaaggcatggacatttagaggtaacgagatgcaggagaggctattgaagggtagatggaaggggcaccaaaccaagacttaaacattgtatagtttttctagacttcaataagtagagtttctttctcactgcagtcagagattttacaggctgttaatcctgggacaccctgcttctaaggtagttttttgtttgcttgtgtattttaaacttggggaacataatatctgcctatttcctacctcttcttcttcctttattttttttttttggtatgtattctcctgctactctcattcattctctttctattgtccattgattgctttttagtcacttgcatttttttttcattttgcccattgtcgattcagcttcctaaggcccttttcatgaaaggaggatttacagatctccccgctatagccctgcaccactgtgggtgtaacctgctgtgaacttttaagagaaagcggctggtctctcactgcgatctttctctgcccttttcatccacaatgttccccaaagctttgacttttatcatgtggttatctaataaatgtctgtaaagttatgtagaaaagggaaaaccttccatctatcctcggagggttcaataactgagtctatgaaacaaactgacaacaagcacatcaacaggaaaaaagatatgcaaatttttacatgctcaaggacaccataggaaagaaaagtgagtgctcaataacactgtgagctcaagcagcttatacaccttcttcataggggagaggggagggggatgtaagcaacttagggggagagtaaatgattttggggaaagaggaatgagccctcggaagaataggtgatagcctgagacaaagtctgtctgggagtggggtcaacttccagtctcctctccggtgataggagtttaatcttacctggttaatgagattctcagggagaggattctagaatattgcattccttttggagtatctatcaaaggaggctctttgtggtgacatttcctgaactctttcagttttatctgcttgtgtaaaataaaggtgcatagcttcataataaggatggaaaccttgtaatgttaacggagtgtgaattgtaacaacatttctggggtgcgtgtgtgtacgcttaggaagcactcagtaatctctcatggaggtgatcgaagctgagtaagagtgttccagcaggcgaagtagaagaggtgactgctgtaaaccgaagctccatgagccggccagctattccagatgctgcttgggagtttcagccctttctcagttggatgagctccatatgccattgagatgtatacatacacacatatacacacacgcagcatacacacacacacacacatatacacacacatgcaactggttgctctatcacttaacttcaaacgaacaagctaaatctagtgcctggtagagaggggctataccccaaggacatattagctggcacaggcacttagaggtagcaagatttttctgaatcagagataggctgataggctacatctggtactaacttgtaaataagaaaatgtgttcatagatgcaaacagcatagaataaagtaagtcatattttataaagacagtggaacaataaaataaaataataatctgagaaatatgtgcacacagttttaaaaaacacgatggtctaacaatagtgattcatgtgactcagggattgtggagccatggcaagggctttatttattatctggataaataatgttcttcttttatcatgtaaaagcatgatcagaagaaatctaattagaaattagaacgttcaaattttaatgaagtcttgagcagcttggatccttttcctacttaaaagtatttttaaaatgaaagaaaggaaaattcagaaatgactttattgtgattagcttttaacctgtatttctgaaatatgctatagtctgtgaaatgtattatgtaagtgaatcaagataaatagtctttttcctttaataaaggggagagggccaaattgcataggagccttgaaacatgaattatgccaactggtcctttgggaaatatctctcaattagaaagcttaattcaaactgatccccttgggaaacagtgagtctcattgcttaatatgcataatgggatttttatattgtacagaagctgttgtcaaagaggatagagacatgctgcagagcttttaaagctgagatgcctggcaggggatgatgaccatgctggctggagaaaaaaaaaatcatctctgtgagcccatgtttctttcttctttctttgaagcttagttgaatatttgaaacctatatgttttaaattcttctcaaggaatttagccctaattttacagagttatattttttacaaagaaatgtagaaactgatgaagataaaggaacaagctctgctctgtaaggctgaaaagttactttattgatggaaaatcccagaagttttaggatcttgccttatcaattgcttttacaattgactcagagaatgattcctcaagtcttgggtgggtgatagctgaagatagaaaaatttgtaaagtatactatcactaaggaaaaaaatttcatctagataaaagtattttttctagataaaaataccagataaaaatactagataaatattttttctagataaaattatatataaagtagtacatatatataaaaaagcttttatctagataactttcaatggcaaaactgcaattacttttgcaccaatcatatatatatatatatatatgtatatacacacacacacctttctactgtaactactggctcaaggacatgaattctgtgcatttctgtatctccaaagtcaaatctattttgaccagaacagaagttgaagcaaagtgcaaatgcaatagaaatgtcactatgatttttgcacattgtaacttttaaagaaacagtttcacaacttctcccttcagaacactaaagggtgtctttgagcagtaagagctgagctaaggagtgcaaaggcactgagcactagaatgccccataacagagggtttctgattatgcacatcagctcttcttttctcaaagcaaactctgacaagtcacccactttggctctatgtcttggcggtaaacatgtgatcatgctttgccattgtcaagggctcctgtgcacctgccgctttccaagctctgacctatgaataataaatgtattgcttaagcaaatatttcttgcaatatgcaaggcctatgacatctctttgaatcactgttgaaaccaggaaatgaagctgagaccctgattcatcctgtctctcaccatcccattattaacaatgtcataaagcaacagcaaatctggttcataccttttgatacattctcatgatgtattttccaaggaaaccaggtttgtgagtttgtgttttagacgcatatgagtgtttatgaggcttctagttactccattttttttggtaagtggataaataataaatgaaaacaagtgttttgtaaccatactgactcaattccaatccagactcttacatttgccaactatgtgacagaaggaaagctgcttaacatctcagagcctcagtttgctcttctaaaaaattaggcttatagtatctgtattagtccattatcatgctgctatgaagaaataaccaagactgagtaatttataaaaaagagatttaattgacttatagtttagcatggctcaggaggcctcaggaaacttacaattatggtggaaggggcagcaaacacatccttcttcacatggtggcaggaaggagaagtaccaagcaaagggggaaatgtcccttataaaaccatcagatcttgtgagaactcactcactaacatgataacagcatagggtaaccacccccatgattcaattatctcccactgggcccctcccacaatacaaggtaattatgggaactaaaattcgagatgagatttgagtggggacacagccaaaccatgtcattcagccctttgcccctcccaaatctcatgttctcacatttcaaaacatgatcatgcctttccaacagtcccccaaagtcttagctcattctggcattaacccaaaagtccaagtccaaagtcttatctgaaacaaggcaagtcccttccaactatgagcctgtgaaatcaaaagcaagttagttgtttcctaggtacaattgggggtgtagacattgggtaaatataccaaatgaaagaaattggccaaaacaaaggggccacaggccccaagcaagtccaaactccaataaggcagtcattaaacctaaaagttccaaaatgatcccctttgactccttgttgcacatctaggtcatgctgatgtaaaaggtgggctctcacagccttggataacttgcccctctggctttgcatggtacagtccccctcccagctgctttcatggctggtgttgaatgcctgtgccttttccaggcacatggtgcaagctgttggtggatctatcatcctggggtctggaggatggtggcccccttctcacctttactagggagtgctacagtggggactctgtgtgggggctccaaccctgtatttcccttccacactgccctagcagagattctccatgaggggtccacccctagaatagacttctgcctggatatccagacattttcatacatcctctgaaatctaggtgaaggttcccaaaccttcattcttgacatctgtgcacctacagcctcaacaacctgtgtaagccaccaaggcttggggcttgcaccctctgaagccatgacgtgagctgcacttgggccccttttagccacagctgaaactgaagcagctgggacagagggcactatgtcctgaggctgtacagagcgggagaccacaaaaccatttctccctcctaggcctccaggcctatgatgggaggggctactgtgaaggtctctggcatgccctggaggcattttccccattgtcttggtgattaacattcagctcctcattactgattcaaatttctgcagtggacttgaatttctctccagaaaatgagtttttcttttccattgcattgtcaggctacaaatttttcaaacttttatgctctgcttcctcttgagtgctttgccacttagaaattttttctaccagatacccaaaacaatctctctcaagttcaaagttccatagatctctagggcaggagcaaaatgctgtctctttgctagagtatagcaaggatcacctttgttccagttctcaagaagttccgcatctccacttgtgaccaagtcagcctggacttcattgcccacattactatcagcattttggtcaaagccatgcaacaagtctctaggaagttccaaattttcccacatcctcctgtctctgagccctctaagtctctaggaagtttctaactttcctacattttcctgttgttttctaagccctccacactgttccattctctgcctgttatccagtcccaaagttgcttccacatttttggatatctttatagcagcaccccactgtgccagtacaagtttactgcattaattcattctcatgctgccatgaagaaatacctgagatgggtaatttataatgaaaagaggtttaattgactcacagtgcagcatggttggggaggcctcaggaaacttacaatcatggtggaaggggaagcaaacatgtccttcttcacatggaggcagaaaggagaagtgccaagcaaagggggaagagtcccttataaaaccatcagatctcatgagaacccattcactatcatgagaacagcttaggggtaaccacccccatgattcaattatctcccacctggtccctcccaccacacatagggattatgggaactacaattcatgatgagatatgggtggggacatagccaaaccatatcaacatctatcttgtaaagtaatgtattgtaaggattataataagataatactacatttaaagaacttaacattgtgcttgacatttatagagtaccagtttatatttttagaaatatttttagtgcctaagctactcttaggtagaaaggggtgtgttgggaagcatttgtaatttttctacttcactatagaagtagaatacgacattctagatggtccaacatacattgatgagaaggctactctgtgatgtgactatggccctaactctctaagtctagttcttggtagggtcagcattagggggaggcaagcgatgtgagctacatgcaagtgcagtgttggatcctgacttcactcacaattgagatattttgtttcccacacatttttgcattaatttgatttaaatattacattaaaatattacttatcttggttactaaatattttggcacaagtttaaattgtacatccaaggtaaatgcctccttgcctcatcctagtcccagccctggcctcctgtctctcctcctagtacatttagaatggtgtaagcccctttccaccttgagctgccttgcgtcagcagattatgatagtcctaggggaaactgctaactcatcagactgaccaccggcagtcactagtgaatccccatgtgctatgaagttgagggcaattgtagctcaaattatggtgcatagtgtgagccagtgtaactcacacacattcctgaacaaccctgaattatgtagcaatgggaagggacttcaacccaatcctatagggcatttatgagagataggttggttagtgatcttcagttccccagatcatttaagagttcatccaatatcatgctacaattcactactgcttatcctatggggagctggactctgaattctaatgaaaataatgaactatcaactaaattccattctgaaagattaggtattggaagaatattgacacaatgcttacaaaatgctttcaatcatttagcgttatcataactctgattgccctcatttagtgttatcatccccatttagtaagttaaaaaaattgaggaacaaagagattgattgatttataaagaatctcaagggaaattagaatcaaagctataaaaaagtatttacagctagaggtaattttacagctgggttttggaatcctttccccagcccttgcaatgacattgcctgaggtgctctctgatttgcatcttagaaagaataaaacttatcgcagtgcattcaggcggcactacccagtcctgcctgggtaggcagactactgggtaggtagatatccacctactcttggtgaagccaaagatgttcatactggtcaggttacagggtgacctactgtcctggtttcagcaccaaatgtcctgcatccctggaaagccacccagtcccaggtcagtaaccctcattgctaaccagaactgtcctccacattgaaaatacacattgtatttcttttcttgttgcttttcctggttaatatcttttttgggtgattcacacaaattacacttttttagttttattatagcatttgatattaagatccatcattacccttagttaatcctttggacttaagagacacaaccttagatataccaaagacaatcatgggaagagtgtgtaaagagcaaactgtaccccacttgtctgaaaaaaaaaccacaaaatataatagagcaaaaatttaaagatactctaaacatatattatggaattataactatagaataacctgcttaaaatacagattagatcatgttaatattctaggaaaatctctgagctatttccccactgcttctcgcccattgaaacatacactcatttattcatccagttcataaacattaattgatcacctcatatatgctatgcagtatacagttgctgagactataaagacaagacagttcaggcttatagctcagcaagggagactaatgtaaacaaattagtgcaataaaaattaagaggtgctacaccaaagactgtacagctgaagcaaaaaaaaacaaatggcagaggaaaagttcagctgtatttccagaaatatctgtcccaaattagtcaatgtgttccagatttcaaagatcttttctagtgttttgcctagaatgtactttctccatttgtgccgtctcaaaatttcacacatccttcatagccaagcttaaagagtttaggaagtgtatcttaacccccaatcaagatttactattcaatttgtctaaaattccacaattagagtttattttattatggcatatttattaatgtatttatggtccgttacccatttcaaaaaacaaagattgtttccacatgccatgcctcaagataaattccaaatgcattacagcactaaatatttttaaatctgtggaaaataataatattaggcaatatttctctgatcttagagcagagaataattttataggcattacaagaatgaaaaaaatacagaaaaataaaatatcaattacaactatggttgtatttaacaaaaatccaaatcaaattagtttaaactaaatagagaatgtattatatggatattaagaagcaaggacaaggatgtggctggaccctagaaataacaagaaggagagacctgaatcccattaagaattttttttttagatctctgctgctctctgcatctccttcactcttatcactggatatagctccctctatttctctaatcaatatgatgaaaggcagtgtgccgacagctgctgagctttaagtctgatggcttgggtacctgaagagagacagacgaatttactgctggtcctcatacaaaagtccagcaagagaaacattagcacatgttgaaacactcagctgtcaacatagcatcacaaggcaactcttatctcaatgtgaacaatggtatagaagcatgagtgggaagaaaaaaaaaaagtttccaaaaagtggtggagtaaatctcttcactatgagaagatagattgaattacataaaactataaaagtgtcatgatcagaaaaagaggtcaaaagaagttacaagacattacaaactagaaaaagtatctgcaactgtaattggaagatagtttctttccttaatgtataagtgcaaaagaagataaatataaatattcaaaatgggcaaggcaaagacttcagaactaacaaagaagcaatccaacgaaatacaataaaatcattgtggaaaaacgttcagctacattaataatcaatgtaatatgaatttaaatagccatcaattgcaaagtttattcctcagaagttgattttttttatttacaatacttggaaatttagagaaatgagtactttcatacactcgtggtaggcatgtaagttgatgcaatatttctagaagacaattaggtgatacgcatcaagatccttaaaaaggaacatattcttcataatatgttataattttatataaaagaactaaggaaataaagagatgtaccaataccattttattcacaagaatttattcattgaaacgttatttttatagcaaaaaattggaaatgaatataatgtctggcaatagagttacctaaataaacttttgtgtttttaggtggaatattgtacatcactaaaattatatttgagtaaatattaaataacatggaaaatgccattaagaaaaaaacacaaaatacaacattttatatgcagtatgattccaggacctatatatatgtgtgtgtgtgtgtgtgtgtgtgtgtgtgtgtgtgtgtgtatgtatgtatacatatacttatatacgtatacacacacacatatttataaatacacatagcaaaaaaggattggaagaaaatacacccaaatcttgatatcagtaactctctaggtactagaattgtagatgatttttttctccttttttctttattttcaaaaaagaaaaatttcacaagttttctttttattttcagtaacatacttgagctactttgtttttcattagaaaaaaattacaaaatctttaaacttttgaagtttaaaaatacgtctaacttttgagtcaatgaggaaataatgtgtgcatttaaaaatatctgtaaaataaaaatgtaaatacccacaataaaatgtgtgaaataagccagagttacatagagcagtaaacctacaaacccaatgctttaacaaatttttttaaagtgtaaatacattggtacatttcaacagctaaaatgacagaaagtatagattgcatggaagcagagacccataaaagtcacattgatactattttctgctaatctctcaaaaagacaaacagattccttggtgtctattgtaagggaaggggttactgattcctcatactagatatttatcttgttattgtctggaaaaatacagtcatgtctatattctggaaaaatgcattcttaggcaattttgtcatgcaaacatcatagcttattacacatgtaggctatatggtatagcctactgctcctaggctgcaaacctgtgcagtatgctactgtgctgaatacttttagcaactgtaacacaatggtatttatatatccaaatatagaaaaggtacaataaaaatatggcattataatcctataggataaccttcatatatacagtctatcattgaccaaaataatcgttatatgatgtgtgactgtaatatgaaaatgaatatgcttgatgttctacctcatgttttaagaagttttgagttaaaaaaacactgaaataactatataatagcttaagcatttaattcaagtagttagaaatatatcaagaaatattaaatatgagtaaataaggagaaactcaaaacaagaatcaaaaccaaataagtgaattaaaaatcaaaataggaaggcgacaatccaagaatgggttactctttaaattttaaagcagataaaactgctggaaggaaagaagaaagggaaggagggtggttggtgggaggagggagagagggagggagggagagaaaaggaaggaaggaaggaaggaaggaaggaaggaaggaaggaaggaaggaaggagggagggagggagggagggacggacggagggagggaaaggcaaaagttgaaataagaaaaatataacaataatggtagcataacaatttaaattccaatgataattgttatataatatgatttaaataagtatatgaaaaataattaaaaatagtcattgaaatagataatagtctaaaataaataataattaaaattgtgtcattgaaataggtaacagtctaaaacaaattcttgacatctactcaaaaatatcaataactaaggaaaaatgtttttcattttatcgaagaactcttgacagaagcattcagagctacacagtcacactgattagtttttttaagctgaatggaatttctacacttttccaggacaggatagaaaactatcctttacattttattaagcttagataacctaatgacaaaattgacaaggccaatacacaaaataagaaaacttatatacaaatctaatttattaataagtgcaaaatgctacataaaatatcaacaaatcacattcagcaacatattgaaagaaaaactctcactgatcaaatacaacttatcccagaattgccaggatgagttaatataaagaatagtattcatatgaaataacttattagaagggcaaattgaactctgaaaaatatttaataaaattcaatgcatattgagatatgagtataaataatatttattttaatttgcatttattgtattatattaaattaataatatagcatttatttcaatctgccttccaaaccataaataatggtttaatagtacaggcttttctatttaaattaagaacaaaataagatgacccattctcattttcttactctgaaaattctaaccaatgcaataagcaaaacagaaataatgaatatttgaagagtattacattatgagaaaactcaaaataataaagaggaaattaaagtatttcataatgtgagaaggtgagccaatgtaaatagacacacacataaaatcaagttaataacaaaaaaaattataaaagatcaaactcaactgtgaaaaaaacctgcaaaatacctaggaaaaaatattgtatgatttgtttttgaaaactataaaataaagctaataaatataaatatcctgatataaatataaatgtgcccatgttcttagatatgaagatggaatttaaaaaaatatttccccatatatttataagtttaatgatattctcaacaaaattccaatgaataagcaaatcttttcaagattacctgaggtcaggagttcgagaccagcctggccaacatggtgaaaccccatctctactaaaaacacaaaaattagccgggcatggtggcgggcacctgtaatcccagctacttgggatgctgagacaggagaattgcttgagcccgggagacggaggtttcagtgagttgagattgcaccacggcactccaatctgggcaacagagctagactctgtctcaaaaaaaaaaaaaaaaaaaagaagaagagtaaatggatcctatagaaagtgtcatttatttaccagcaagttttagaaccagtattaacacaatgtgatgctactatacagatggatcaatggaacagaagagtccagaaattaaattatatgacaattattatgtcacaaaggtggtataacagatcagtaagaaattatagacatatatgtgtgtaggtgtatgcatatatataaaattataaacagcatgtggtatacagttatatattgcatatataattgtactagcttttcttctaataccacacgtcaagatatttcaaatggattaaatgaactaaattatgaaaacacaaaaatcttgttaaaaacccaatagcaattatatttatcaattatgtgggcagaggagaaattttgaattccaacagtcccacataggctagattctgttactgtaacaaataattcttccaaaaaaaataaaaattaaaaaattttaaaaagaggattaaaattgaggcttaaaagatggatttttgctgaaatggctgtagtgagtctgttgcaggctctgctccaacgtcccaggctgaaagagcagtcactgggcagagggaaacagaagagaggtgtgggaattctctcactagcaatgaagtcctctgtccaggaagtgacaccagagacttctgctcacaagtcatggaacagagccagtcacacagccccaaccaaccccatgttaggtacaatccacgcatgtattccgaagggaaagaaccggaaatagtaacaactactatgaatgcttcatgtttcaggaaaaaattaatgtatttgtaattataaatgtaaacatttctctgcccaaaaatctaatcaacattaaagctaaataataaactgagaaaacatttgcaataaaaaatactgaccattttatatcattatgagtaagaaagtaatgatatctcaggatataaaaaaggcaaaagacaggaggaacaagtgatttaaaattacagaggtataaataggtagcaaataagttttaaaattaaactactcagtaatcaaacggatgcaacttgaagcaataataaatattttctataatacattgacctaaaatcatacagattctgagggaggttgcaattcagttgggcatttctacatggtggatggatgcacatataaattgctcagccttcacttctgcaggtccctgtagcattacataataaaagcctaaactgtttataccttatgtttcgtaattacaagacattttactctctccaagtaaaaacacgaaaagtgcttaatgtcaatcataatagaatgtataacagtgaagaactgacaacaacttacccaaaaaagtggggtggattaagaaaactgtgacatatccagacaatgaaatattaaatagccattgaaaaggtggattatgttcaggaagaggtacctatgtgaaaatgacaggagaaaataggatagagtcaggccaggcgcggtggtttacgcctgtaatcccagcactttgggaggccgaggcagctcaggagctaagagaccagcctggccaacatggtgaaaccctgtctctactaaaaatacaaaattagctgggtgtggtggcgaacgcctgtaggcccaactactcgggaggctgaggcaggagaatcactggaacccaggaggcagaggttgcagtgagctgaggtagtgccattgcactccagcctttgcaatatgagtgaaacactgtctcaaaagaaagaaagaaggaaacaaacaaagagaaagagagagggagggagggagggagggagggagggagggagggagggaggaagggaaagaaagaaagaaagccggatagagtcatcttaactatttcagagaaaattcaggtatgtgtaggaaaagaatagaaggaaattcaccaaactgttaatagtgattgtttcacagtgttatggttgtgtcttgttttttcccctttctttcaatgtattacccaatttatagttgtatgtgtgcttttaaaataaaattatttagaataaaaaatgtctccacacacatcagacacaccagaaagtaaaatgcctggaatagcccgggcgcggtggctcacgcctgtaatcccagcacttcgggaggccgaggagggcggatcacgaggtcaggagatcaggaccatcctgcctaacatggtgaaaccctgtctctactaaaaatacaaaacattagcagggcgcggtggcgggcacctgtagtccaagctactttggaggccgaggcaggagaatggcgtgaacccgggaggcggagcttgcagtgagctgagatctcaccactgcactccagcctgggcaacagagcgagactccgcctcaaaaaaaaaaatgccttgaatatccattgtgggagttcacagagtgcagcacatttaaaaatacgtgcattgagcagtcaagtggactttcagatgttactactttaaaaataaatggtgtgtatttccaaaagttcttatttgaggcattcctaacacagatccctctgtgatatgatgtttaactgtcctttattttcaatcaaccagaagctttcttggatatctgtattagtcaagcttatctctcttcatctgggacctaactacttcacaaagaaattttctctgagaaataactttcatcgaactcattcattattcatgtcaatgcagactctcagttcattttaaagtgttggatcttagaatgaaactgagagcaatctaggaaggtattagtaacagaactaccttctgtattctggggtaacttatgaacaatagtaaatacagagtttcaatcagacactttaaaggaaaagtgtcgtggtaaatgtgtaaatgcttgcatctgagatgctgtcagctttttagatgttctacagcactgttgttgcctagtgtgtatcattttgtacaattatttaaatcagtaaatgaaaaagttattaaaaggatggattttttaaattttcaaatgctgaaacagaaatatacagagatgttttaaaaaccaaatggaaaatattaaggaagaaaaagaagaggccacgcatggtggctcatgcctgtaatcccagcgctttgggaggccgaggcggacagatcatctgaggtcaggagtttgagaccagcctggccaacatggcaaaaccccatctccactaaaaatacaaaaactagccgggtgtggtggcacacgcctgtagtaccagctactcaggaggctgaggcaggagaatcgcttgaacccgggagccagaggttgcagcgagccgagactgcatcactgcaatgcagcctgggtgacagagcaaaactccatctcacaaaaaaaaaaaaaaaagaaaagaaaagaaagaaaaaaatatagcaaatgcattttaaatatttacattaaatgtcatggacatgcaccttacctgcaacatatctgtgagatacgattgattaaaagatgctgtttttcatagacatacagaccatcttaatgcttaggtatttttgtaaatgaaaagatgaggtaagatttgatagtataaatctgatatgaattagatacaaagtagtgtcataattagaggttttatttctgatcaagaacctgatgtctaacttttcattaaaattagcacaagaacaatatttaagactgcaaattattttagtcagtcccaaagagagtagatctacagatcaaacttttcaaaaagtgtttcttaagacaacaattccactgcatgtcacggttacaaggaaaactgtcctatcatcaaatgaatttgggggatactgagttaaacactcaaattgttttctttgctgcaggacttctgagagacaaatgtcattgtgtagtgtgaatttttaagaaggatgaaatgaagcagtgcctcccaagcatatttgaccactaaactctctatgtataagatctcatgggcaacatatacgcacacacatcggtatatactgctctgtgggagctgtgagcctccatttattttggcttcaaacatcagttctaatctttaacagcaatatcttcttctcagcaagaaatttcaggttgagaaacaacagaaatacagaagaagaaaactagaaaattgggatgcaacacataatatagcttccctggaaccacaggttgtgaacttgtcttattccattcatttaattaataaggagataaatagaatcatgagctcttcagcatgaatatgagtcatttaaatgagatgttaaaagctaaaactataactgctgtcaagagacattaaagtgatcacagagtttcataagaataaaagtttggcatgaatttttggcaatattcctggttcttgcctgaaatctgctgttgaacaggagatgagccataccttcatgatgttaaggggctggcagcctgatgaaaagtatgctttgaaagtgcttggggacaatgggccgtgattgttgggagagagtgagaaatcactgctaaaaaggcagtaatggaaaaagtcaggcagtctcactacagacctcaataaccaccctccatctttcctacgtatctcaaaggcctctctcttggcagaacaaactactttgtgaggcatagtgttaaggcacaagaaggagagtaagttcaactgaaggaccatttactggggacaacatactatgaccaaatcattgcatttagctctgaaggagaaggcacatttcaataaacatctgtcctgatcttcaaggaacaggcagagcaggatgtaggcttattttacaccaaaataaattccttgaaatatgtagtagattttatggttaccaaaagaaagggagagttcacctctggctggaggaatcaggaaagattccacataggaggagacaaaaagcaggctttttgctttattgatagaataattgactactatacctactttctttttctgtactctacaccagtaatgcagtatatcccaaaagactggaagctctgctgagggcaggaaccaagcatctttcatctttgtattttccactcctcctagcatagtcttagatattaatagatgtctaataatgttttatgagttaaactgagtgttgaataacactggaataagagtaactttggctttgggtaatttatagtgcaactcaaatttatgaaggaaaattactaatagtatttactaaactgcccataatccacggcctttctcttactagctaccctctgaagtacatccataattccttgctccatattttcttatccctcaaaggccattcctagtgaattaatgcaaatctctttaaggcatcaaagagtgagtctggatgtggttattgtctcaacggtgacatcaaaccccattctccccctctaaaggatactaatacctgaagacacttatagcagactgaattagagccagtttccagttgaagctgtccttgtccttaaccacagctctgttcttggctgggactttctgaaaggtaaaaatccaatctcttctgtccattcactttccatcaggtcaagaaacacctgcttcccatccaaatccatctagcatgggatctttaccaagaatgttttgagctccaaagataaaacaaaaatacgaaagctgagtgaggaagacagcatttatctaagggaatcttagaatttaaatctgtagccttggaattaaaggtgcagtaaatataggcctatagtaaattgcttatgatgtaatcaactagaattatggatgtggcaatagagaggctatagaatattgtatatttaaggagcagctatcagcaaaggaatagatcaaattgccatcttgttttctgttgatagcttctggaatggttattattccacaggaatgcaaaacaggagtcaacactacaaacgctttccatgtcttgattgtcagctaatggttttacctttcttcctggatgacctcacagattgtcacaacaggcacacagaagttagttaagggagcaagcgagctttgttagaatacatatagtatcttggccctgtcacattcagaataggaaaatatcataaacataaaaactcaatgtgttgtacagtacaactatgtgccatatttgcaaaatcatgctagagagttaaaaattgctatttgaagaactgaataaaataacatttcacaaacaggaaagaaatacagtaattaaaagtgaccaatatgaaaactttctgaagacaattgagatgctgcattagtttcctgtgtctatcatcacaaattaccaccaacagtggcttaaaacgacagaagtttactctctcacagatccccagaggccagaagtctgaaatctgggtattggcagggtcttattttctctgaaggctctgggagaaattcatttatttgcttcctccagcttctggtggcttcagtcattccttggcttctggctgcatcactccagtctctgtctgtttttgtttgttttcttgtttgttttttgagatggagtctcattctgtcacccaggctggagtgcagtggtgcgatctcggctcactgcaacctccgcctctcaagttcaagcgattctcctgcctcagcttcctgagtggctgggattacaggtgcgtgccaccatgcttggctaatttttgtattttaatagagatgggattttgccatgttgaccagtctggtctcaaactcctgacctcaagtgacccatctgcctctttaaatctacacttactcctgggtgatgccattcagtctcatggctttaaatgccacctttatggtggtgactcccaaatttctatctctaggcccaacctctctgccataagatccagattgatatatctaacttcacagctggcctctccacttggacttttttttaaaaaaaacttccattttaagttcaggggtacatgcacagttttgtacataggtaaatatgtgtcatggtgggttgctgtgcagataatttcatcacccaagtattaagcctagtacccattagttatttttcttgatcctctccctcctcccaccctttgtcctccaataggccccaatgtgtgttgttcccctctatgtgtccatgtgttcccatcatttggctcccacttatacatgagaacacgtggtctttggttttctgttcctgcatcagtttgctaaggatgatggcttcacttggacttctaataggcaccacaaaagaatcatgtcccaagtcaagtacctcctgcatcgttcctcgtcttggtcaatggcaatttcaagccaaaaacctgatgttatcctcaactcccttcctcttacttatgcatcatcagcaaatcctgccgaagtccttcagattttatctagaattcaaccactttttgtcacatcccaattccactaatttgtacaaagccatcatcatctctcacctggattactgaaatagactcttacggcaagagtgttattgcaacatctccaagggcagatctccctgtgctttgttcttgcccttctcctcccttcagtctattcttaatacaaaagtcagcttgattctcttgaaatatgtcatatcatttcactcctctgctcaaagatggccagtggtttcccatctcacccagaacaaaaccacagccctgtgatggcccttaaggccctctgtgatctgctccaatccacccatcacttctctgagctcgtcttctaccagtccaagcccagctcacccgacttcagcctcactcttcctcaaaaatagcatcaggctgctcccaccttagacattatatttcccctggctgtaacgctcttctcccagtatcttcagagtggttttctcattatctttaggcttttgctcaaaagtgccctcccagtaagcacttttctcacctctcactctgacatgtcaatgcctgtcttcctgttcatgaccaattccccttctaaaataaaagctccaaaagtcagatgcgtatctgttgctcactggcacatcccagtgcctcacacagtatctgtctaggcatcttacaaataaatgaggaaataaatgaacaaatcattggatgagcgagttattcagtagaatcatggacataatatatataaccatgaattgaagtagaacaacaacaacaactaaatataggtggattttaattctattgcatttctgaaatggttatcgttggaatatatttaccattacaaggtaagttgagtcagaacaatatattcctttgagaggaataagatagaaaaccattattttcctgtgttttttttgtttgttttttccatcattaaatgagatggattctctgccacaatgaaacattgtctgaaattccttttgggaagaagagggtaaatttaatactttcactaatctctcagcacaggcttaatctagagacagatggaatcagtaggcagcagtggaattgcctccctttaaggttcttacccacaacaatggcttgatttccaccatgttacactgagttgattcggatagctccctgttccatggaaacagtgattgaaaagcaggttaggaagtatccttggaacctaaaaaaaaagtcaatcagtgagacctagagccaggcatggtttttttcatattaagattgctgaattccacccctttgacattctgattctctccatataatgtgggattaagggaaagtttggaagccattgccgtgggtttaccttgggtgtcttcacgaatagcacattattgaccttagccttctctaagtgttaccctttgcctacaatgattatgttgttgacccagcagttgtagagttgtgattcagaacaattctcctgtaagtctagatggaattatgtggcacaacccaacatccttcatggcaacccttcattgcacccatcatccccccttaaaggccacctgccaggtgtacaggatgttgccagctgtggcttccatctgtgtttaggtagtcacaaaacacaactgcctacgtcctcgctgcacttcactggttcaagagtctacccaaaacagacagaaatgctcctgtggtgacggaactctgctgtctaaaccaagatttcaagtgaattcctcttggcttatcttaaattactgcgctgtaaagtcagaatcttgttagaagagaatattacttgaatatatgtgagttcctttaaaattattttcaatttcaaagcccttgggagaaaaaaaagaagatgttggctgggcacggtggctcacgcctgtaatcccaacactttgggaggccaaggtgggcagattacctgaggtcaggagttcaagaccagcctgaccaacatgccgaaaccctctctgtactaaaaatacaaaaattagctgggtgtggtggtgcttgcctgtaatcccagctactagggaggctgaggcaggagaatttcttgaacccgggagctggaggttgcagtgagccgagattgcgccaatgcactccagcctgggtgacagtgcgagactccatctcaaaaaaaaaaaaaagatgctgataaatgtactagtctatgctaggtttgctgtaaaaacaaacacaaaaaaacaaacaaacaaaaaagaccatagactgggtggcttaaacaacagacacttaatttctctcagttctggaggctggaagtccaagatggaggtgtcggcaggtttggtttctccagaggcctctctccatggcttgcagatggcctccttcttgcttggccctcacatggcctttcctctgtgtgcacaagtccctggtatatctgtgtgtccagattttcccttcttataaggcccagtcagagtggtttaaggcctaccctagccgcctcattgcaacctagtcactgttttaaagacactatttctaaatacagtcacattttgaggatccagaggtgaggcctgcaacatataaatttgagggaggatgcaattcagtccataacagtgacttaccaagaaagcaagtcgcttctgagtttcaaagctactccagaatgtaggcacaggcattattgtctcataccctttgtttagtgaccatatgtggcaccttgtctcaggtgagggaacacagagtatgaaggacagaccagtttagcatcagcattatttgtaccaacatctatgcttcccagaaaagtacagtgggagcaatcaggacaaagtcctcataggtaaatcctaaatacgaacgtgtattaataaaaaaagcattaatttttcagaattcttatctattctggtgtttacaagcagtatgattttacccttatcattttaaatggcacaaatattcacataagacagactcattactcaaagaaaaagcccaacttctttcactttccaaccctttgcttcgacaatggtgggtgaggtggagaagaggctggggaggtggatattaagcatgcaccttgaccgttgatcaagcttcctaatgatgatcagacaaaggattactgcccaaccatttccagtctataaagactggcaggtgatctgtactgactcaaactgatctacgacatagacatgataaaaaaatagtttaacaatacttctcatgcttcaggtacacacgagcaatgaaagagaacatggacaacccaggcctgccgattttgaggtttctcaccctcctgtgttccatctgtcatgcactacttctctcaagaattatagcagaatgaaaaagcttgttcttcatcctgagctctcagtcctgccttctcccttcacccactgccctggcttgggaaatttcaaaaatacaaggggaggggacaactttgcctctcttccttgagcctaagctagatttttatttcaatttcctaacccttccatggtccacatcattgttaggagtagaagtcagctaagctcaaatgagagacagagagaggaagaggaacagagggatgaaaaaggtagggatttctcatctcaaaccaatgggcctccaaatgaatgaggccagaggttcacaacatgaagacccctaaagccttcagacgtctcattgacagctcacactcacaattattatacaaaagaagtaaaaagggaggaagggaggaatggaggaagggagggagacagagagagagaaagaaagggagaaggaaagaaagaaggaaagaaagaaagagaaagaaagaaagagacagagagaaagaaagaaaggaagaaagaaaaaagaaagaaagaaagaaagagagagagagagaaagaaagaaagaaaagagaaaggaaaggaaaagaaaggaaaaaaagagagggaaagagagaacaagaaggagagaaggaaagaccgaaggaggaaattatgcaagggccccaacgtgtgtgcccctttattctgcttattaaagactctacatctcgttttgttgtatctgaagctatggggaggagaaggagggaggaagtggctgatcgttaaacagtctgcccacatgtgaggtaatggtctggctcctattaataactttctcctgtttctgtcagatctcacttttttggtacatctccagctttctatttacctcataccacagtagatttttcgcatttatccgcaaccctctcttgaagaaagagagtgtgatggggtcttgagctaatgacaccattcataatgcctgtttgatgaaaaaatgaaaaaaaaattgctctgaaagtgacaaaacagttcacctacacactacccaagcacataatgaaaacacttgtaattcccttaaacccaggttcatttggctttatgtgatagacaactacatagcaaaagaataattttgaggcaagtagtcagttcaccagttggtgccaactcctctttttatttccattatccaggtacgataataaaaaaaacttatttctagggaatttttgagttttcagggcactttgattacattttctcatttgctttatagagcaattctccaagggaagcaagacaacactattagctcacatgtatgagacaaagaacaacagaaataacttgatgaaatgaaaacatttacattttttggacattcagacaactgagtcagtcccagacaagactgtgattttgaataagcaggatgtaatgtgtaatcttcttgttcactttttcatttataaaaatggaaaaaaaccctcctgccttgaatgttataaagtgtaattaaacatatgtaaaagagctatttcataataattttctttctgatacttaaaaatccttctcaaagaggaagtaggtagatcaggtttcaaaattcagaatttctgtttcctattcaggtatttgtttcctccaagcagcctaccctgcacagattaatggtgctcacatccatgccagtgattgacttttcccctaaatacctgcagcctgaacgtcctaaagatgccttggtctccccaaggatgctgattctgagtaagacacagtctctctacatgcgggctctccctgtggggctgaggagacagacaagtaaacaagtcattgttcataatcactgtggaagccctatcgccaggcagccctctgtatgggtcacctagatggtggcagtaagacggacttatgtccaccttctggtgaccaagtgtcttttgcatcatcttgtcacctcactgttgagcatccaccaacagttctgagagaaactgaaaatcaactccagagtctctccctaccattgtctgacaaaagtaaaacacaaaattcacttgaacagcaacatttttccttacgttcatttcaaataaaggtcttaaatggctccttaggtaaaggttaacattaccaaataactctgtcatgtaattttccttcttttaatttcagtttttgtgggtacatagtaggtgtattgtcatacaattttcaactatgatttctcagaaaccagggaaattatctatacctgaatgtcccatattatcagtctacaaaagcccgaaatatttccaaaaggagccaaaataattcactataaaccatcttagctttcacaacccaacactgtagttagttatttaataaagtcatttcagcaggaacattacagatgtgtatttgtttattgcatttttttcaaagtaggatcagggtaatttctttgaattacagtctgtccattggagttccctttctaacaaaaaatgcacataaatgacgcgcatgatgcgtatttgtgattttcgtttcagactttttctatattcttttttttccccctttgaatggagagagaactgagagcacttgtaaatcaacctagcatagacaagttaggtaaaacctacaactgacttttggtaagggatcactcaatcctgagagtagataaaaaatagcagcctgggccaggcacggtggctcatgcctgtaatcccatcactttgggaggctgaggcaggcagatcacgaagtcaggagtttgagaccagcctggccaatatggtgaatctccatatctactaaaaatacaaaaattagccagtcatggtggtgcatgcctgtaatcccagctactcaggtagctgaggcaggagaattgcttgaacctgggaggcggaggttgcaatgagccaagattgcaccactgccctccagcctgggcaacagagcaagactccatctcaaaatatatatatatagatagatagatagatagatagatagatagatagatagatattgatatagatatagatatgtcagcctgcaagttacaagtgtttagcattccatgagcatcagttaacatgtactttcaaaagaaatgaggagtattggtcaatcaaggagtaacttaaatggagatgggttaagaaagcttccactgtaggccctgtgtctattaataatcctaggacgtctctcagaaaacatctaagaactgtacagttaacaacacttacattgtttctgtcaaacatcaatgtctcaagcaaaatcagagctcattctctgatgaggctttaagcactaacattttgtactgttacttgcagtgagatcctcatgtttaagacaccagagcctacctagaacatgtgcacttgctcagtgaagggacatatttcttcagttacctgatgcaggtttgctttggactaaacagtttctaaaaacaaaaaggaaaagaaagaaagaaaaaaagaaaagaaagaaaaaaaaccagttctttgaatattctcatgcactttggaaagtactagaatatgatctcagaattctgagccatgaagcacaaaaaaggacatttttatcttgaaaaatctaacagtatgtatgtgtcattttgatcccatcaactctgcatgatccccttagagtctggaatgtaggcttctgaatagaaagatcttcattctaaagaagaatggtcctacaaggatacagctcaaattatgtttagatcgagcatggtgcaattcttgtccacatcacagaaaatcgtcctctgccatattatcagttacacttttataccactaaatgtttggaacacatttgccatctgagagatggtatacagtccaacactggatttaaaatcttaagcatacatatgcagttagtcctatttatctgcatgtggcacatgctgataaacttcacttttagcccgggatttaggatctgctctattactctatttatcatttggggtctcttatttgtatatgtacattcttctttttactggccgggtgtggtggctcatgcttgtaatcccagaactttgggaggtcgaggcgggtggatcacctgaggtcaggagttcgagaccagcctggccaacatggggaaaccccatctctactaataatataataattagccgggcatggtagtgcacacatgcagtcctagctactcgggaggctgaggcaggagaatcgcttgaacccagaggcggaggttgcagtgagctgagatcgtgccattgcactccagtctgggtgacagagcgagactccgtctcaaaaaaaaaaaaaaaaaaaaaaaaattacatgtgaaccatgtgactaacgcttctcatgcatctcttttgcttctgcaggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagaggtaactattttcccacttttaaaagcttctttgggtgatatgtctgctctccaagtcaccttctttttgctacctgccctcttttaaagcgggcatctttgtgcaaatgggtcgcgggaaatctgggtcttcgatgtcactgatcagtgtaatctgaactaacctaatggacgttgctgagcactgttttctgggcctttctgatgagcttacccttcagtgccctccactctatgattaactagctcagctgtgaatggaaaatgtcaagcttgatctgtttttccttcctgaagctgagataccaccatgaaatcgtgcggtgcagtcaaataaaacattatggaaggtcaatccactgagcatgtggaaatgcccaggacacacataactcacaccctgaattttaacaggttgtaaactactgagtttacctagcatcctctcaacttttttttactcttttccacaaaatcatagaaatatgaagattaaacctgtgagagcaatgtctacatccgatcctctttttcttctgaactgaagccaagtgcctagcctaaaaagtaatctaattcatatgttggctgcaaggtttctctcatggaaagattcattcggaattgtggggcttgcttagacatcttctagacaatattaggacaagtctttgaagtaagatcacatagttgagggttggcttctaacagggacactatctagtcactaaataaatgtgtttatgtggaaacaaaggctactcatcaccccagattgggggggttctttgcctcagagaggaatccttgcctactaaatacacacaaataaggaaacacaatgaacaccatgtttatgctgatttccaggttactaaatgctggttgtttccatgtagaattaatctagttagatcataggttgtgtccacctgatacagcctcctgcaagaattctagtgttctttgcaaacaaaatataaaacttattttcttaggagcacagataaaaaattaacaacatagcagggcgcagtggctcatgccggtaatcccagcactttgggtggccgaggcaggtggatcacgaggtcaggagatcgagaccattctgtctaacatggtgaaaccctgtctctactaaaaatacaaaaaaaagtagccgggcatggtggcaggtgcctgtggtcccagctaccacaggctgaggcaggagaatagtgtgaacccgggaagtagagcctgaagtaagccaagattgcaccactgcactccagcctgggtgacagagcgagactccgtctcaaaaacaaaacaaaaaacattaacaacataatatttttatatctatggcctgacttaagtataaagatattttctttttaaaaatgggtagactttgagatatcatatgggtcaaaattgtctatggacaaataataaaactatatacttatacagcattttaaagtttccaagctatcctcacataaattatctctataatgtagagatagatctatcacttttctttctctcatcgctctctcttacacacatacacctatgcaaacagacactaacactcctacacattgtggagcaaatactgtagaaagccaaccacatttagcaatggaactctagccacataaaaatcgaaagctttcctgtggtctgaagtacctggcttacttgtcagttaaacacccccagagcttcttaaaactggtaatttgctggcaaacagaattcaaaaggattgattttctgtcaaataatattagtaccgcagagctaactattaacaggaatctcaatccattgcttatgctggatagaacaacactatccagctccacatgctggagttcacacactcccatactctccttttatctggctaaataatgaaaacctaaccagaaaataagcttctgaagacaatgacagtttacacttccagcacataatggacaaaactgtacatcttcgtagttaatgcagtagttcactaccaaagagcagagtagcagaaagtttttcttgtaaacatttgctgttccttagatacctgcaatatggctgtcaaagttgtatcagttattctgtctgaattaagtcaggtaactacagagccatatcatttttcaaactatttttatttgtagaatgatattaatattcaatacaattttatgtattaatttagctaatttgatatttaattatctgatgaccgttctaaatttgcagaattaaaatataaatttgaaagtgtgtttaagctcttatttaattcctaccaacataagattaataggcactattttacatggttgtagagggcaaactgccccaacctttccggaagggaatttggttaatatgtttcaagtgacttcaaactatctataccccttaattataactggtaacttaacttctggaaatctactcttagaaagtagcacaagattcagagaaaaatataagagctaaggtaagtgctataatattatttataatagccaaaaattaggagcagcttaaatgttttgggggatgtttgtttgtttgctttttgaaacagagtctcgctctgtcaccccagctggagttctgtggtgctatctcagttcactgcaatctctgcctcccgggttcaagcaattctcgtgcctcagccacccaagtagttgggacgacaggtgcacaccaacacacctggctaatttttgtatttttattagagatggggtttcaccatgatggccaggcaggtctcgaactcctgacctcaagtgatctgcctgtctcagcctcccaaagtgctgggattacaggcatgagccaaatgtttaatattataggaatgcttaaataagggatgacacacctatgaaatggtctattctacagacactaaaaatatgctttaggagaatttgtaaggacttgaaaaaaagacatgctatagtgttaaagaaagtaatatgtcaaactgtatttatataatgattctaattttcccaaatattaatagatattattccaaaatgataggatgaatcccagagcctttttatccctaattttaaatattctaattctctcagtgagtgcttatattcttataatgagaaaaatacatttatgttacaactaaatttttcagtagatattgacttgatgtatttaggctacctgtcagctgaccctggggtagaaagaggcctgatgttgagctaaagctcctgtccagtggccatgactctcttcattgtctatgaaatgagtgggttggacaaaatgtcttctgagatccctttaagctatgctatttcattatttgaaaattaattagacagcagcactgcttatgaacattctttagcagtatttcatttacctggaacttctttctgagttttggaaagataggagctaaagcactttgtagttaccgagaggttctacattaattttataaccacattaatattttcaatgccaccctgctgcatgacagaacttaattcatacaacactcatttggcaaagggcttgttggtaactaggagtgctttcaggtaacaccataccaagcaagggatttagactccatctgattaaaggtaataaagtgagaccagcagggagttggccttgttggtatattgctaatcagttctaagtttacatctatcagtacattagcagctcaagaaagttggaagttggaccaaccgtatttcctcaatatgcagacagggattgtaaaagatttttcaatagttgcattaaaaagaggaatcatgaaagaaaaaattaaattcatagaactctctttttctctccccctttccctgccctccctccccatcctctccttgtccttgggcatcagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtatgggactcacacaagacctcacccgaccatgtctgctctgaacaaacagaacgaaagtatcaaatagtcattaaactcatcagatggagcataaaaatgctcttttatataaagctaactgaatattctgaagtaatttaataatgcatgtgtatataattcacatttctttttgtttgttgatcctttctaacgatccttttatcatcaaatatatgggaacttttttttaaaagaaatatcatcttatcagtatatgttataatccaatcacaatattaaacatgtattttcatttttccagctctaataagactatgaccacaattgaaaatgaccatggaatatgattccaacttgataagtagctatgtaaatgtttagaaaagtttctaacgtaagttaacaaagaggaattcatttagaggttgtaccaatagagtggattatgtcatgggaaagggactatgaatccccattgatgagtgcttaataaagcttgctccatgtgcttgttcagggtgcaggatggaaatatgcctgcttggagtccagtcctcatcagccactatctctgacccgcccccatttgaactttcttttactggcaccacccccctctgctttctgcttattgtccagaatttttcaaaaattcaggcccctttttatttaaagtcaggcagtgaccctccattgtccacataataaagttgaatttcttctaattcaaaactcttcatcatccagccattttcattttcattaactcaggcactagcttccctcactgcctgtactctcacatgagttatgatgaagaatctatcatttcttcaatatccccatgttctcctgactcctgttttctgaggctggcacctcactttggatgatcctttgcacgaccttcacggtggtgaactccctcattctccacgaccgcacgcaaatttccctcttccttaaagctctctgagaccaccagagggttcactagcactttggaagcaaaagcactgaatcccaagttatatttcaaatatctgtttacatgtctgtaagactggaaatttctaagcatcctaattttatcttatttatgtttataatctgctacctgtcgtaaacctgacatagaggaaacagtttagtaattccacatggatagaataataccattgattgtctgaattttttttctccaagagttgaaatgagttgctttccttgatctacacattttgtaataagattatgaaaattacaagtgaaagttagtaaagtgaaacagtgtcaaactttgcaatacggtttcgcttttcactgcccctttcgccaagcactagcagttactattcctcaaaggatgaatatgtgcctcctctttgatgttaaactctggttccattttatatagtcagataaaagtgacgagtgtggttggaaatatgcacttatgtattttcttgtgcctcatctcattttagaaagaattgaagattctaagtgagtgggtatatattttataagtattgtattcgaaacagtcccatcaagaagaataagctacaagcagccatatttttagaactttacctgcttgctgtgaaggaataaatcattatctaatcaaatccacacgcatactttaaagggctttgaaaaagaatatcatgttttaaacataagtgtggttagatcttgcatgttgcctacttttgctaaacatgaaattttgtgagctcataaaatcaagctatagctcattatgttgtgaactctgtagtataatcatctctcaccatttctacagcaaagctggaccatctaaaaggaaaacataccaatgaataatattgaaactcgtggatttaatttaagaaagagttcaactaaagacgtaggcattgtagatttcaaattgtatttagacaaaatataattagtaagtaaatgacagaaaacttgatattctaaccactctctgatgtcaggtgagccacacatatgtgacatccatttttcaaagcaaacaccaaactatcatttccatcatcttctacaagaaactgaaatgtccttttcatctttgtcaagttcacctgtgctcagtgactcaatagatacttgttgaaatttacaatccaaaatgatttcgtatgtcgcccattgagagatgattcaagttaaaatgatttttgcccacaaagacattaaaaatgtaaatgaataatcaattgagccattaaattggaacccagagaataaacaggccaactgagatcaataaaagcacaagccttgtgactgtgagtgggttttatactgcttgactcagggttcttgcctttagtaattatcacaccataaaaaggaggaaacttagtaaacctaaaggaaaagaaaggacttaggtgtgcttagcacccgcccctacaccagaattaagtacccattaaagagcactttattgggatttgtttaggagtttgttaaatagcctgaagccaacacagatgtcgcgggaccaaatggcccattactcccattgaagtcaatgggagcagtgtgcacgtctctaaggacaaaattcaattcgctaaatactagcaagcagaattctgtcctctagaagataaaatgtcgaaagactctggagaactcttaggaggagcaaagtttcgtctcgcctcgtctctcttctctctctttcctggatgtccttcccgttagtcacctacttgtcgctgattcccacatccagaggtgaccccaggcaatgagaaattgctgcccattgacctcccctcatgattcattagaccctggtggaaacctggctatcacttcacatacagcaaaaagagctgagaagctgagcctcaactgcagtgtgtggcatattcagcagtttctgccttctcaaagccaatctcagggaaatgcacccacagcgattcctggagagcagggatcagcaaactttttctgtgaagagccaagtgctgaggctttatggccatgggggtcttggtcaaaaccactccactctgacaaagtagcaagcaagcacacggacaatatgtaaacgaatggacccagtgtgttccaataaacctttatttgcaaaaatacatgctgggctaggtttggccttttggccctatttcacctctgctatagccttaaaagataagacaactgagctaaaaactaagattgtaattttgtacacatatgaagtgggttcagctcacatccaaaactccttcgttttggtttctgggttttcatgcccttctttcctcctcactggccctcctggcttcctcatcaatacgtgtcagtcctttgtctcattatctctgtgggatttgccaggtgatattctggttcattggataaacaaattttcaaagaagtgttgggggaacagatacctttcctcacccatcataacaatcacaactgacattcctataacaaaagacaggttaacaagagaaaatcatagcaaatttgtttaaccaaagttttacatgactcaggaggcttcaaaaatgaagaccaaagacctagggaaaactgtctatttctatgcttagattccatgaagaatgaacaacatgtggaaatgtgattggacaaaagggtagaatcagtggtaataggctgagggggaaagcccagcaaggcctgtgtgttcggattcttcttagcctctctgtgcagtgttccttcctcctgagcatgggtcagggcccctatgaaataagagtcttcaagggaaaagagaatctttctagattttatatcttgcttttggggagaggagttctagcttctatgctccacttagggaagtgaaattctactttctatgactcacgtcagtggattaagaggggtaggataccgggggtcaggagaaagtcagaaagaccttgtttctgagaactttccagtctttttcagttcaaagtagtcagcatgccaaggtgccatattttggggtgtcatgttctgagccccaacagtgttaatggctaataatgacttaaaatgctgtttcttactttaaactaatcatagcacattttaggtttggctctcttaaaagacaacaaaagcattgaatattgcatgccacagagagtgggatttcaaagtgttttcttatgcttggttaggcgattacctacgcagtcagcatagagagcaaataagcaagtgctaattcaaatttcagtggcaaaacattaaaaaaaaacaaaaaaaactcctattctgcttagcttttattttgtgaatgattaagaaaaacctactttatagttttgcctgtctctcttctctactttaacttgtccttaactaaactggcccaaagtttatattcatttggttcaggtgatattttctgaaatattggggaaaatagtcaagacagcacatatttgcatactctgtactatggctgccttttcctgagatctaaatggcttctgcaatacgttgtttgaaagttttatttttatatagttttttaaaaaagattgctttgtttagaaaatgttaaaatgaagaaaagtgtaaggacataaacaaaaatatccagaaaacctatcacagatagtgtcttagtgtatattattttagatattagataggcaggcaggcaggcagacagacaaggagataaacaggtaggtagatagataaatagatacatacataatagatagataatagatcatgataggtagatgatagatattaatagacagatgataggtagatgatagacaataggtagataaatgatgaatgattaatagaggacagatacatgatagaaaatagatcatgataggtagatactaggttggtgcaaaagtaattgcgtttttgcagccgggtgtggtggctcacgcctataatcccagcactttggaaggccaaggcaggtggatcacaaggtcaggagatcgagaccatcctggctaacacggtgaaacctcgtctctactaaaaatacaaaaaaaaattagcctggcgtggtggcgggcgcctgtagtcccaactactcgggaggctgaggcaggagaatggcatgaacccaggaggcggagcttgcagtgcgccaagatcgcaccactgcactccagcctgggcgtctgagcaaagactccatctcaaaaaaaaaaagtaattgcgtttttgctattaaaagtagtggcaaaaactgcaattatttttgcaccaacctaatagctgataggtaaatgatagattagatagatatataaataagtagatgatagattagatagatgataggtagatgatcaattagatagatagttgataaatagtgaatatagttgacagctaaatagatatatgataaacggtagatagatgatagatagatagatagatagatagatagatagatagatagatagagatgatagattcccttgtttcatagacatttactgccagacattatcctaagtaatggggataaaccacacacaaaaatatctgacttcatggaatccacagtctgtttctctaatgaacaaaatatatagtaaatatttagtagatagacagtagaaaatgttatgaaggaaaataaagcatcaaacagtattcgggagaccgacagtagagatgaggtatacagttttatgtaaggataccagggaagtgctctagaaaataacgtttgagtaaaaatttaaagaggataaaaaacaaatcatgtagatacctgggggagagcatttcagacatcaggcagagggaacagccagtgcaaaggccctgacaaaataactatttcctggtagcactgtgctgaaccccatcattaagtatttcatatcatggaggctttgcatatgtaaatagctaaaggacaatatttaataatttcaacttttggtttagattaaagggtacatatgaaggtcgttgcatgggtatattgcatgatgttgaggtttggagtatgaatgatcctgtcacccatgcagtgagtgagcacaggtaccaataggtactttttcagcccttgcctccctcctctagtagtcgccagtgtctgttcttcccatctttatgtccacgtgtacccaatgtttagctttcacttataagtaagatcatgggtatttggttttctgttcctgtgttaattcacttaggataacggcctccagctgcaaccatgttgctgcaaaggacatgagcttattcttttttatagctgcatagtattctgtggtgtgtatgtaccatattttctttatccaatccaccactgatgggcatctaggttgattccatgcctttgctattgtgaatagtgctgtaatgaacatatgagtgtgtgggttttttggaagaatgattttcttttggatatatacccagtaatgggattcctgggccaaatggcagtcctgttttaggttctttgagaaatctccaaactgcttcccacagtggctgaactaatttaaactcccaccaacagtgtataagtgttcccttttcaccacagcctcaccaacatctgtgtcttttgactttttaataatagccattgtgactggtgtgagatggtgtcttgtagttttcatctgcatttctctgatgatctgtcatgatgagcattttttcatatgctcgttggccacttgcgtgtcttcttttgagaagtgtctgttcacgtcttttgcccactttttaatggggttatttggtttttttttgtttgttgatgtaagttctttatagattctgaatatgagacatttgttggatgcatagtttgcacacattttctcccattctgtgggttgtctgtttactctgttgataatttctcttgctgtgcagaagctctttagtttaattgggtcccacttgtcaatgtttgtttttgttgcaatttctcttgagaacttagtcatgacttctttaccaaaaacaatgtacagactggtattccttaggttttcttccaaaatttttgtagtttgaggtcttacacttaaatctttaattcatcttgagttaatgtttgtatatagtgaaagacaggggtcctgttttattcttctacatatggctagcaagttatctcagcattatttattgagtagggagaaggataataccttgaattcttattatagacaccattaagctaaatatttagaccaaaaaaaatgtaagcaaaagaaaacagggtgcttcaaataggaactttcctgttctaaaatttacctatggataggcccgcctcccaaaattcacaacgacgccagcccttacttcattataaatatgtggatattgagaacattcatgtacagaatacatgagtaagtctaaaagaactaaaatgtttaggctgcaaaagaaaaacataaggacatagaagttaatggctactgaacactgagtctaaagggtgatggaatagaagaagctttagctagtcctctgggctttcatggacaaagtgggtgaaggattgagggaagcaactttagcatcactgaaagaatgaacttttaatcaccagatctctcaagagatgaattgcatttctctccaaaatatttaacaccctgacccagaagagttcaagcccaggcttggaaaaccctgtcataggcaggtcctgatataaggattcctgtagtacccaagaggttaccctggcacctaaagttgctcccaactttggataaattgcttttctaaaacacaaattgccactgcactgtcccatcgtgatgccaccctggtagatcatctgtttcttcatcttcactaatgctgtcagagtctgtcattccacaaatatttattggatatgccaataaatattggtaccaggcattgttctaagcatatggaatacattagtgaataaaacagatagaacccactgacttcaaggagcttaggttctatgggaataataaaccattttttcattcaatataaaatgattataattgttgaacggtggtgagtctgtggaagaaagaaaaagtagagcagattgaagggaatctggaagccagaaatgtggtttgcagaattaaaggtcatgtcacattgcacagatgaggcttgagcaaaggctgcaaggagctgaggaagtgaaccacgttctgtgagagagaaggcggttctagtcagacagaacagctaatgtctcaggtgagagtgtgcctggtacctcagagcaacagcaaggaggccagggtggatggatcagagtaagaggggaggggagatagaagagacggtcagagaggagggccttgtaggtcatgcaagactttgtaaaccattggaagagcttgtgctctgcctggaatgggaagccgtggaagagttttgagcagagggtggataagatcagagtaacattctgcagtagtctctactcatcctaaggggatacattccaagacctccagtggatgcctgaaaccacggatagtactgaaccctatatgtactatgtttacttttttcttttactttatttttgagacggagtctttctctgtcatccaggctggagtgcagtggtgcgatctcggctcactgcaacctccaccacctgtgttcaagcaattattctgcttcagcctccccagtagctgggattacaggcactcactaccacgcccggctaatttttgtatttttggtagagactgggtttcactatgtcggtcaggctggtcccgaactcctgacctcgtgatccacctgcctcggcctcccaaagtgctgggattacaggcatgagccaccacgcccagcctgctatgtttatttctatatatacatacctaagcacttcttctatatttgtctgtatagcacttgtatgaataataccatgataaagtttaatttataagttaggcacagtaagagactaacaacaacaatgatgaaatgattcacgtcccatgtggacagagcaggatggtacaagacttcatcatgctattcagaagggcatgcaattgaaaacttatgaattgtttatttctggaattttccatgtaatacttttacaccacgactgaccgtggttcgctaaaaccatggaaagcaaaacctcagataaggagggcctactcttgaagaatagtaggagtaaaagaatcactgtacactctacagaggcaaaggtagaaatatggcaacctgccagatggctcctatagaaacccagggaagagatggaggcaatacagtagaagagtaagatacgctcaggttctggaaacatttttaatgtagagctggcataatatctgagaggatatttgaatgtgttccccatttgaaagtttttattatatatgatcatgtcctctttcctttatctccatttgtgtggtgacattgggctatgtttgaatgattgctcaaacattgtagggtctttgagggaactgtacaaaaatcatcatggatattctcaactgcatgcattttatctattagtttcactactactttaagatgtctttttgagtatccagcacaacctttgggtctgtatgacacttattttgatttaaggaactcaatgacctaagaaacttgggacacctcaggttgcctcaagatattaacctgtttggaagatagcgagcatattccctcctatggcaaactcctctgaaatatcaaagtttggctcagtgtttcaattaaatcaaatgtcaagaaaaacactttgtattccttagacacaagacaaatgccatatgttaagtttatttttaaatggaggataaaaacaggaagaccgtgttccagtctgagaaaatattgatgccatggtgttggtgaggcaggttacggtttaattcatacctgtagatcaaagaatcaaaaattaactcaaaatgctaataatatcctgagggagtagaggttaggaaagaaagaagagagaaataaaagattgatctttttgtcctgagccaaaggatggagttgtcattacctgaaacaggttataggtggaactagtttgaggaaataagaatgatatcagaaattgagtcattaatatgttaagtttgagtttcagatatctattagacatctgaataagggtaagaacaggcagttaatacctgagtctagagtctagaaaatggatctgggctggagacacaaatttgagtggcctcagcctatagataggacgggatgagtacatcaaggaaatgagcaccagacagatgcctctagccctgaatttataacacatcaaccttgagaagtttatctttgtttaccttaagtcatttttctcaacacatcacagccatgagatttctaaaatgcagcctgcagtgaagagttagttgttagtcatcacatcaaatatagtctccgagctttactgtaaggattaatttgaaatgagaatagcatccctaacagtggcagtgattgaaaaaaacaatcaaccctgggagaaaacatacatgaaatgaaaatcgcaataataacaataactaaattcttgagtgctgactatgtgcactgtcctaaatagatgattaactcatttaatgtgctcaaccagcctgtgagtaagtgaaatatctgctcttatagctgtatttaagtaatgacttagtttttaaaaactctatctgtcatagttccttccattttcccatagaaaacagaaataatatactcttctagaactaagaatcttgacagaagcctgaagtttggactcaaagaaaatcaacactttggcatgagtagtcaagctaaaatgcaagatgtgctatacacagtcagtgccaaataagtgactcttttcaccttctgtcatcaccactcaccccactgtgtcattatgaccacttgtgatagctaaaactcttctgctatgtgctctcccaccattccactgaaataacccaacgatggaacattctttacactcaatatcaaaaaaaatgataaattacagtttctttttttctctgtactcacttttttctacccttcatatctcccacctcggttctttgaccagaaccttacttaaatattcagaactatgcccaggaaaccaatatttagatattccaggccaggcatattctttttagctactgttgaaacttaacgagaattcagcaccaacatatactggtggagctgagtgcaatacactttcttgaatacttagactagattcttctataagctcctttgtaaccaaggtacacaatttttcttttgggaagactcccacttgccttctctgttgcacttctgaaaaacgctatgtatgaagatctgcactttaaaagcattgtgtttccccaggtaattcgctcacatacccgttttcattttttagttttgatttttcctccgctctggaggatgcacagatccccttaagaatcgtattagatttgggtacattaatatacccacaagtttatgaaatgccattttgcatatttccaagttcaaatagagaagaaattaacatttaaaatttgcaacctgatctttgggtcccagtggtttataacattcatgcttatggcatcaaactcactgatggtttaacaaacaggaaattggattaagactcaagaaaacctaggtacttttcttttgaaccgagactcattaaagatagctaaagctatccagcaatggattggactgcggtgtaaggtagagaatttctcacactgagaggtgttcagcagtggctgtgtagaggggactcatgcatcaaaaggagtttgacctgaaggtctcttccaattcctgctatttgtgacccattttcagggccgatccaaacaattaacctcaccatgcctccctttcctcactgtaaaatagcactgacacctattcacctcagaggtatattctaaggtttatttcgctatttataaggcatggagcagacttcataaaaaggggcaatctaaatagcaaagtttgttattacttaaaaggaaggcataggaaatcttcaatgctcactggaaatagcagaggttttttttttttcctcctccatatgctccacctgttgcctgagttacccaatgtgcatgcaaatcagcatttttttctgtgtcacatctgagtgcaccgagtagacaggcggccaaagcaagtgtttagaattggccatttggatatttttgaaagttgtatctatatgcagagcttagctcaaattcatgtgaaaaaaaacagccttctttctgtaaagcgtttattcaaccaaagttgcatttccaatttcattcttggggatagaagtggaagaagcttttatgatatgattttatatctgtatgttttgtctttttatttagaaagatttgaacttagagaaaagttgcaggacatgtacaataaactcctgtacacccttcacctagattcatcatttattatcatttggcctcatttgctgtaatgctctatcattctcttaatatagaaacacctacaacaataaaaattatactaagtagtagcactgttgaaccatttgaaagtaagctgcagatatcttgacctttttccccataagtacattagcatgaatttcctaggaaggacctttctcgttataaccacactaagattatcaagtacaggaaacttagcaataacgtaataatgttatctaaacatatagaaatatatatttgctaatattattattggcaaaataataatatatgtttgctagttgtcccaggatcactcatggcattcagttgtcaaatccctttcatctcctttgattcagacaattcagccttcttttgccatatatgacattgacatttttaaagagtccaggtcagttttattgttgaatgtccctctattgggtttgtctggttctctcttgcctacgttttatttttaaattctctccatctcagtgggctagaaaaaaattcacgttatcagcattacatgcaccttcaccattcactgcaactggggttctggcagggttgggtcactccatcagggctggcatccacacgagagaggattagcaaagctaggtgttgtgcctaaatcaatgtcctttttctgaagcaattatatgtttagcaaacgacttttaactactcattacaaagaaatgactgatggattgctgcaaaatgcaaatataagggaaagcttcctctaaattttgtctactgtgctttttgaattgtaaattctccatcatttgctaatgaaggcagaaaggcttttcttaagcaaacaattgcttcaggaagagaaataaaaaactcactccctccctgttctttgttcttcccccagtttccatccctaatctttaaatctgctgatcctccccctttctgaagccagtttacctatatactggcaaaaggagaaaaataggagtttaacagtaagctttttgtaaaagataaatttattccaattagaaactagtcttttggactgaattgttctcctatttcctctattggtattaaaatataccttcttttatgaaacaactgtaaaagttgatggtcatatttgggggtgtgtgtttattaacggcctagtgtgccaaataaggatttaatattgtgtgctggtctagaaatgttctttctctgttacttatatagctatgtattaatatagttaattagtcagttaattagtttttcattcagccagttgacaagaaatcctaaagttgggaggggccactgatttggaggaaagagccctaaatttggtatcagaaggtggatttggccttaatcccgggttctgccacttattagctatataaccttgagcaagttactccagcctccagcagtcttagctcataatctgtaaaattaagtggtaattgatgcctcatctacctcaagagagttgacaggacaaaattatcctacaggctgtgaggactttgaagcaggttgtgttgtcttgcatccccagggcttagcatgaagcttggcatctaatgagcatccagcaaatgttttcccataaaaataaatgaaagaagtgagaaaatatatgtcaactttaaatcctataaatatgtaagtcatcatgatagaaagatgtgacattctattcaacacagaaaaagagagcagttcattgaagcacacaaaatgcactttttaaatgttttcccaatgttatttagagaccacattaaactgtcccttgtggtcatggtcatgaaaaaaaaaaatctatgtgattgcaaagcaggtgggtggtaacagaaaacaggagagaaactcaggcagcctggagtctctattttttccccatctcatcaacaagtcctaagccatatctgttccctcagcaccaacaatttgtatttataaggcaggatggtgacgtcaaaagattaagtgttggattcacaaacagcaattttaatccaggattcttcttaactatctttgtaagttacttaactactctgggccctgaattcctcatttaaataataatagtaataatggttacatcataggattatttcaaagattaacacatattacaaataacaaatatacgaacccacgttctatattttgtttcatttttaatgctcctcagtagttcatgacgtggctgtggaagtgagaagacaagcaggtgattataagtacctgagggacttcagttgactgatttgaaaaggagcaagaatccaggaagcctactattctagcaattcaatctttgtgtaaaaagagaaaagattcatgtgttagtccattttcacacagctataaggaactacctgagactgagtaatttataacgaaaagaggtttaattgactcatatttccacatggctggggaggcctcaggaaatttacaatcatggcagaaggtaaacaggaaggaagaaatgtcatacatgttggcagaagagagagagagagcaaggggggaagtgccacacttttttaaaccatcagatctcatgagaattcactcactaccacaagaacagcctgggggatatccgccctcatgatccaatcacctcccaccaagttcccccccgacacatggggattacaattcgggataagatttgagtggggacacagagccaagccatatcagataatgagcactaaatcttgataaggttctacagcaaccaccctcccattctactactcctacacatttaactctgaagttcaatatcattataaatttattgtacatcagaatcaaacctaactatggtggtagagaaacctttcctcatctgagccacacacacacacacacacacacacaaatgtaacttctggtaaaaaaaaaaatagctacataaataaaacaagaaaaagaaaaatgtgactttgacagtagctggaatacatgctgaatcttgcacagagcatatcacaattttcatctgaatactcatgaaacttaatattccctactgattacctaaagctgacaaatcctgaaggtacagaactgcatactaaaaaaaaaaaacaacaaaaaaaaaaactcaatttttccgtatgatggaagttcttgagtgagagccaaggtgcagcgtagtgagcacctgctaacattagggaacataagagggagccttttacacagcggctttccttgtcctagtaaagcatgtctattaggaaacagtgcagatcagtacatccacacctgtggtaaatcaaacattctccatcaagttagttggacgtatatgttttgttgcaataaccaatagggaatttttttttaaattctgtttctgcttttatgatcttaatttctaaaaattctatggtctttttaaaaaatcaagtaggattttccaagttaacattcaaatatattagcaagaaaatgtaatgagcatgagccatttacaaatagtttatatggcatgaactgaaagattatataaagcaacccaattaattagctggttaagggtatgttatatataaatacttaataaaaggcttacagaagtttatagcctagacaaatctccatattctatcggctttgtaagtgagcaggtgtgatctatttcatcgaacacttttggaaacttcaaccaactttttgtttaccaagttttacagttgcaggcttgatttgttaaagatgggaggtgtttgctgaaagctggaaaggacaattgcattctaaataaatttaaaatgctcctgggaaaattatgcttccaagccacacacacccacaaagggaaaatggtataatccaccacaggaagatgagtgacaaatgggaagtcaggagtgtaacctttaggaaggtggccactgggtatgttttggagttgaaacgagtttaactaaatggcaataaacaatactctgtcgacagaacagtctccattgcatgattgcatgtcattttctaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcaggtaagagggctagggaggaggtggaggtgtgggataaatgttattttctatttttcaaaaatgccatctagttttcacttaatgcagcataataaaactgcagcagtcccgtttatgctaaagattataattttcagagcccttttaaacaggcaaggggctcagagagttcatggggcttcattgaagccataatgtgagtgtttagttgtaaatgtgtgtttctatgggtggaccgagtggtatgtgactcctaccagctgaagatgagagaaggacatcattttgaggtgattaaacatctctctctctctctctcttatgtctcttgaaaagactgtgccagatttcatttccacaatgcctgacttgtcctaaatacatcttcctcatggcaagacctttttgtcaaacatgcaggattgcaaacacaataaaaaaggtatacagggacagttacagaaaagatgcctctttcttctaatttgttctagacaataaactgctatgtgttagtctccacagataatgtggatagaaatatttggtaaattgtgaaatcctatataaatgaagacatgagtaatgttcaaaaaaaaagaataataacaacagaataataatttctgagcacttggtcttaagtttaagaaagtaaattcattgggaagccaaggcaggcaggatcacctgaggttaggagtttgagaccagcctgaccaacatggagaaaccccatctctactaaaaatatgaaattagccgggcatggtggtgcatgcctgtaataccagctactcaagaggctgaggcaggagaatcgcttgaacccaggaggcagaggttgcagtgagacgagatcacaccattgcactccagcctgggccataagagcaaaacttcatctcaaaaaaaaaaaaaaaaaagtaaattcagaattagaaacaaagcgcagactggtgcttctcaccccagagtgattttgccctctggaaacttagagcaatgtctgaagacattttggggggtcatatttggaacagggcactctactggcaactagtgggtactgctaaacatcttgtaatacacatctggaaaggctagtgagacgtttaaaatagaagcattaataaaagatcagatgattgaatttgggagaaagaaaaaatatccaggttatatttatgtggtctgccggccatctctttatatttaagtcattattgtggcataggcaaagtttttatctaaaataacacaagctgtattgcactcctttgtttaaaggtctggggttgctatgttgttgattggtaagggccagtaatttcataagtagataaaccccttcgcaggaatgcagaactgtggaattttgaatcactaggaagagctctcttcaaataatcatctggcctgactctctggtgctccatctcacacttgcagagcacctccatgcagccattgagttcagaattgagtttttacttgcactgaacatcagcagtcaaaaaagttgaccaaatgtttctattatgtgctggatgattagagtaaaaaaaaaaaaaaaaattctatttaaagttggagttgggaggttaaggtgggaggatcacttgaggtcaggagttcgagaccagcctggccaacatggtgaaaccctgtctctactaaaaatacaaaaaaattagccaggtgtggtggtgggcacctgtaatcccagctacatgggaggctgaggcaggagaatcacttgaacctgggaggtggaggttgcagcgagccaagattatgccactgtactccagcctgggcaacagagtgagactctgtccccaaaaaataataaaataaaataaaataaagttgggaacacaaagttgcatttgaaagcaatcacagacatcaccatatctaattctcacactttgcaagatataaaatgatattgccagagtcatacatccagtgctttctccaccatgagatgctgtcactcctgctaggcagaagagtatccattgcttaattctacgttatagttacattaacaaatctttagatattaaaatttcctctcaataaagcaagtaagcatgtggcagtagtgtcaacaactgaagaactttaaaggtaagtaaatgcaatcagtaatcctttatcataaggcttcatttaagaatgttaatacagttcattaaagggtgtaatgaagtgtgtgggtcagaactgagaaaaacacccagatttatgtgtagccctcaaaaggcaaagaagcatcccttcccaggggcctgttgtaacagaggctgaggacttctgttacatttaagagaatgatttgctgatgagacttctctttgctagatactcatttgtctcacataactggccacatctctcccaaaggcaggtctggaataggcaagaacagtgtatggtggcggcagggaagggctgctagattttctcttctatttcactaaatttggacttgaagttcctttgatagaagtagctctttcctagtagcctggggattacatcattcaaaggacaattaaaacaaaaacaaaagcaaaatatccaagaatggcactctcaagaaatgtctagctggtacagcggggagtaggattagttcagctttgtaccaaccactgacacagacatttttctctctatcctctctcttatcatgttttggcctatgtttgcttttcctaatcattttagtgttaagagtggctgtgaggcttggaggaagacactaaagagatggcttatccagttttcgttctagactaataatctgcaaatattttggagataagaacccttttttaaaggtcctatcatgaaattcctaccgtattgcatgtaaaagggcaattgcgctttttggaataactacagaggactcaggtcagcttaatggggcttcattggaacctccagaggctgctgtgcttgaaacgggatattggagacatcagaacttttctgttctggtcaaagtaaggcccaagcactctatgtgatccagcttaacttgctccatttgccctggagaaaaaactgtagaaagagacttgtctgctaagagattccctagggaggctgaggactcaggagttctgggtcctgattctggctgccattccactaatccttctacccaaggaaaggaaaggaaggagacttacctcttttactgagggtcctaagaggtgccaacaaaggtgtgtggcatcctacatgatcatagcatcaatctcaaacaaccccctgaggtgagtttcttattctcactttcgaggtgaggcaactgacgctcagacaggataagtgacccatataaggtcattctctgagcctggctaggctgccatgtggtctccagactgcctgatctcagagcctgtgtgctcactttactctgaagggcccccaagcagaatggatgactattctgaagtaggctttcagaaatgtctggaaaaaacacagccatatgctgctggtcttctttagataagatcagtattaatagcttttacttttctggtagctgaaatcactgccaagaacatttctctgccaggtcaatgtggtaccctctttatgtgcgttttccatcattgtcctgcatttccctgcacctttatcatattttctcaccttttaatgattcttcagaaaagaagaaatcaaaggcactttaaagatatttaacatttatctaaaagcaaaaattggggaaaagtctatagttattcttgggcatgctaattactccagcaaagtaattatttctattcatattgaacaagtactatatgatgaaaatctgagaagttatttccccaaaattcatttgaaatttgaatgtcaagacttgattaggctacagaagatagggctttcatatgaactttcttcatgaatttctacagttggaaaatttccataaaccagaaggtcgcatgtgtcctctccccaacttacccacccaccacctcgcagcagggtcctgatgctttgaaaagatgctgctctctccttaacctgccttcaatgtggaaaccattgctcctcctcactctcatttccccaagtccaactactctttcgccgactcttcgctgtttatccttcatatacaccctcattcatactgagtgtgattttactgagggagtggctgaaaggaggtgaatttaaagaatgaagcaaagggcaagaaagctctacctatggaattctcaacttgtacctagcaggatgctgggtgctaagcaaccatctcatttaagtgaccaaataacttttaatatgattggcattattcctcttttgcaattgaaaattgaagccaattttatctaccatatactgagcatacacttaaatagaaaacaccaaggccgcatgacctgacctggcctctttctcctcttgctggcctccagtatccgatgctccatttcagaggcatcctttctggccacgtgacacagccttttctccccacatcatagcctttgcacttgcggttgccaaatcctggaacattctaaattcccagtcattcccacctaagtcttcatgaatatctcttaagagataaaagagaggaagctcccttctcattctctatatcccttcactctacttagtttgctctatcaccacaataaaaatcatagtgaattaagacatttactcatgtgttgtccatatcctttactacactgtaagttccaagaggacagaagccttctttgtccttttcccccaaatccctagcacctactacatttgacacacaacgagtgttcagtacagctctgttgaatgaataaatgaaccaaacgaatgaatgagccaagaactgttctagattctttcagtaaatcatccccaaagtcatattttcttctaccccactgagtctgctatactctcatctctgccaagcacatttgggtgagttgctcctccgtgcctgttacctgaaagaaaggctttgttcaactatgaaatcctatactattaagaaaccgtaatgcatttgagcctgtgatttcacttcctgaaaataaatttggctctttggagaactgcctagtcacttttaaatctatagtaggattgagtgagcaaatcgctatttcaggcacccattcctaatggttctctgatgaaaagcaagatggcactgtcttgctccattcaatgggaagctccctgggggctgggccaatttcctgagctggagaatggccagcaggtgagcatgaacatgctgtttcccactcagaaaacctgccctctcctttacatgaacaaattgagggagattttttctcccacaacactagtggcaatgaatatttagctataattgagccattagtctgcataaaacatttagcaccaaaatagtttgtacagctatattgcattttctcctgtcaacatttgcatgcttttgcttttttctccacccccaacccactttttttttaaatctctttcaattaacataaaaacaaggcaaagaagaaaatggctttttgtttgtttgtttaatgcctggtcttcctctgctagaaagtgcaatgacaatgctagttaatcaaataattttgtgcattgattctctcctcatatatgttgtgctcagtggctgtaatgatggcaaacagagatgcttaaattggtttcatcccttgtttagataagacagaagcaaccatcagctgtgatctctcactatagaaaacatcaagtcaagcatggcacactatgctaagggatggtaaacatgtgcccactaagtcagatctataagtcaatcatttttttcatcataaatacatagaaaaggccgaagacctcaggggccattttatactgaacacgtaccgtatgctggcactgtgctaagcagcttaaatgcatcagtcatttaatttttatgagaacattctggatagaagaaactgacagagcccagagagattttgtaacttgcccaaggtcacaaagctagcaagtggcaggtctgggatttaaaacttatctgaggctttgaaaggaaaaaaaatgtaacctcttctgctactgttgtgtacaacaagatgtcaactgattctcgtcttattgcaacctgaaacgtattttagttaagccttgcacttcttgaacgaaggtgtttcattttattctcaaacatctaatcatgtctagctttacacaattccttaagaaatgtgaattgtatcaaatgtccaatggcccagtagagaatgtggtagggatatcatagagaaatttatttttttattcaatacttatttgttgagcactgattgaaggtgttggagatacaacagtggaagcaacaacaagaataaaaacccaaatctctgcccgattaaggcaaaaagagaccttgaaaatgaatgtaacaagtgtaaaattatccagtgcttgcaaattggcctaataccatcaagttactttctttttttaattaataaactttatttatttattattttatttgagacagagttttgctcttgttgcccaggctggagtgcaatggcatgatctcggctcactgcaacctccacctcccaggttcaagcgattctcctgcctcagcctcccaagcaactgagattacaagcatgcaccacaacgcccagctaatgttgtatttttagtagagatggggtttctctatgttggtcaggctggtctcaaactcccgacctcaggtgatccgcctgccttggcctcccaaagtgctgggattacaggcgtgagccaccaagcctggcttatttatttatttttcacttttgttttcagttcaggggtacatgtgcaggttttttatataggtatgttcctgccagtgagggactgtgattagaatcttagactgaaagttgggagacccatttgcaaattctgctttttccctaacagaaaaaaataactaccatttatctggtatttactgcatgcataatatgctacgtgtttgactggaatgatttctttttatcctctcaaaatagtctttgtcatagatgaggaaaatgaggcttcaggtcacacactcagtgacaggtctggaatttcagatcagagtatgatgttcacatcacccatgttgctcacatcctgtaaacaggcaactttgagaaattctgttgatgcctcttcaactcagtcacctcatctgtaaacaaaattatcaaagcttgctaatatttccatcagctctgagcttccatgcatacacgtgaccaagaatcctcttactagcgtttagatataaagaacttgcttgtacttagtaggctttcaaagaaatgggaaattaattaagcagttcattctttcttaaagtttctccagtcctttgatagtctttgagccagttaattgataagttcattactttggataaatcctgacaatgtaatgatgatgaatctcaatttatactaatttgatgataatttgtagtatgttatataattactttggcggtacattctcatcgtaattatgtttctctcaggctgatattaaaatctatttatattccctgaacacatagttagttttagttgtacggagcggttcatagttacgagtatattattaaatgtatacaagaattaattgacctttgtggataaccaacaatttactaaaggtgtgtgcaatttgcccatattcttagtgtccaggatatccatttgaggattctcaaaggcctccaaaaagtcagtttaagaaaggacttagatttgcttcaacctgaattgggaagcgagaaaaaccatatatgcatatgcttcaaaaatgctctaatgcttaatcccggttatatcaacttttgactatagtaggagataagaaaaattttccttgcagtggaagcaggggaactttagaagaaactgttaaaagtatttgaagatatgtatgtcagggcacatcttaagcctattggatcaacaaacttcagctttattcaaaattgtaggaaggtgcatgctcttgggtgtgccttttttgtggaaaggggtttgtagtgtccgtcagattttctaaagaagcctgcatactaaagtggtttaaaaattactttgctaggttaaccttatctacttcctcaatacttcataaatgcaagatcttatcaaaaggatccttccttcctacttttcccatgactgttagccaaatcctctctgctataagggtaatcctatgaaatgtaactttcatcatttatccagccaaattatgtgccagatttttttttttggcccgtagagttctatgtgccaaagaatcttctagggtgaaatgggaattacaatatcattaaaaactctaatgtgttagacgagatcattatttagtgaaggttcaggtgattcattattttccacttctctaaaaagggaatgtattagtacatatgtcacattatttgagaaaatttaaatgtgacaatgtattaaatataaggcattaagctcagcaccaatatataaaatattccacttagagattatcattgtcattagtagcagtagtcttttgtgtaggcaaaactacaggtgtgatacaattcttagaactggcttcccaattccaactctgtatcacgacatcactccctgctctacatcataacaatgatttccaagattcctctcagcctaacataccaagtctccctgagatctcacctaatgtaattacatttccatgctagaattaacactttgcatcctctttgttcttcccccaaccaaccagtttctcctgctctgtccctttcttggtaactagaaatttcatccaattactgcagccagaaaccaagaaatccaccttacttgctctcacctttcacattcattagttagcaaacagtggagattctgccctcggaatatgtttcagattcaatctccttttctctatctctcatcatcttccttctccactaatataattgatctctctgccacaagttcctttcccctcctatttcctaaccatcctctgcatagtctaaaacactattcattctgagtaaaacatctgattttatacctccatgtttgaaattgctgagtgccaccctctccaccctggatgttgcattaagaataaaggacacatttcttagcaggccatgcagagctctccacatctgtccccactgtcattataacatgtattgcaaaaatatctattatgtctaatatacccttttagccaaaaaaaatctgttacaaattttagaaactatcctttcttactccattaaggagattaaagttctttccaaatgtgacctaaagggattcaaaatcacaagaaaagctgtatctaattaattctaatatctccagggatgtcataataggagatcaaggtaggtctgaattcttacagaagaagaactgtgagttaagcacctcctagtccctggaacatcatccaagggcctttcacagctgagtccagcatttatacaggaggctccctcacgggtagacaggaaacttaacaaactctggcaggtggattgatgcatcctacttaagataaagctttgactcctgtggttctaactttggtcttaaataaccatatgcttttatttgggatctcaaactccagcagaattttgtgcaaattattaattttcctgccacttgcacctcctattatcaattaagaaattaataaagtcctaagatcccaagattgaaatcaaacctgggttcaaatactataactatgctttatctctaaaatctataaattaggaataacacttcctctccaattaaatgtcaataacctattactgtagtgaacatcgtgttgtggcactcagcaagcagtcgctgtgaatattattgttgtagcttaaaaatatgagcttggttaatataaatcagtggttctcagcactggctgtacataagtatcacctggggagtttttagtaactatcaatgcctgaaacatatcccagacaaaataaatcagaatatttaggaatgaggctcaggcattggtattttggagaagtttcttggtggttctaataatatactaagaaacactgatataaattattttttaagcctgatagttttcagataaattaacaaagtcaagtcacccaaaaagctgaagatcaggccccagactcatgaagactttactgggcaatagagatctcgtgagaccagcaagatcaccatttaatggctgcacccctgtctctccttcaaaaggtgactttcaagcaaatttgaggtatagttttcattaacatcattatcaaagaagcttgttgcaaaaagattacactgaatcatctggggtagataataattcaaaatattctgttaccttccagcttctagattttgttcaataatttgctgttaaaatttgtttcctccgtattctctcttacatatcatctttccaccaattttccctagatgttgcagagaggttattttttagtttcatgtaattgccccaaaagttccattctctcctgtttaccagattgcctatttcattctgccatgggaaaacttcttttcctgctctgttctcaacagtctgcactccttaaatagcataatctcatctgttgtgcacctgggtgatgcaatctggctcttctagtaggatcatcttccaagctaaactaaaccccaatgatttgcactccttttattaatatctattagtatgagcttcctttctcctgcagaccatacctctaaggagagaagcttataaaggagttaacactgagaagaacttccaaatagtacagttatttaattcatcaactctttgtggaatatcttttgcttttctttagtttaacttggaggtaggagaaaaaggggctggatttatacatcatatagcacagttttcaaatccaaggaaaaaccctagacttgtggttagcttatcacctgtgtacatgcatgtggttaacacgtgtaagtgaatggagggaaacagaggaacttagcaagttgtcaacctcaaatgaaaaaagtcaatttttcctcttgatacatgtttttgacgttaccaaagctggagtaatgtaccaatcactggagttagggttacagcgatttcatatgccataatcacagaaagatgagaaaatgagatgtattggttttctattgctgtttaagccaaatttagtggctttaacaatatatttgtttacagttacagaaatcagagatctaaaatcatgttgttagcaggtctgctttccttttggaaacttctggggaaaatccaacttcttgccttttcttactcacagaggccgtcctcattccttgtcttgtggccccgcatcacactccatctttctctctccttctatttacgcattcccatttacaccttctctgccttaagaccctgctgttttcattgtgactacattgggcctacctagataattcagagaaatctccccatctcaaaatctttcatttattcacatctgtaaaatccatctccaggtaaaggaacatattccattggttctggaattaggacgtagacatctttagagaaccattatttggtcccctccataagtagatggatatctttctgtatatcaggatttttctggtgtcaaatgctattttctgtatattccactattacttttgtagatgtaagctataatcattcaatgtggcatgaatgtactttctatagcaataaacactggtctaaagactgtcttatatccatcttgttctactgatgaccaccattaaaaattgcatggccaaagaggcatctggctcagaggatagtatagatgcagcctaaaatattacagttagcaaataaaaaagagctacacactgaagctcaaactttcatcttaaaattgctgctcggagacttgatatcattcacctggttttctgaagactcctgtgccaaaaataccttatttctatcttgaggtaaaaccattattttagccacattgcatgttcacacatttggaagttattcacttgaaattattgattacaaaccatgtctggtggtttagaatttatcctgatattgagaaaggctataaaaagagaaatacacttcggcttagtcagtataaacttccaagatacctatttttcaatggaaaaaaagcagtaataaaaaaccatataaatattacaagaacacctcaaagttgctcagtagcactccaggttccattttgagtttctgttaccacaatagtagcagcagaccaattatgtgtggcatatggatttcccttagtgatggttgctgagaatttgtggagaggaatttttcattgctgtctccatagctctgcattgccttccaggaaatgatcagactgaaatatggtccaggcttcttaagataactccatgtgtggttggaagattctgagccaaagactttccctgtattttgtagaatgactctgtcaacaaccacagccattagacccctatgagctacgtcctggtcatctttacctagacttcattgaggactcacaagacaaactaaaatatggccttggtgctgctcaggccgtacatgataacttcacccatcaagatctaagagatcatcattgccaagaacaactaggctagactaagaaggtcaatactactgtgaacaaggtcatgagtgttctgtggcaaaaactccagaaagcagctggaccaatgtgggatcactgctgtcaatgagcaatgactgtgtcccaggatatattgataacagttaacagtagggccttagaattgtcctttcaagaggcagctggcagtgagggttttttgttgttgttgttgttgggttttttttgttttgttttgttttgaaacagagtttcactcttgttgcccaggctggagtgcaatggcctgatctcggctcaccacaatctccgcctaccaggttcaagtgattctcctgcctcagcctcccgagtagctgggattacaggcacgcaccaccactgccgactaattttttgtatttttagtagagacggggtttctccttgttggtcaggctgatcttgaactcccgacctcaggtgatccgtccaactcggcctcccaaagtgctgggattacaagcgtgagccaccgcgcctggccggcattgagtttttattctgccttctgatgacccatttactgcaaataaaataaagcagtaattattttttagctactggaacaatggaatagtcttgtggcatttccatgtacagtagcatgatacggagaaagcatttacaataggtacaagacactcccccgctgctgatttaaggattatgttatctagatggaatggaatttcataagtatgcaggagcttaagtcttttggtattgatgtcttttgagttcttataattaattctgtaacaatgtagattagaattaactaacaatggtgatcattagaggtagggggggaaaactgttttgttggaaactttttttcattactctaacccaactcagctacatcagatctgaagaattccactcgtttatatggggaaaaattatttgacttgtcccaatcatgattatttgtttatttgtaatatctttattctataaagaattggagctgcctggaaaaatatatttgaaacaaactaataaatgtttttaaaagggaggggaattggcacaaaggagaaaactagataacaaaaacataaagctggatgacattagcacatgaaaaatgtatgccctgtgctcctgactaattgccaatggaagacccgtaattttgaccctaaacctcctagcaatcaaaacaaagttgtaaacaagatcatttacatgacttgcagtattcatgtaacagaaaaatgtatttattcaaaaatgaacagcttgttctggcactgataacaatgctagtgatattagggaactgagatctctggagagtgacatatgtcagaatcacctccacttcattggctagaaccagcacatacccccacccaagcccaagggactaggaaatgcaatcctagtatgtaccctttgagttggaaaactggaaaaacagtactaatgacgtccacactagtaatcttccaaaatcaatagatattccacaccctgcctattttagatacataatgttaacaaaagggctgggttgtttttaactgtcaatctaagtcaatgatataatgtcaaaagttgtttaacaagattaattccattaagaaatgagacttggccaggtgcagtggctcacgcctgtgatcccagcacttagggagaccaagacaggaggatcacttgaggtcaggagtttgaaccagcgtggccaacatggtaaaaccccatctctactaaaaatataaaaattagccaggcatggcggtacgtgcctgtaatcccagctactcaggaggctgagacaagagaatcgcttgaactcaggaggcagaggttgcagggagccgagattgtaccagtgcgctatagcctggggcgacagaatgagactctttcaaaaataaataaaaataaaaaaaagaaatgggccttattagaagaacatattagtggaagcaattcggaggaatatgctatccatatgaacagtattgatatctgcctttattacattttagtgtgtgtgacatgaagtgttttctgccaaaaaaaaaaattaattgtgacaattaagtaaagccagagatggttcctagcaataccgccctaataaagtatacatactgcctaggtcagcaccatttggtcagttcggcagacaagtactgtatcaaaattcaaagtcattctcaggaaaaagtaagttctgcaaagaactattagaaaactccctatatcgtgattacactttttatttttaaaactgacatttattttgatgtgacattttcttaatcccttaatgacttttagttgaaataccaacatgcagagagaaaatcaaaatgggaatgcaatcgttttatttacaaagtatgcgacaattagacgacagggctactggtctcagctgcttaaagaccatcacaagaacaactgctttaaaagcaccgcctttggtgctgttgactttgttgttcttatcaagatgtttttcattcacctgggtgagtgtccacaaagttgacaggccaatgatcaatgactggactcgtttcttaatttccatttctagtaaattcaagggaagaaccaggaggcactaatgcaagcaattagctaggaaaaggaacgggaatttttctactacagcaaataaaatgtgtacctggaggaccccagggttctttttgcaataacagctgtcctgttggctgtttattcgctgcattttaatatctctttcctaacgctgagaggcatgtcaaatgaatatttacctccaggaattttaaaatacaataataaaaataatcagttaaatggttgtttaaaaaaatgcttatctcttaacaggggatccaaagcctccataatgaaatttaaaaagaaaaattttacccaagtgaaaagctataaactcaaatgcctttgtgttctattttcagtttcagaaacaaaattttaaaccttagcattcagccctatatcctcacatgaaacctgcccagttccctttcaagaggtaatcttggctgcaattacactatctaatgaccaaagtgaaaaataggatttctgactgaccctggcaggccagctctttatgctcgaatgatataagagaacagctaacaagacctcaccatgcatggccttaaatgttattgatggcactaaagcaagtctacccttgaaaaaaaacatcctttagtgtgcctggtcttgttgtcaccgtaggagtgacttatatcctgtgggctgatgattcatggagtttcctgtcatttgtcttaagttcatgacattgcaatttcactaaatattcctctggttttcgtgttagtagagacgttgttgagaagtgtaggactggtgttcatgcagttatgtgctgtcatctaataccctctttatttcttattccctttcacgtaaaatcattctagttcacatatcttaggcaccttccagaaccgctgataacttgcaatgtctttccccagaccttttcaatccatctcttcaactgaagatctgaaagtctttgttatttaatgcaaaggtacatgttttccatagagcagtgattttcagacacagctgtgaaatgcagaaatcaaggctacactctcagaaatcccaattcaggatgtccctgtgatggtgtctaagagtctttgatataaaaacttccagagggaatttttacttgcatccagaattgaccagagttgtgcggaaaactaccttggaaatgtgatttctaagtcttctctcttcatttctttttttttttttttttttttttttttttttttttgagtctcgctctggcccccaggctggagtgcagtggcgcgatcttggctcactgtaagctccgcccccgggttcacgccgttctcctgcctcagcctcctgagtagctgggattacaggcacccgccaccacgcctggctaattttgtgtatttttagtagagacggggtttcaccgtgttaaccaggatggtctctatctcctgacctcatgatccgcccgcctcatcctcccaaagtgctggattacaggcgtgagccaccgcacccggccttctctcttcatttctatgcaaagacaaaaaaaataaaaataaaaaaagcacccaaatagttattttggtaatctatcccaaggaaaggaatatccttattcatatttagaaagaattgtctccaaaccatttgcatcttcttctcagttgacaccatttccgggactccaaaagtaagatcacagttcaatgaacgtagaacccctgtccttcctatccacctccttttttccttcttccacgaagtaaaaacaatatacacgctcacagaatgtccggaactattacgatcccaagtagttatttgagaaccagcatgaagaaacagtgtgaaattggtgtcagaatagtccctatccttttatctgtaaatgaatcctctcttccccttctcatggaaaagggggagagagaaaggtttcagagatatactcattcataaaccttcatttaaacatatctacataccagtattgacaattcaacatttaatgagttctactcataatgagggtggcattatgctaagtcgtaagtagggagatcaatgaaatacatatttctaagtatgagatggctcagacacttaggcagtgggaaagacaaaaccctgtgcattatggacaactccaaatacaaaatttgtttagtacaaactatttttttttttttgagacggagtttccctcttgttgcccaggctggagtgcaatggtacagtctgggctcactgcaacctccgcctcccaggttcaagcgattctcccgcctcagcctcccgagtagctgggattacaggcatgcgccatcacgcccagctaattttgtatttttagtagagacaggatttctctatgatggtcaggctggtctcgaactcctgacctcatgtgatccacctgcctcggtctcccaaagtgctgggattaaaggcttgtgccactgcacctggcccaaactatttttaaatttgatcatcaaacccattacttcgatgtaggtcaagcagtgtgtaatggaaatagtgttggctggaggtcagttggcttgctccacaccagccactcattggcctcaggtttctgatctgctgagtttgtggatttccaaagtcccttcctgttctatgtttccaagcatttgcagtcaccctagaaattatcccattcttattataattctgttcctgattctttccccttatttctcttttgcagattctgttcatgggcatgatgaccgagtactatcactactttttcacaaccctggtaagtgcatctgggagaaatgtattccacatggtaggaaacgtcttcacacagttatttcagagtcggcctcaccagtgtcaaaggcaggatattgtcatggagacttgccttactttcctaagaatcctctaaatccagcaatgctgagcagcaggctttttttctttctttctttctctttctttctttctttccttctttctttttcttttaactagtatcaatgcatgtgcattcagagagggattaaaatgaaaattccattaaatagaaactattaaagtaaaaactattcataaaaaacatcatctacaatttttatatacattagaaggtgtatccaagtgtgtctggcattcattgatttgatgtggctttgctgcctgtgtccagtagatagctgggttagccaggggttacctgtcagatgtctgaaaaaccttcagaaaggggagttttggagatgctctgcacattgaacattttgcctcattaagaaaaatcatggtcctaagccttagaaatctaaaagaaaccataggacatcttaaattttgagagactatctgatcatggagaatgatttagggtatttaacacatcaaaatgatgtgataattttcattcagtcaatttcagaaatcagtgacagcccccacctccccacctacacactcacacattccacttccttacatgagaagaaaaacagaatcaagctcgttttctaatctgtaagagtatattagctaaatttgacctggattctgggggggtcagtaacagtgccattttagcaaattcagctgacaagctagtgagtaggggaattcaaagaatttagaataaggacccgaagtagtaaattctatttctgactcaaatgtctttgagagtgcagaggacatcatgaaatgaatgctttgggacagttgtcaaaatcattactgctactgagcatagggtggaagtgggtacagggtagaaattcctgaactaaggtttgcatagtcttcccatagggtggaagtgggtacagggtagaaattcctgaactaaggtttgcatagtcttcccatttgcctcttactgtttcttgatcatgtcatccttgagaacagctgagggaaaacttgagaactgcaaagtgtcttactctgcttacaaatatggttcttcccatcacgaagaacacctgagggttactcaaggtgacatggccatctgcctcggaactttctacctcctccagctgtgaacaccctggaagagctggtgtgggagaaatttgagaaggaatacgaataatggaacctaccaaggctaggagaccatagaggatgaataaatgtgcacttttattcctcttcacccctaacactcattctgcatgcacaaggggatgtagcaaatcggattttagacttctgacattctttgttgcgtggaaaccctaaattgtaggacaacctaattttgcacatgtttaatgtatgtcattttagcatgttaaatctatgtactatgaatctctaagagggttcatgtgtattctggcagtttctgtcttacctcctgagactggacttaactgtctttctattcactgagtgtgctaccggactcatttttgcctgggtcctcttctttaactttgcttctttcatccttttcctctgattttatctgcattctgtcctggttggcttttatattcttaccattcttgcccatgagtattaataaaagttaaagaaaaaaatagttacttagtgttaaggaaaaaaatatgcaatgctttaaaaggcagtattgtacacttttctgatactgatctcggagcacagagctgtgctcttacagttctactgcctcatccaaatatatcttgggaaagagagagttcatcaaaagaataaatttgtatgcatcttccgcaaatgcaaattgcgaagtgtttctgaagctgctgcttttcagtacctgtaatcatcaggataatgtcctgtcttgcaatgcactttcagaaagcggttgcattgttaagaaacttttatggaagtatttttcctgttaaatgttatcttgaaagttgagtttcttctgaaatgtgatatattttaatgatgtatttttaaatctagtcttttcatataagaaaaaagttgaaattattacataaccctgtcttaaatgtgaatcaatttagaaacttctggtttacactcagcctcatctgtaatagaaaacaccaggatgagttcaactttttttcctgaaacattgtctgcaagggaatgggttcccttattaagatgttcttgcatccatgtaaccttgtgctctagtatgtcctctgaagagcatcctttggtacctattctgagcctatgttcagcgaacattcttcatgccctcgttgtatgagatatgagttcttttcaacaagccaggagatgattttttttcggccaggagtgattttcctgccaaatgcatatgcagttttcaaatttcactttgtggcaagacctggaacagcctggggtgcaagatttggtggagaagagtgggtactgccagtggttcattcttgttctgatcacatcaccactcagaacctcagtttcttcatctgtaaaataaaagcattgaaccaaatggaaataaatattcttcaaaataccccaaaggctatgaactgggaacagaattcttagctttttagaatgttacatcctgtgcccaaggacatactaattatcagcagccaaattcctcctcttgacttatctaaactctaacagtactgcaaaaataaaacagatgaaaatgaaaactgattactgccctagaatttttagggcagcatgttaatgaaaaacaatgggaaaaatgttcttttattgaaatagtgtggtacggctgccattttgttttaatctatagcagctcccctttatccaatgggtatatgttctgagacctccaatagatgcctgaaatctagtatggtgccaaaccccatatagattatgtttttcctatatatacaaacctaggataaagattaattgataaattaggcacaatactcttgcagactggaaccattatgaagtataagggtgacttaacaaagcacttccataccacgatactctacctcataactgagacagctattaactgactgatgagcaggtggcatctgtagtatggagactctggacaaataattcatgtcccaggcaggacagcatgggacagctcaagatttcctcatgctactcagagtggtgtgcaattttaaaattatgaattgcttatttctgaagttttccatttaacatgttccaactgtggttgaccgcaggtaactgaaaccatgaaccacaaaaccacagataaaaggtatcattgtattagttggtgctacaatcattaatattcttttgtataaaaaatgaaaattctaattattttccactgttatcctttttgatactatgcaggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacagtaagtcattttcaaataaaatcatttgcaagaatatttgaatgccttcggggttaagatctcacgtatctttaaaatattagagaaaagtgttacagtgggtgccttgacttgcagtagagaagaaagagtttgctttttaggtaatttgaaaggctgtgactggctactagcaaaaactgctacttttagcttcctggatgtacttgccccagataaaaaacttgacaagagtaatcaccattatcagccaaaccagtgcaaggacaagtgaagagcattttattctaggaatgtggctgtggggaaggtggctggtgggggaagaggaggaacaacctacctgtgagttttgcagaaccgatttgtgttcctcacttctgccacatttcagcaagcaaagccagtgtggaaaaatgtcggatttacaaacagtcggtgtattcagctcttcctgtcctggatgcgtataggttcacctctgcagaactgacagtgtttaacaccagccatatgtcgctcttgaagcagatgccagacctgcctcctgacaagtcagagatactctgctgaacagatacattgcgaactgcctcatcagagagcttctccctaacatcatttgtctcttgtcaaatgcacctaccttcactatatttctctaatgaagctccctgggtgctgaagaaaatagcaggaaataattttttaaaatgcttcctatatgggagccatctaaggggaaagatattgtggaatgcaggcaggtaatagcattttaaaatggcatagtattttattatccattcctatcatcgggagacgcactctcgcttttaagatgcaatttacccaacatctcacagagaacttgggatttttttcccctttttcttatgaggaacaaatgaaagtgaagaactaaatgaatgaattaagtggttctggatgattctatgttcaggctccctaactgtttttcaaacctgaaataacttttaaaatattcaaagtgaactgagagataatgatggaaagcatcttggtacaaatgagccctgggatgatttgaaacatttctttgaataggagcaagtagagaatatccagggaaatattatatttctgaaagggagagggaacaccagagacagagggagaagcacgctaatagatcggtttttctcttcttcctcttgggtttataatttcaatgagttcaaatatggttcgaaatcctctgcccacttttccaatgaagtttcaatcacaggatgagatctcaaatcatttttacctgtgtttggtatataccactaaaagagttacagtttgaagctatgttaacacagactgtggacttatgccaaacattaaatattcatcacaagtatggcttaatttacaaagaaaaaaagtctgtgtgttcaattatactgagctgacaaaacagtttgtacatattgactgaaatgaggaagatcgttgaacaaaggagacagacctacgcaattcatgtggaatcaggccgagcgtgaggtgaagctgctatcccagggcagcagctggtgtcctgagctaacggtaatcccctgggcaggaagtgtgataaggttgagtcccagtggatggaagaggtcctggtctgcctgaagatttttactgtcatcccaactaagagaggggtttctagactgtgttcttacagttattattataattaactatataaaggaaagtggggatttaccagagcagaagagggtagctcactaaggtgctgcaaaagtgggtagagtaactattgaatatatcaggtcgtgtcaatactaattttttaaaaagtgataggatgcaggccccagtatgagttgtatccaacagtcatgcagataataactttgaaattatgtgaagcgtaacatttacctttttttatccaaagagtctgctttgcacttgactgttttctttctgtttctcctggatgtggctactttgggaatgtggaaactgtgtcatgggaggtgaagggcattgaagggcacgaaaggacctccgtttgatcaatagctaagccaagagagcaaacttatgaccccaaacccaggcccaaagctaacaaatctttgctgtcaagttgcctctatttaaactctttcttctctacgttaaagataaaaagtcctttggtttcagtttcattgggtccacatcgcagaccctgcccttcattcattcttgcacatcaagcacttgctgtccccctgccttgaagtctcacttatccaggctacaaaatgccacttcaccagacagagcctccatgaatcaccatctagtacagtagccccctccctggtttttctctctttcttcttacctgtttttgttttcttcatagcccttatgacctgacgtgttatattttgattcgtttgttcagtaccttccctacaagaatagacacttcataaaagtgtcttttatgaaaaagaggctttgtgattttgtgctttgctttctccccagcactagaaaaggcccagtgcgaagtacaccgtcaataaatatgtatttaataaagaaattaatgtgctaaataaataagaattaagcttctactaaaactgaagatgttaaatgaaaaatatttaggcagccttgaaatagtcccataaaagtgcagagagttcctataaacaagatatatgtgaatgtgcatgattagtaaaatagagattactttaaaataatagtgtttttttaaaattagtcacagactggccactcttaatatttaaataatgctactactataatagaattgaattctctgaaatcatatgcttcattccactattcttcaaggtgaatttctctgtagctgtttatagtcatattggtatgtggtgcatacatacatggatgaatataggaattagaaaaaagcataaggaaaatgcatgtgttttgatttcccattcaattgtctatttttctctctaatatttctaactattaagcatttcctagaatttcatacactaaaaatcctcaaaaatatgattatatcaaaacattcaaacctgaaaatagagaaatcagtcatgcctatatccaaaaagtcttgacaccagacttaagaacaatagaattaattaaagaaaaaaatttagtttaaaaattaggttaaaattaagttactaagaaaattgttactgagtcaacggagttgaaaaacagtaaaactcgttattaaaaaatatcttgagaaaaagaaagagtgttttatcaactgaagtggtaattgacagaattaacagaagtttggagtgatttttataaaatctactttgttctcttttataatgtttacatttttctcagcaattgggctgattcgacctttcagcttttggatagactgggataatacagaatggttcattctcaaatgggtccttctcagtggaccaaaattgtgtatgagtcaacactgcacaggagtcaggggaacaaccaaacattgatctgacatctgcctttccagttcttcatatccactcacaacataaacttacgtcagagccttatcctgctctcttgcctgtaaacatttcccttaatcatgacccacagggaagacgtcatagagttcccactttgtacatccactgctactccagcgatgaaagaaaacaggcagctggattcagtacagaaagcaaaatcttccgagataatgaaagcctagggttaagtcctggttatgtctcctaactaagtgacctgaacaagtcatttaacctctcttagtttgtctgctcatccataaatctgtacaataacaccttacagtgttactctacagattaaattagatcacatatgcaaaacctctagtacatagaattgaatttacttgatgatacctgatgttttgcccatttgtagtcaataaaagaacaagaggctgggcacggtggctcacacctgtaatcccaacactttgggaagccgagccaggcagatcacaaggtcaggagttcgagaccagcctggccaacatggtgaaactttgtctctactaaaaatacaaaaattagctgggcgtggtggcaggcgcctgtaatcccagctactcaggaggctgaagcaggagaatcgcttgaaccagggaggcagaggttgcagtgagccaagattgtgccactgcactctagcctgggcaataagagcaagactccttctaaaaaaaaaaaaaggaaagaaagaacaagagatattctgaaatatcatggcagaatccatgtatttccaagaaacacattccttagcttgcacatatagcccaagatggaatcttatctgggacctatatgaccctgtgtgatcaacccatttgatctctgaatattaggtctctcttcagcaccccaatctcctccagctttttccaacaacaattatacaccatccaggcagctaagtatggggactttctaaggccatatagtgtcgtcagtccttgtctctaagatgaggtggcatctgactggcttatgttcagagtcctcaagaccatcttcagatttgatgacttgctagcaggactcacagaactcagaaaagctgttatactcacaatgacagatttatagcaacagacgatagagtaaaatcagcgaaggaaaaagtgacagagagtccacacagaaaaagcatgaacttccaagtatcctctcccaatagagttgcatgaacagcacttaatcctcagcaatgatctatgacaactagaaagtattgccaaccagggaagctcacccaagccttggggtccaggttttttattgggatgatgggtcacataggcatggagctcccatacagctggccttagttacttagtaaccagccttttgggagatcaaattgatacagcatggcccagagacctaggccagcaaaaataggcattcatcataaatcatgtttttagcataaactatctgacattgcccaggacccaaagaatacaatgacactcttattgggatattccaaggagttaaaagttatctctcaagagccagtcaaggggccaatcttctctttggaatgtgcaaggtctgagtaccctaagcctagtgagttaatactttactgcaaattgtaataaccaaagcattgtgtactgaggagaagtatgctttcaatgtgcttatttcatggttcagattgtggtaaaaagattttcttagggtcattgagcaatgtgatttcatccaggctttagatatacataaaatgtgaacagaaacacatttggaagaagaaaatttgaacacaggccagtttctattacattacctattacctaaaatgatgacagtcattcagtaagcaggcctcgagcacaaaactgaaagggggaggaaaatcagtggtagtttattagtgctataatatagttaatgtaaacattttctccatctaagaaaacattgtatttcaaggggtagcatattttttcgaacaaatagttttcttctttgggttgaagggcacaaattagacctataattttgaatcattttattgcctttcccaatatggagcccgccttgagaaagaatgcccatcctttctaaactaagtttatggaaaagtcagattattagaattccagtccttatacttctctatcaaattggtcattcagcgaattaatgaaaacacatacgaattttcaaaaaagtatatcctattgataagaaacagtccaagtcactgtagcatgtggctatggtcatgaggtgaaatctgagtttgcatcacgaattagaattctcactctttcccttaatgtctacaaaattttaggcaagttattctacctctctacaagcctcaatttccctgtctgtatacctatttcaaaagtttaatttcagtaattaaaaaagatgacatatgtaaaatgcttatagtgcctggcacatagtaaattatcagtgaatattaacctttattgaactattattgtgactattaaatcatcagaccaataacttggtgtagaagcagcacagctttatggttaacggcatatactctagcaccaactttgtgggtttgaatattgcctgtccccccatgagtttggggatcccatttaacatcttttttctttatctgtaaaagaataaaggttatagtgaaaatttaatgtttgcaagggatttagaacagcatgcgacatatcataagtgctcaataaatgtcagctattgctgttgactgcatttccaaaagtctcaatctgccagtagcttactttcctccaattaaacagaattagtacagcaaagtggtaaagatcatgggtgctagaatcaggcaggtgcaggctcaaaccctggcaatgaaattgattacagagtagccttataccggtcaatttccatgagccttagttttctcatctacaaagtggatagtgtaagtcctgaactgaaatgatcaaaacatttttaagcattataaattactgccaccaccaatccaacgtcagtatgtcaattacataagcatgaatgaaatgctttttcttaaaactatatcttaaaaccttgcaattctacagttctcacaaaaataaatgtcattttaaggaattgagtagtattaacttcgtcagtgaacatgtttaaacaacttttctgtgtcaggaaccatgttagtcaccaaagctaacttaaatttgagcagtttctgccttcaaaaaaccaatattcttaacaagatacagacataaagatccatgaccatgaatagatggaaaatacaatgataaagattgaacagaataataatgattcaaagtagaggtattccgtgacctcaaagactgataaaattgtgagatatagtaacccctgtcctcactttctacctccaccaagacatgagcaatcaatgcatagtatatgttgaatgaatcaaccaattttggaaaaccatatgataattttcattctatgacctagattctaggtttaactctgaaaatgattagctatgtatataatccctattactctccagaaataataagcagaagtagtgacatctctgggatttctcactatgattgtgtatgtggtgtgtgtgtggctgtgcatgtgtgtgtgtgtgtgtgcatgtgtgtgcccctccacaaatatcctacctcgaagtgagttttctcacataataaatagctttatctcttctgcttattttgaagacttgttgagaatttcaaatgagctaatgtatttgaagttgcaatgaaaccctcaagtgaaatgcaagggtattataagattttatccctaaaggaaaccacagggaagcatattttataaaatgctgtattatgtaaaattgtgcaagtgagaggaatttcatgaggaagggaagaacgagatgcccaaccccctaaaaggaatgaccgacttgtttcaatctctctcaagaaagcacatgctggcaagaggaggcatgttctgagcaagctgcacttgtctgcccttcagagggtctcccaaaacttgccgttgagtttcattccatgactatgaacttcttaactctgctaaatgaaagtgaccaacaccagtatccttatctggaaatcacctgttagtgattgtagcagtttctttctaccaaatataaaccagtaagtagatagataaatagatatagacaaatgctgagaaacaaatctgatattgcaactttgagctttagtagcttctagctcaaggtagttgatcttaacaccatgcttaacatggaggacacttcgcaaaatatttgttccttgaatcaagtcttttgtggctgatctgggttgctttatttttttttaaagaacttgaaacgaagcagagttataacttcaatttactccaaagtgtgaggtattattttggagaaaaatagctattggagagtgaaaactacctagctgaagagtaaatggcctttgagatcagacagataagagctatggaagcagggagagtgattatgcaagtaaaggaaggtaagcaaaagtggaatttaagatgcggtgtgtgttttcctccacagactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcaagtgatgctccctcacagcccaggggcccttctgagcactgttgggcttgcccatttggtatggtcctccccacagggttctgctggcatgatgcccctaagagagaggaagccatcatcaaccagtctgctcagatttcagtgtcaaaagtttgtccagaaggactagcaggaattttccattgtgatgctgagaagttcagtgacgctaccagataccaacacttactctccttcatgccagccatggccatagctcctgctggctctccacacatgtccataagggcatatgggtgtttcttccatgtcccactgagtcaaggggagagttgatccattactgaagggtaccagagatagttccagcattatcagtccacaatcccagtggcctcctaaagctcaggctgtacaggactgagtggaaggacctctttaattatatagtgactattttgtcatttatcagctaactggaaaagtttattcccattcaaaacctactgagcacataaaagatttttgagagtatggggtatttgcagggatagatatcttcactgatgtcctgggatcctggactgtcctccaccttttcttttctctgaggcagtttgactccttgtcacaaggccctgttctaagccccgtgactccttatcgatatgtacactgcatgatcatccattccaccacgaacctcagggtgtgtctggacttgatgataagaaataaggctctttggagtagctaggcctgagtatgcgcaatgctctgagatgctattctaatatttctctatgggatacagacatttagttctcaagtgaagagtatttttttcctttctgtactggagaaggatggaaatatagtgtaaagaagagggagggcacaggagaatacccagctaagagtaaggaaagacacctgctttggactcgtgtctctgctggtctcttccatgcctgcacaccctctctcagtctgttcaatgcaactaaaggctgactctgatccatgagggtgaggataaagcaggcgggatgtataaggattaagtacctaggctacaaatctaggttgcttgcaagcccaggatgagggtgcaatttaaggaaacattcattcttgggtgagtattctatacttgcacaagattaagaggaaattctcgcttaaattttgtaccctgagcacctctcttactttatcctagtcctggcagtgactgcatgggtttaaatcttagttccactaacactgatgagcaatataacctgggcaagtctattggtccattttcatgctgctgataaagacatacctgagactgggtaatttataaagaaaaagaggtttaatggactcacagttccacgtggctgaggaggcctcacaatcatggcggaaagtgaaaggcatgtctacatggtggcaggcaagagaaaacttgtgcagggaaaatcccatttataaaaccatcagatttcatgagacttattcgctatcacgagaacagcatgggaagacttgcctccatgattcaattacctgctactgggtccctcccacaacacatgggaattgtgggagctacaattcgagatgagatttgggtggggacacaccaaaaccatatcagcaagttacttacacttcttgtctctcagttttcttatctataagatgggtatagtatcatctaccccacagcatgactgtaaggataaagaattaggcaaatgcttgtgaagaatagttcagaaacctagtaagcatctgaaatactattctcttgccattggaaggcaccactaagaatagcctcattcagtttactgaagatgataccaggaatttcaaactggcaacaacaacaacaacaacaaagacatcacaaataggcatgaaacaaaataccttttctgacagctacataactctgacacactgtgcctaatagaaaaacatcacaccacctccttttccctgcagtgatcatggttgtgtcctgaatcgccatcctgattaccttgatctttaacaagaaaacagctggttttcttttatctcctagaagttcaaggagaggcagaagtgacatgaaagcttgggatcaaacactcaagagcccccaagacaccttatcacttgtacttaagtcgcataagaaggtgaaattaccaagccacatttaggcatatttaaagaaataatgagctccaagatgagggaccacactgaaaataagaaggcattttatattcattcactccaaagaagcaaatctctcatttttaatctccacagttaggggttacaggaagggaggggggaatgaatcagaaaccattgtcaacattgtgctcatcctcttttgtctcctgagtcaggatgtcatatgctacctttggcagggtgtaggtacctacagagaagatggaatggggtaaccagaagcaatgcctcagcctgctggaggactggcactgaggaaattctgagacaacctaaaacatgcaaaagagaaagtgcacgtgttttttcagatgagtgcataactgaacaaaattttgcaagtatcaggtttcattaggaaacatgaaataaggaacttggtccccaaatttcccccgctgcttcttttttttttttaagttattctcactttgtaaagaagttccaaaactagagtcagaaaaaaaaaaatgaaaagaagcaagtcagcagattgaatttatggggtgaagaccaaattcatcacaggaggtaaacttcctgagcagaggttgttgcatgtgcggtaatttctgataactccacacactgttgggaatcagtaagcttttcagacacatgtttccagctcactgcctttcagtgtatggggctgactagataaaggggaagagttaaagaacatatgaaacatgatagagtatgttactatgttagctctccgagcatttgctaaacaaatgcatgctaggagattatacattcccactcaacaagcattactggaactccactacataagtaatattaacttggcatcttaagggataacacccttgaaaagtagaagaggtggcttctgccacctagtaatgtaaattctacatggcagaggattgacacgcttcattaaagctttttcttatacctcaggataaaacatacactcttcagcaggatatacaggctcatgatcttgttcctgatccctttgccagctctctcatctcctgctccatctgcagcacctgctgaacctactgtggctcccttgaatatgcaatatgctcctaccaaattattttaactctgattgcaatgccgtgctcctctgggtcatgctttacgtctcaactcaagcactagctcctatctgcaggaccctgactcacagatgtaggctttgtacctccattacaactgtgggtatgctattgtgtttgtttccacgtctatctccaagctatgcgttttcagtctcaattccctagttcttgcacaatgctggacatagaataagcacccaataaatacatgccaaacaagtgaatgaattgatgaatgaattaatgaatgaattagcaaaggaaccgaagaacacacacaatctataagcatgtgcagtgcttcaggacacactgtgttcataaaaatcatatccagaaacaattcaataagacagagtcaggagctggactagacctgtccaccagggccataggtttcgataggagagtgaggcagggatttagggaaagaccaacctatttaactctggtgctgggaacacagattctgagatttcatcacactttgctgtcagtgtgaacttagtcaagtcatttagcttgtttctcagttcctccttctataacatgggtaataaaatgcccacaccataagtttgtagggattacatattttatatgtatagcctagcaaaatatttgtcatgtagtgattgtttaatgaaggatagctaccatcaaatgaaaggttctgttaaaaaatgaaaaacagttttccattttcaagaaaaggaagtctattggagtaagattgcagttagattaacaccttttcttgaaatgaacttacagaaaaaatgtacatgtataattcagtccactgtatcctcctttgaactagttttacctgcttgttttctcatgcataaatatttatgtttctttgacatatttatgtgaggattatgtttttaatattctaacatcacaaagtagccttttgtttctgtattgcactttacgggtaattgttattttgccacctctttgtacaactgatatggtttggctttgtgtccccactcaaatctcatctcgaattcatatcctcacgtgtggagtggggtacccataatctccaagtgttgaaggagggaggtgattggatcatgggggcgtttcccccatgctgttcttgtgatagtgactgagttctcaagagatctgacggttttagaaggggctcttcccctttcgctttctcctctctctcctgctgccatgtaagacatacctacttccccttccgccatgattgtaagtttcctgaggcctccccagccatgcagaactgtgagtgagtcaattaaacctctttcctttatttaaaaaaaaaatgtctaccatgtaaggtagtggtcaggaaaaataaggcaacacctaggaaacattaagtatattgccaaacatattataagcactgcatgtttcttattactgttattggtgtcatcattattattattggagtcatcattattattattggagtctaggataaagtagcagttgtttgcaaaatggaagacagtacctagtggtggaaaaccgaaagttccatggagacaggcatgcagcatgcagtaggccaactgcaacgaagccaggaaatgaggactttcaatcatagaccacacacatgattgttcaagaaaggtgaaaagacattaggcaaaaattcacctcaaccaaggctgagtttcttggttcgtttgggctgctgtgacaaaataccataaaccaggtgtcaaataacagcagaaacttactagtcatagttctgcaggctgggaagtccactatcaaggtgctagcagaatccgttgtctggtgaaggctggcttcctagttcatagacagctgtcttgcactttgtcctcacatggtgaaaggggcaaggaatctctcaagggcctcttttataagggcactagtgccatccattcacctcccaaagcccccacctcctattaccattgtcttgagggttagaatttcagcacatgaattttaggggtaaacaaacatttgaactacagcatgagctaccagaataccatagcaagctgcttctcaggtcagtctgggaaatggtagctgaatgtaggggccgaggaagccaagaattacgctgtgtccagattaggttccagctggatataggacaatcagtggagcagctgtggtagcagcaagcactgaagcatctggaaagaagaaggtttctaatcaggggtgctgggaagaacagtgaacagagtacagaaccgggaatcagagatcttacgttacatcagttgtccttagttattttctgggtcacagtgcttctattaaaactgatttaaacataaatccattgtcccccaaaatgcaaacacatttgtctataatctcagtggccttaaagacaccctggcttccctaaaacccacattcaaggtgcctgaattgagttttagagtagaatttggttgaaagggcattccagtataatgaatggcaaatgtataaatgaagcataaggaatcctgttgggcccagatggagtgatcctatgtggaagcagtgaaaaatatgtttaagtaaatgtggaaagacaattggaagttgtctgctaaaattcaaatttgactgataattgatataaaaaaaaagccactgtttttgaggcagagacaaaacgaagtttcagatagtttatcttggtagctatgtataggtatgattgaagcaggtaaaccaacaaagattaatgtggacagaattgcagatgtcttggtttagaagtgatcaccattcataaagagctgaaagggaaacagatttattcaagagaaatatgcaagtgtttatttgagtacaaccctaacttttcccctaagtttaaattcatccagtcacctcccttctggaaatttccacttggtgattctgctgctacctccatatcaacaaattctccatcaggatatattatttttttgcctgttaaatctattattgttaaaatagctccactgtcagataacgacaatgcaactggtatatcaaacaaacacaactactgaaacagcaaagccaattctatttttaatctcccctcctacttaaaattattcagtagaatgatctgggcaaatctcatgacttttttgttgacttaaggtaatgacagtcctagagcttccttatgttaaagcacagcctcaacttcatgattagaatatccagtctaagatattaatcaaaagtccaagttgatttaacatcaaatacctcccctctctgagactgatccttctggaagactagtgacatgacggaggggggatgaatgccttctcctctttctcctttccctgtttacttcctcccaactcctgtggctgttgtgccttctactaggctcaaaaataaacaggacagatctcgctgggctgggctgctctgtgctttctgggcttagcagacagtttaagatggtgtccctggtaggcctgggagatttctgaagctaattctttttcttgaagcatttccttttgactctatgagttcctgtttgaccgtctcttctgaagtttcttttactcattgggtgatggattcctatttcagtggaagcttgcactgtttcctcagcctcttgacatccagcagtacacctcatgctctctctgctgaagcctcctgacccctttagacagtcccattgactataacccaggacattcccacaaagtatgctggatttaaatctggtgcacaggaaacactcacttattcctttcctggaaattctggggttgtctctaatcccaatgcaaccaacttctccctgtcagccaaaaaaccaattggtcaactctggttagcactcttttgtcactcgggagtcacatcacagtctgtagtccactttgcctttctcacatttatatcagtcactggtcttctgcgtcttcagctgcagtgaacctatttcagacttctcttgagtgaccccctggaagctctattcaccaggagtggtgttagaaagtggcatcccaaagacaagactgggcagtgtggacacacagagagacaacagctgtccccagagaagtctcttcagcaatcacctctaccactctcgtgacctcttttatgtatgcttgatttcgtagttgggcccacaagatctagaaccatctctggagaacacttcctttatacttatgtattgggaacactgagggtgtctgtctcccactctggtgtcctgatacccattttactagtacctgagtgaaagcattacagtacgatggagcctgccactcaaaccatagctctacaggttatctaagacctcatcccctcagtacactcatctgattaagtcctgtcaactgtctgtcagagatattttttctcaaccttctttgcccactgccctcatcatttttcacctggactgttaaaatagcctccaactaggctctgtatctttaatctcagcccttttgtaactattgtccacatataagcaaagtgatatacataaatgtgcagtaggtattctaccctttacgaacacaaacttgctcatagcttcctgtgtccaccatccagttccatacagagtggagacagatggctttttgttttcctgactaaacctgcctaataacaccctttttgtcatatacctttcagcctgcctgcaaagccctacctcccatttttcacttagaccaactcttagaatttcttttctctagaaagcctttcctgaacctctgctggagggtgtatcctgctttcaactccgtagctctgatatatctttatgttagcacttaacatgcttcactcagcaccgtaagatctttctgtgggacagaaagtcaatttatctttgtgtcctcagagcaccgtgcctgtacacggcaggcattttaaaagatgcttattgaactgaagccagaaagttaaattctagcaaattcttaacacattttgctaaactaatactcaattttaaactatataaatagttcctaattgatctgctccaaaataaatttactgcataagaatgaaaaattatttctaaatatcagtgcttatgggatgtcactgagaggtatatgaaatatgggcagttttctgccactgctttgctatgaaaaatgtaatttatggttctattttgatgaaatggagattatacatttgaatatataaacctaatatttgaattcaagcttttaaaaatcaaagagtaaaaaataaaattattcatttaggcacctacctgtgcttaatatttgtttggatttttacttagtaggtcactatggagtggggtttttgtttgtttggttggttggttggctgattttgtatgggatctgggtaaaaaattacagtattgaaaataaaaaagtccctggtgaaacgtaagctctgacatatttttatcctactgtgtcttcactgagtaacacttcccattaatgcatgccatttgatctcgattgccaggacaagctgtttcttagtttaattagatgacattgggtctggcagcaacctcaatcaaatttctactcttcagaaaaaatttccatttctatttctcattctgcacctcttgaaagttagctgcattctgacccctcattcttcagcatccctagctagtcttcactgtgtaaaagaaagccataaatcccagcagcccctcacatttaggatatttagacctaaggaagagtgggtttttaggtccttccctcaattccctgtacaactctggatggataaaatagattagtttctaaaggttcatcgtttatatttttaccaattacataggttttgtcttatatataaacatcttagtttgtttgcattataatagcacagcacctgagactggctaatttataaagaacagaaatttatttatttatttatttatttttattttattttattttagagacagagtctcactctgtcaccaagctggagtgcagtggtgcgatcttggttcactgcaatctctgcctcccagtttcaagcgattctcctgcctcagcctccgagcagctgggactacaggcgtgcgccaccacgcctggctaatttttgtatttttaatagagatggggtttcaccatgttggccaggataatctccagctcttgacttcatgatctgcccacctcagctcctaaagtgctgagattacaggcgtaagccacgtgcccagccagaaatttatttcttacagttctggaggctgagaagtcccagataaaggtaatagcatccagtctctggcgagggctttcttgctgtgtttccacatggtggaaaagcaaaatggcaaaaagggcctagctaattccctccagcccctttataagattcctaacgccattcattaaggctccagcctcatgacttaatcctttcctaaaggccccacctcttaatactgtggcattggagattaagtttctacatgaattttcaaggagacaaaagcctttgaaccacagcaataactaaagcactaagacacctattcctgaaatagtcaatcagtggctgggtgaacagtctccaacaagaaatgttgcaagggagtgttggcctcagatgaaggtttctgccaaactcttcttagtttatatgattctaaataacattgatatttataaaatagcatcagggactcatgtcaattattcttgttttcccattcaactactaatgtcctggttctaccccacattgattaaagaatttgcttttatacagtctgtgatatatgtgtgtatgtatgtgtacacaggtgcacacatgtttaatttacttagatgaatatcattttacacatatatatatacatatttatggagggaagtgaggatatacatgttttgtgagaccgtgtgtgtgtgtgtgtgtgtgtgtatttgtgtctgtatctatttctttaacagtgtgctttcgcaattatctcaaggtttgaattatatctaagttggtacatattatttatccagttcattcatttttcactaaaatctagtattctataattaatccattccaaaagtatttactgaatacctagtatgtggcagacactcttttagacaccaagaatgcaatcaggagcaaagaaaagtcctcactctcatgaaacttatactctagtcagggaaatcagacaaggatcattgaaaaaacaaagctcagaagagggaagggcataccatacaatgcccttaagagggaaatgggcattgctatattataaaacttctcacagataacatggaacttgaataaatctctgaaagaaaatagggagcaaagcatgcaaatattaagaagatgaaagatccaagtagagggaacaacttatgcattgaatacacatcagtgtacttgtccaatcccttctgcatggatattttggctgcctcttttttttttcctgcacattcacacaatgcttcattacttaattacttaaattgaacatttaagtaataggctctcatgcacaaatccaagatttgctctagagaagcactgttgcattgtccaataaaaagataatgtgagttgcatatatattagagtttttagtagccacattgaaagtaaaagacaggtggaattaattttaataacttattttatttaacccagtatatccaaaatattagcatttcataatgtcatcaatattcaaattattaatgagcaattgtactttttttcataagtctttttaatccactgtgtcttttacacttatggtacatctcagttctgactagccacatttcaagtgctcaacagccacctccagctaccataatgaacagctgtcttagcttgggctgctataacaaaatcctttagactgggtggcttaaacaaaaggcatttatttctcatagttctggaggctaaaaagtccatgatcaaagtgccatcatggtcaagttccagtgagggccctcttcttggcttgtagatggttatctttccattgtattctcacataataaagagaagcagcactgctgtatgtctcttcttacaaggacactcatcccaccatggggactctacctcatgacctcatctaagcctaattttcatctaaagacctcacctgctagtaccatcacattgggggttatggcttcaacatataaatgtgggggtacacaattattcaatctgtaacaacaacccagcttgagaccatacacctagaagtaggactgctgcttgtatgcatttttagctttaccagcataatagtttcctattgctgcataaaaacttaccacgaactggctaggtgcagtagctcaggcctgtaatcccagcgctttgggagactgaggtggtcagatcacttgagttcaggagttctagaccagcctgagcaacatggtgaaaccccctctctacaaaaaataaaaaaacaaacaaaaaaaattagctgggcatagtagtgcatgcctgtggtcctagctactcaagagggtgggaggatcacttgaacccgggaggcagaggttgcaaacagccatgatctcgccactgcactccagcctaggtgacagagagagaacaagagagcctgtctcaaaaacaaaaacaaaaaacaaaacaaaacaaaacaaaaacacacacacacacacaaactagggatgttaaaacaacaatcatttattatctcagtttctgtagatgagaagtctggacaaatttgctgtgttctctgctcagggtccacgaagctgagaagggtgttggctggggctgctgcagtctcattctaggttcaaggtcctcttccaagctcacgtagttgttggaagaattcactttttgcagacattattggcagcttgttcccttaagaccagaagagagcaaatctctgttttctaaatccctttttattaaagaactattttgattaggtcagccctcccctgcaggataatcgtactttttattaagtcaaagtcaattgattacagatacctaattgcatcgcaaaacattcctttccctttgccataatcaatagaatgacacccaccatattctcaggtcccactcacactcaaggggagggaattacaaagggcataggtcacagaggttcatctcagaattctgcctaccacaactatatagtgtcaaatttctccatactatatttttctgttgcttcatggagatccctggctttatgttccctccattttatttatctatctacctcctattggcttctctttcttttcaaaaccgtctagaatactaccttttcaggaatacccttaattccttttcacctcattttctgctacacccacataagaaaagtctaatgctgtgtcagtactatagtgtgccttctctttcccgatgcccaggcaaggatgtatctcaaaaaatcatccatccttgcagttccacctcatggcaaatccacggtgtccaacagtagctaggctcctagggccacctctcaatccttttacttgtgtctactcatctcttccattcccctcggcaatttattatttcactgggccacaattcaaactttactaccttcattctcaacttactgccaacttatgtgagaaaattggccaggcgcggtggctcacgcctgtaatcccagcactttgggaggccgaggcaggcagatcacaaggtcaggagatcgagaccatcctggctaacacggtgaaaccctgtctctactgaaaacacaaaaaattagccgggcgtggtggcgggcgcctctagtcccagctactccggatgctgaggcaggagaatcgcttgaacctgggaggcggagtttgcagtgagctgagatccgccactgcactccagcctgggtgacagagcaagactctgtctcaaaaaaaaaaagaaagaaagaaaattgaacttagtaggtgtgaacaccttcaatttccaacaacccatttagcaaacttttttcatgcccattctctttctccaaaatcacaggatgagacattgtgccttttcctcagtgtctacttgtgctgctgtccatcttttttcctctgctaagaatgccctttctgccactccctcttcttctatgttggactaaacccaacagctcagctcaggcatcacattttccagaaagcttttgcaaatagcacacacacacacacacacacacacacacacacacacacatttctcctttcctcatttatccaaaactacactgtgtatatcttcaccattgcatttttatcattgtactataaatacatttctatgtgtctacctctccagtacgcattgcatttcttggaaacaagaactgttaaattcattttattcacttagtacctagctctcttcctgcatatagtaggggctcaataaatcttggtgactaaataaataaatatttctttaaatataatatctcactcaaccagactaactagagcaagacatgaattcaacccatgtggaatccattgttcatcttcatagataaaccatccataaataacatattgtttacctataatgataggcatctgggcaacaaagacaattatatgattaatatgatcaaagtaatttgagtaatttgagactgactaatctgatttttgggttttattgaccacattatctagctaattagacaagagccccattcccacccacttcacctatatgaatgtctcaggtttgtgatcctgcccatttagttgatttgcatgtacagaagccaatttattccatttcagaaaacaagccaccacatgaaccagagccaaacaaaactagctttttgtaaaagaaaacccaggtgtgtattctaagataaatccttaggaaataaaaaccagtttacccagagtacatggcatagacatagttaaagtcagcagatttagagttggaaatcaaatattggcaagaaaagctattatatttttaaattatgcagtgatccatgcaagctgttattgcaagataatgggttataaacagcacacataatagttaaaataattatatattgaacagatgaacatatgataaatgcatcatttcagttcctgaaatagctgacatcctaggaagttgtgtggtctaaaggttatgtttatcatttcttcctttgcttaatgtttattttcatcaccattattgtgtatacttcagatttgtttttaaataacttttctgagaactgacttaaaattgtgggtgacctgacatggattacattgcttagatgaagggtgaatttcagatatttgtcattgtacagtactctgtggacctgagaaagacagtaattgtacagttattccatcagggctatgtttatacaatagatactgagtgagccttctttaattaaaaacaaatgaaataatgccatgatgaattgcatctaagtcttctattcaaaagtcaggactaagtataaacaaatttttgaaatccataaaatgccttctctgttctcttttccttttgctatattccccaagggtaccttggcctcttgatcttactctcagaaattctatactaaagtgttaacaaaaggaaagtttgttaaccaaatgaatgattaccttaattaatgagttattaattcatgtttaaaggtgtcactcctctcctgcacattcacaggccaatagggaattcctaaacttggaaagccttcaaaattcaaagaaaaatctcataagagttgaactgaggtgtaagaactgatttgggaatgcacaggaattgagtctgactgccccttcagttccaccaccaaagaggtgaaatcatgtgacctgctcaaggccatgtgtaccaacccaaatcttccatggagagaaaaagggacaatggggtgatggtgtggggcacgggaatctctttctcccacattgtaatcctgtcacctttcctcagtgtcattgccagcagaaagcagatcctgattccctaggtcttggtaccttccctctacttttctctcatgacttaaatgtgtgtaacttttggaagtgctgctttattcaattatgccttccacaaatattttggatatctaccaaatgctagtaatggaattcaaacgtaagtaaaatactttccaccatcaaaaagttaacaactaattgggaaagagagtgctaacatgaataactgacataatacatagttattatatataagtacataataaatgtttgcaatacaaatagttaagataatagctagcatagttactgtaatacaagaacctgataaactatgctacagaggtaacaagtagtcctctacaggaacccagagggtttatttaaaccatattttcctgtcttaaaatattttcatcacataactcaaattttttaccctttgaatttgtgtagtaagtgttggaataggccctcttacaactgcaaaactcctgaaatgtgatttgatcaccatttcaacatgcaacatttgttttcaaatactgcattgctaatggaacccattcttcaggcatccagggcaaaaaggaagactccttgccagaggttcatattgaaaatatgctgggtgattcatttagtataactgattgttcttcacaatttccaggctagaaatagtgtgctcatcaacacatacaaaaaccaatggtgctaaacattgacatccaccagtaaaattatgactggagtgcatgaatcaattagcaaaaactagagagagaattgtcaaacagtgccctattaatacaagttctatttgaaatacaaataaaaggagaagtgatgctggaagcccagcatcaaggtgtcaccaagtttggttttttctgagacctctctccctgacttgagatggccaccttcttgctgtgtcctcccctggtgttttcttcatgtgttcatctctggcaatgtttcttcttataaagacaccgttcaccctggatgttacgatttgaatgtgtcccccagagttcatgtgttggaaacttaatccccaatgcaacagcgttaagtggtgggaccttcagcaggtgattaaagcatgggactctgccctcatgaatggattactgctgttatccatacctgataaaagaatgagtttggtcccccgtctctcatgtgcatgcattctctgatgctcttttgcccttccacgttccaccatgagatgacttagcaaaaaggccctcaccagatgctggcaccttaatgttagacctcccagcctccaagcctgtgataaacaaatttctttttaaaaataaattagtctgtggtattttgttacagcaatacaaatggactaagatattggattagggccctatttttatgacctcatttaaccctaattacctctataaaggccctgtctccaaatatagtcacattctaagctgctgggggttagggcttcaacatacaaatttggggggacacaactttgcccataactttactcatattcactcttcaggggtacaaccatttaattaaaggacaaatagtcatgcataacattcactaggatgactctgaaacattcactttgcaatcaatattgagcaagatatactatgtgctggaagtgctggcaggaattgtactaataagacaagagagacatggtccctaactttgaggaagcagagttcaacatgaagagagacatgaaagcaaatatgtgcattacatatttgcatacatttggtcacattataacagatatgggggagtgcttgtcagggacaatagagttcttccacctcagtacttaagttactttaaaaccttctcagaggacatgagggttggcctcagctttggaggatgaattggagagtggcaggcagcatggtggggaagaacactccactcttgggaactggttggcggctgaatgaagtatggtaagaggttaaatggtatcagcagaggccagataatcaagggccttctatgctctactaaggatccagaacaattctgtgggccagagattctcacaattaagtgtgcaccaaatcacctgacaaaacctctgaaaatgaattacttctcacattcacttcccagaaacttagatgatcttatgcaagtttgagaaagattgcattttaggcattaagataaagttaattatgttgcccgtcctctacccctgtataattcaatataaccaatggcgtgaggtatatattacgatgtgctttatattgcattattcacaagtaaagcttcataacaatccacagtacggaagatattaatagacacatcaattaacttaaggcaaaataaacatggcctcgtgccctccacatgtcagactacataaggatctaacagagcaacacagacctgctatgagctcaccctgaggaacaggaggtagtgagaagggaagaagaaaggcctggatcaaactgttctttctccctaatttccagaacagcaggagagtcagagacgtgagctggagagtggatgggtcttgcagagaaggagggcaagccctctccactaacctcacaccattccttcttggtcctccgtaagccaaagcacaggtttagcccccagcctgggctttagtcatctacattattaaaattacaaactagtgatttaaacttcaagctaattacaacttgaaaataatacttgaatactgacttcctctatgtgcagcttaagaagaatcactcagagaaacagaggaaaacattcattgttggcttttacttaaatagatgattctaaggtttgccttggaaattcaggttttgacaaaagttataacttgagctgaccttttggttataaatgttagagattttctactcatttcttttttttattgattccatattaaatacagctttaaaatttaagtggcatgattaataagagtaaaggcaatgcctttaaaaaatgacttctaaaaaatgcctttttcctcccttctaaatatcttataccatttttaaatattctgcaatggaaaacaggctggtactaacatctaattacctaaatctagattcactcaagtagtctagtcatgatttataacccaaaaaaggttctaatcaaggaatgacagcatttgtgtttaaaattcttcagaataagaaagggaaaaataaacatttttctgcatcaatacatgtcatgagtgtagtcactgccaaatattttagaggacaatttcaataattgcaagggatttaattttaaaggaataatgaagatcttaagtgtgacaaactgttcacttaattttgaacctctactaagtttgctctgttcaatgcattacacattttcttttcattacactatttttagaaataaaatcatagcatcattatacacaaaaaacacgttcagccaaagatggcaattatccacattatgtcaacaagatttgccaacaaaacatttcaaaaataaagacaataaatgaaattctctctatgaaagattactttggcattagacaattattctgcaagtgtttagttggagaatccacactttatacttagtgaatagcatgttgactcttatatagggtcaaacacctactacattataccagtgctttctattcattctattttatttatttcagtatgaacttttgaaattaattatagcttatgaaaaactcaagctaaacaatattcattttgagagttattgaggttattcatgaaataagggtatttttaagctggatttatacattgagcaattaaagataaaaacgaagaagtaaaggaagataaaataaacacaaataacaaagtctttggaatgagacaacctaagttaagcttgggtttctcattaacttatggtgtcatcttggcctgaaattcagcttcctattgatttttttttttaaggagatttttcaaaagcctgtcttgcagggtttgggtcataactaactgatatggtttggctgtgtccccacccaaatctcgaattatagtttccataattcccatgtgtcatgggaaggaccctgtgagaggtaattgaatcatgagggtgggtctttcccatgctgttcttgtgatagtgaataagtctcatgagatctcatggttttatagagggattcccctgcacatgctctcgctcttgcctgctgccatataagatgttcctttgctctttcttcattttctgccatgattgtgaggcttccccagccatgtggaactgcgagaccattaaacctctttactttataaattacccaatctcaggtatgtttttattagcaggatgagaacagactgatacaataactgagatgatatatagtctgataggcagtcaatttgttaccttccatcatcctccttcttatgatcttatagtaagtttccacattgtcttgaagatattataattattaccatgaatagacaaagaaacagcaaatttgccagttgggaataaaattttagtaaattatggattcacatatcataagatatagtagaggtcagtttccctagagggacagcctaagatggggaatcttgtgcaagtgacctattgaggaagcgctctcaggagaaatgagtaatggagtaaggaaggttggataagacagaggaagaaactaggagaaatcaaatattagccatatcccacaggggacctttagaacataaattttcatccaaatgtgcatggtccccctaggaggctagcataccccagtagtactcattcattggctattggtcatcacccttctgggaatttgggacaggatctccctggcatctcagaaccagcaggctcttgtagaccagggataaccaacactgcctgtagctagggcatgaatgtaccaagctggtggaggagaatttgacaggacaccaatagtgactactataggtaggagaagaaacactgatttcaaccatgtagattttattctaaagcatgtcttccaacgtagagtactcccaacttaaacaagaccagaatagcaattcagcttttcaaaacaaaatacaagaacaactactttttaaaaaggtttactataggattctttgagcaagaaaatattcttagaggccgggcgtggtggctcaagcctgtaatcccagcactttgggaggctgagacgggtggatcacctgaggtcaggagtttgagaccagcctgacaaatatgatgaaaccccttctctactaaaaatacaaaaattagccaggtgtggtggcatgcacctgtaatcccagctactcaggaggctgagacaggagaatcacttgaacctgggaggcagtggttgtagtgagctaagatcgtgccattgcactccagcctgggcaacaagagcgaaactccaactcaaaaaaaaaaaagaaaaaagaagttattcttagaacacctcacatatgattttatttataaataattgatttgcctacaaatttaaggaattagagaatccatgtgaccttctccagtagtgctatgatcctgggaacctaccaagtgtaaagtggatgttgtatctatactgtggggcactatattttactgattctgaaattagtacaccctgactgatactttgaggctacttactgggaaaaaagaccatttcataccagtcttgtcctagaagtagggtaataaatgattctggttttcacctgggactgagagtatctcccctggacatgggaccttccattttaaaatctagataatactgggcaaatcagaactagatgatcacactatgtggaatttatagcaagagggttcactattactacaaagtaagaaattagcaaatttggatctttagcttgggactatatagatgcataatttgcccatctgcattttgaattgagaatgaaacaaagagttttaggttttagatcgtcttccccacacacacacacacacacccctcaggcccaatgaatatttatatcaattttctagttacatagcaggatttctgtcaggtgccacatttgagtgttcttaggaagaaactgaaaattcctaccagttcctatgtgtcatccctgacttctctcaacaggtgtatgagcaaagatttatgattcagaaatgattttttaatgtactgttattactttctgtttctgacaattgagaaactagaattttgtcttctcttaatttgaaggctggctttcttctttttaaaatttaggaaggcacattgttggctaaattaattcacaattgggtttagtcagtgtcctccaaagcttatggttatgtagtgccaagaaagaatactccaaattttaaattattttcctagagcaatataagatatatattttttttccaaattctgtatatgtagaattatataaataatatatacagagagcatatatagaatatagaattaattacatatatgatatatatcacacattgctctaggaaataatatatataactacatatgatatatattttatgactataatatattattactatatatatatatctatatatatatagatatatatatctatatatatatgactttcataccatttatgtaacttagactagagaagaaggtaaaacacatcctggttttcacttaacttcagtgtctttccccaaaacatcacctcacagctttttttttttcctttggtccaaggcaaattgctggtatctcagcctcagagaaaatcacaagtgagatttaacttcagaaaagtccagcttatcctaaagagaatgaaaataggtgacgatctctctggaagcaagtctaacgaagtgctttgccctcaaagggtacagcatgtcctctatttcaatgaagtttaaagaaaggccatggtggaaacaagccatttctttcaacaaattgcttgattggctgccaattctgattttattcttgccttgtaacctttcacatgagatgccctcatcccagtaaaactgctgtaaaccttgcatgaaatcacctagtgatttgctgcaagaaaaagtccactcaggcaagaaatacctgttacgtctcagttaatatccaacatttgaaaactgcagagctgatacttgcttttacctgctggccaattcaagatggtctgggtccctgtcaacatttaagctagtatgcatgcagttacacatcctaaattacttggcgaataacttcttaacatcataggctttatactagccttatacacgcacatctttataaggagccaagctttgcagatgacacagcatctctaaggatagaggttgaatccaatcactgcacttaatggaaatctctcaggagtaaagagaaccgtgactatctttggtcatcctttgatgcttagatatgaataatatttagctctcatcctcacaacattcctgcactgtagatttttatattcctgcttgacaaatggcaaaatagacctcagttggtttgatcaacttgtccctggtaaaggtgcaggtagatttgaatctggggctgtgggaaaccaaaatccatgctgcttctgttgctgcttctgttctaccatcatgcctccattaaagaaatatgttcagtgtgtttaactgagaaattcaccaagtggtacagtatgatcattgaatatgagtttttccttttcttaggtcctaattttattttacttttcaattttttatttccataagttttaggggaacaggtggtatttggttacataagtaagttatttagtggtgatttgtgagattttggtcacccatcactcaaatagtatacacggaacccaatttgtagtattttaccgctcacccccttcccactcttttccccctgagtcaccaaagtccgttgaatcattatttttttttcttttttgagacagtctcactgtcattcaggctggagtgcagtggcacaatctcggctcactgcagcccctgcctcttgggttcaagcaattctcctgcctcagcctcctgagtagctgggcctacaggtgcacgctgccagacccggctaatttttctatttttagcagagacgaggtttcactatgttggccaggatggtcttgatctcctgacctcgtgatctgcccgctttggcctcccaaagtgctgggactacaggcgtgaggcatcgtgcccaacccattgtatcattcttttttttttttttttttttgacggagtctcgctctgttgcccaggctggagtgcagtggcacaatctcggctcactgcaagctccgcctcctgggttcacgcttttctcctgcctcagcctcccgagtagctgggactacaagcgcccaccaccacacctggctaatttttgtatttttagtagagacggggtttcaccttgttagccaggattgtcttgatctcctgacctcgtgatctgcccacctcggcctcccaaagtgctgggattacagtcgtgagccaccgcacccggccccttgtatcattcttatggctttgcatattcagagcttagctcccatttatgagtgagaacatacattgtttggttttctattcctaagttacttcactttagaataatgagtctccagtctcatccaggttgctgtgaacgccattaattcattcctttttatggctgagtagtattccattgtgcatatatatatcacactttctttattcactcgttgattgatgggcatttgagttccttccatatttttgcaattgtgaatttgtgctgctataaacatgcatgtgcaggtatcttttttgtttcatgacttattttcctctgggtagatatacagtagtcggcttgctggatcaagtggtagttctgcttttagttctttaaggaatcgccacgctgttttccatagtggttgtactagtttacgttcccaccagcagtgtagaagtgttccctttacattgcatccacaccaccatctacttttttaaattttttttattatggccattcttgcgggagtaaggtggtatcgcattgtggtttggatttgcattcatgaagcccgaatgccctgccctcagtgaatcaaaagttaatcaggagaagcagacaagtaagcaatcgatttcatgcagccatgtgtacattaatagggataattgcaggaaactatgggaaccctaggaagaatgctaaccctgtctctgaagtttaggtaaggcttcttggaggaagaaatatcaaagatgaaaggtgaaggacaattagagattatcaaggtgacactaagggacactaggtcatcctaagcctttcagtcagggtcaatgtgataaactggaactgagagattaatgagaataagtagtatcacatgtcaaatgccacagaacaatggaaaggatatgcaaatgcaaatgagcatggagcaataaagaataaacagactttaaataaacatattctaaatcaaataagccattgcaaatcctcaacactggtctatacaatagcagcccagaaggcccttcagcatgccgtttggcctgaaatgcattaaggatgcagaggaaaatatttgaatctgatgtcacactccaggcctctgtcaatgtgacatttttaaaatactaagcaaaatattgatggcagatataaaatggtctctattccctatgctaatgaattgaccattaaatggaaataagcagcctgttttaatgtttagatgcaagcgcttctgaaaacactcctgtcttggcactgggcccgggtacctgggggatgtatggcggttgggtggaagtcctgttagaggtgacagcatcagcacataacatgcatcttttaagagcatcactttattaactttttgattgttgagctcccactacacacggtttccaaaatcatttatattcagtactgattgctcaaacttgcacacgggaacaatccatggcaagaacttaaatggcaacaagattggtgtaaaaaatgtgacacaagacaaagagactgactttctgcagcagcgttattgaaggatgaggcttaacaccgtaaaagaactaaattcacttgctgcattctctgcaccaaaaggcagcaactcttcgattgctcccaggatgtgtgtttccttctctggaaggtgttttatgtttctttttaatgccttggtaatgacactattaaaaattaaattggaaatgtattttgattaatatactttcaagggagtttgctaattagagatctgcaaagcccatcttttatcactggtttttacttattataaaatgttttatacaatgatggctgatagcaaattttgctccacaccaagagagagaatgaaactaagctggatctaaatgagaacaagcccaacctattctaattaacatgattccattgaactgtaatgttattgaaacaactgacttttaccatttcaacttaattattctacaataggcagaatgtatgttgcttcatgcttaaagcaattttgaaagcgacatctttgaagtatggcatcaagcagttttttttctcactcacagtttgtgaatattgttttaaaacatcattaagtcaaataaccatagtctaattaagtcttttgtagttttgaggcggtttcatgaaatgccacgggatttatttgactcttttcctcacttgactgaaagttcttgagaggctgagtgaattgaagccccagaatcctcagcctgaggaaataaatgctgaaaagtatttgagttgaagtagtattgcttaatgtgatgatagaaacacgaaactgaagggcttgctcagcaattctgctaaaatatcacgatattacttaggcaagccctattcctgtctttgtgctcagatgggcacagctgcaaaaggattagttaagaagttgtaagtaaatgagcacttggaatttaaatgataaaagcctgtcaaagaatgataaaggacccctagagctgaaagaaaaagtacattactattttttttaaatctaaacgtatttgcttgatggacaagagagtaccgtatccctcaagagatgggttcagtcagtctcctgtgtctgaaaatagttgagctagcagaagaggccaaaaaggagactttgttccatgttagaagagtctctaagcactacagtctaactgattcactagagaacaggacatacttctttggccatttttctgatttaactttcgaaagtgcagtgttagctttcaaagaggtccaggatgggttcccaaggctgttgggtgctggattcagcccttgttgggaattggggcaaatttccaggccaaatagaggaaagaatagaacaggtgtactgttagtgattgctttgctcaaaatctttaggttatagaagacttgggagccctgtggggtaaactgattttcccagagtcactgaagtcttgttacttgcaggaaatccaaagttacgggagactgaggttgggcaaaatgaggttatattgtgagccaggtgaaaccgcaaaagcctttgacgttggaaaatttgacagagaagggctcatgtttcaaaataatttctgattaaagtatatcatttttgcatcttctgaaattatagcagtattacatatatcttggaagatcttcggaattcagcttaattagctatattaagtatcatctattcctgttagttgtaaaaggaatagtggggccaggcgccgtggctcatgcctgtaatcccagcactttgggaggccaaagcaggtggatcacctgaggtcaggagttcaagaccagcctggccaacatggtaaaaccctgtctctacaaaaatacaaaaattagccaggcatgatggcaggtgcctgtaatcccagctacttgggaggctgaggaaggagaatcacttgaacctgggaggcagaagttacagtgagcagagattgtgccattgcactccagcctgagagagagcaagactctgtatcaaaaaaagaaagaaagaaagaaaaaaaggaatagtgggccatgaaggcaaatggtgaatgcacactacacctgctcttaaggaagccatcatcatctggaggaaaatgcacacaacaaactgtaatacaagactgctatgatgtgggttataatatgatatattaataaataaaatactagtaaaccccaaagaaaaaaactatgcattccatccaaaagggttcggaacagcttcggagaggaggtgacatttgaattgaccttgatagattctatcgctcattcaacaagaacttagttaggatgtactagttctgcgaaccgtccttatttgttgggatatattagtgtacacaagagatacccatccctgcctttgtgatgctcgctttctatcaagtaaggtttctaaaaatttactgggggagagaatttttagggagagagagtactgggaacaaattcgtgaattattatgtgcacaaagtctggggaagcatctacatagttggaacacaaagtttatgtgtagtagctattggggcagaacatggcagtagatggaggtggaaagcacagcagggaaaagtcataaatagtatattagaaaggtgggggctgggcgcggtggctcatgcctgtaatcccaacactttgggaggccgaggcaggcagatcacctgaggtcgagagtttgagaccagcctgaccaacatggagaaaccccatctctactaaaaatacaaaattagctggatgtagtgttgcatgcccgtaaccccagctacttgggaggctgagaccagagaatcgcttgaacccgggaggcagaggttgcggtgagctgagatggtgccattgcactccagcctgggcaacaagggcgaaactccgtcccaaaaaaaaaaaaaaaaaaaaaaaaaaaagagggattttattctccaggcaattaaaaattttgttccaggaaagtgctcttatgaagaatctgaaacacaaagcaagttataactactgtttattgttgccatgctgaaacactggaaaatgcacagagatcagcgtaaatgcctccaggactgacgggatgcaggaggtcctgggccatgggtacagccctggtacttacaggcctccttcagatccatattaatgtatgagctttggattgctatggttgtgccagggaatctatcaccaggctagtgctccatttaggaaacgatgggggaaaaaaacttggtttgaggccatgctaggggttgttatctaaatccccagagaatgacctatgaggatatggtgaccccaagaataattataacaactaggatctttgggggcaaacctatttttttcagggcaagcagtctttgaaaagactcagcagatctcccttgcctacaatatattaaaaaccattttcccatagcaatctgtattttgcctgaaaatcctctagattatagggttatgggatccaataagtacatgcccaaccatatgatgagagcatttcaacattccaataactatactgaaataaacaaatatgcagtttgtcagaccttgtttatcatcaatgactaactcaatgttttcatcttctcctaaaaactacattggccatactagccacagctcactttcccaattttataagacttttattagtgttactatttacctattaatttcctgtatatgggtggtggatggatagatagatagataaataccttaatcatcagagtaaacttcttcagaactgtaatcagaccccaagcttaataactggcttgaagttgtctggtgggattggtcagcaaacatgagtatcagacaaagatctatggagctgacaagctttgagcccttttccagtgattcttatggtgtagtgtgaggatcttcttttttaaagctaactaaagtacttatttaaaaacagtgttccaatgattttgtgctcatttaaaatgtaaaaaccactgcactatattattgatgacataggagggcagttggtttttcactgacaagcagcataaaagaaattcctgagatagggcagggttcattgcaaactgctctatgagtaatcacgtatctgtaagggagttgaggagatcttaagtaggtcaagatcataagggaactggatttttgttaggcttccactcggacagtcctgtgttagatgctttgaagcactatctcttttcattttcacaacgactagataaagactattaatttttgcaaatgaagcttgaggaagttaagcaacttgcaaagaggcacccagctactcaaagatagagccaagattcaagccccagtcatttgattccaaagtcattctccaaatatgtcatgctcagactttaaaacttgatagcaattaaaatgctatttaagtagcattttaaattactattgttatgctgaaagtgtcttgtttacaatgtcaggtttatgactaaaatttgtttgtaaacaatatgtgaaaatcaatgcatagcctattagcggtatttttaaaattgtaaatgcaatgtgattctttttggtgaggccaatagaaacatattaatttactgtttatattaaattatcctgttttatctcaatctttctgttttccatacagcttttcaaatcacaaagtaattctatcatggattgccgtgtgatgtgttttataaaagccaagcatcattgatatctcagaatactagaaaaggagatattttgagttggtgagaaatgaatgcactgacaatgtactgaagggaagagaatgtagggcatattcaagaagtttcaatgtggggagagttgtgtgactagaggtaaaggactttaaaacatgctttactgtctcacagttaaatctgaagtcagcaaaagtcacccacacttatggtaatgtggtaactctatgagcagaaacacacaagtaatccaaaacagaaatcctagaaggtaaaaccgtcctgggacccatttaatccagtggtcaacaaacagaatgggacaggcaatgaaggtctgtgaaaggcattgctagcaagaagattagaggtgtttcaacaaactagccaaaggtcaagggttcattttctagaaatcccttttactctaaaccctgatggcaaatagaacgctatgtgtcaattccagttggcctgagaccccttgcaaagaggactgcacaaaaaacgctgaaggcttattttgtttctactcctgcagacagcccattctagccttgtgacattgacttgcaggagaagctgctccatgctaggtgaaccagagaaactgagaaataggatcctggaagccagagcagaggctctttgtctttgtaaatggaacccagcagatccaagagggatccacttgggcaactcacacttcaaacatgccactaaatgagtgagaaatcaggattttagtgatgatagaaaatttttaaattatttctccttttattttgggcttgagaatgttttctccttatgacccatataaagtctagagttaggatgtaaaatggagaaataagcccacatgctttcatttctttcacatcatctcattgatggaaatgcagtttggtgaagaaaaagaacatgagatagactggttctgaacccctctgggtacatcttactaactttaggatctctttcctctcaataaactggggaccatcctacttaccttatctagatgctgtaaggaccaaatgtgattacatttatgccactttgcatttgtcagtatataattttataaagttatcaacacgactctcatgcaaacataatgtaagcatgtgccaaaaatacacttaactccttaatgaaggaaccatctggatggtaaatctagttcaaaaaagaatcacagaaagagtggttatatagtccaacaggagaagctaatggaaatgaatatctgagttaaagacaaaattgattattgttcaacaagcaataaaaccataacctttgaggtcatcttctgtactagacttgcatcagttaggtctctgttgaacaaaaaatatctaagtccacatgtaatttcatagtcttgaccttagacaatagaaaatagtaaaacaaacaaaagtacaatcctctagaggattaaatcatccttgggtggacctgttaggcaatgatcccatgtgactttgaaacgaaatacagtcgttgttcttttgttttatttccaagttttagataattttctcagcagttccctattgtgtcataaataatttccaaagattattcatattaccaaaagtctgatgtcattgtgcttagacctgattaatttacatgggggcagtgcaagatgttcattgaccatggaagcctctggatatgggtagcaaattcagagctgctgtttcaagcagctactaaggacagaaaattaacttctgtaagaaaatttcaaaagaaatctctcattgcattttcagaatcctttctccagaattttttttttctcttactggcttttttattccaaggtgtttgagtttcctattgctttttaggtgaattaccacaagcattgtcgttcaaagcaacacaaattaattctcctactgctttggcagtcagaactctaacacaagtctcattgggctaaagtcaagatgttggtaaggccgattctttctggatgctgtagagggaaatcagttcccttgcctttcacaaggtccagggattcctgtaatccttggcttatggaccctttcctccatcctcaaagccagcaatctttcaattgaaagtagcatctttcaatttttcagtctctttctctctgtcttctatttctgtcatcacatcatcttctgtctctctgacccttcctgggtcccttttataaggaccctgtggttacattaggcccacccagataatccgggatgatctccccactttaagatccttaacttgatcccatctgtgtagcttctgttgctaccttctaggttccagtgattagaacatggacaatggggaaaagcatgacatttattcaccctaccacacaaaggtaagaaactccattcaagaaatgcatctgcacaatattcctatagcacctagacattttggtgaatttctctgagtgcccaacatctgatagatttcctggtctactagaaaattgtcttcctttttacctgtaagtttatgatcgtataaatcatagaacaaataacagaccagtttccagagagggctttctgaatcctggttccacatttgaagtacagcactttttccttaatggtgggtttgctacacctgattaaataagatctgtattatttgtaataaaccagatacattcctggcatattagtcaggattctccagagaaacaaaaccaataggagagagagagacagagaaagagagagggaatatgatttattttgaggaattggctcattcaattatggtgacagagaagtcccatgacctgccatttgcaaactggagacccagaaaagcagatggtgtaattcagtctgagtccgaagatctaagaaccaggggagctgatggtataactcccagtatgagggtagtagaagatgagatgagatggcctagttcaacaataaagcagaaaaaaagaagcaacttcctctttccttcacctttcattcttcttagaccctcaacagattggactggatgatgcccaaccacagcggagagagcaatcttctttattgggccccccaattcaaatgctcatctcatctggaaacactctcacagacacacccagaaacaacgtttaatgtgggcccatcacccagtcaaattgacacataatgtgaaccatcacacctggtgtgaccttatttacacagccaatttattcaactatagcctggttataaaaaggacaaatttgtattgattttatacaaataaccacattgccataaaagctagtaagttgtctgtgaattctgagtggtcagggagaataaggtgccatataaagaatgtgtcatttataggttaccaaagagagagttaaagagatcaggaagagaatgaatctttttattcttttaataagatatgtaaagctatatcttattaaaagataatatattattatcttattatttaataatacctttttatcttatttattattatttaataatatcttattaaaagaccatatcttattaaaagaataaaagaaatgacccaggtatcccaagatatcttataataagatattaaagccatataaccacaattagattcccctcagcagttcacttaatcctacttgtcttataactagtggatgttggatcaacacctggttttcaaaggtcttctgctcctggactattaaaaagagtcctgaaaatcctgattccatcctctagtacagttagtcatctaagtgacaccttaatatccaaagtctataccaatgactgtttgaagtgccaataggttaagagtattttttggcaccatgtttccatgaggctctgatactgccattctctgacaaaggctatttccagactgtagtttatagcaaaaccttcagaaaaacatgagagtaaagcagaaaccacgtgttgatgatgggaatgaaagtgtctgagacgatgacatagaaggtaagtgataatttatcttcttgttaagagcaggctaaatattccattttaaaagagagaaaataaaactatagtgttacattaatgcagtatttggcagaaaaaaagattcacaaaacttaaaatatctatcttattaatgaaccaattaaagctgggtaaacttcgccaaaattttaacacatttccttgtttttattcagactcattacgtgcatatattatactccgaggtaaataaaattctgtttcctccaaccttctatactccacacacactcatgctttgccattcactatactgtttcatactttggaacatattttcttttcactttgtaaacaaaaatataccccattaccttatacacatgagcttgcataaaacaaccccctagagacacatacattctttgaacatcatcttcaaagtggcaaaaccaaaatgctcattaacatgactctaagttacagtttctctgtaacatatagaaataataagacgtatatagacatttataggtataagcagacatacacacactaatggtaatcatcatgccaatattatctcttaatgagaagcaacccagatatcccaagattatccaccagttaacttcttgattttacattagctcacgatctgaaacgtaatagaaacatggaaattccatgtcaactgataccttataaagtgtaaaaactgtttatataaaaattttgccaaaattctaactcaacataattacatataattttaaatcttcattttaaacattatgtgtcaatgctatcttgtctcattggtaaaccagtataagaagttttaaggagttcagattaactagcctcttttcaggaaaccaaaaacaaatctgtaaaacaaaaaagtacatcagaactctataattcagagtgataatattaagggagagatatgtaatgctatttaagctaatttttaaaaaaatcaattaaatgtggtcaaatatgcactttggttacatgaacttgcatttttacatacaagcaatttctgtgaactttttcaagggtagcaatacaatgtatttaaacttcagtttctctgcaacatgagaatcctgagaatattgatataagtaatcaaatctataaataataaaaacagaaaatccttatttcacaaggttttattcatacacaatgaggtgaaaaggcttttttttttttttaatttccagagataggcagctattgagggttgcagttttggttctataaccttagccatgtcttgaaaggaaacatagaacacaataactcaggaggacagaaaggttggttgtcatttccagtgaacctgagacataatcttgctcagacaaaagaaaagtgctaagaaaccaggttttcagtcatctctcaccctgcaaagagttagattacctgcatctagctgatagatcaccatatgatgagaacgaagtgccaggttcacaattattcctgccaccaaaggaaaacttaacagccacatgcagatcagatacacaagacactagtatccccgtgactgtgttcatgagacttgcctagcagtcaaatacccactacttcatatactcagctatgacccaaacgaggagacacaaaatgctcttctcagtaggcagtgaaagtggcacagtggtctgagaccaaatacaggtgcctgcacccagttgtggaggagaaatgactgaagctgtgagttaggtaaggcacttctcgactgacggacttggccaaaactcagaatcaaaacacataatcacaagacaagacaagacaagacaagaaacaacagagacagagagtcagcagaagtaaagtttgttgctacttagggtttgctctaggactggagtgttgtgttttgggtttttttgttttttttgttttgttttgttttgttttgttttgtttttaaaaaaagatgtttctgagcttaaatggcccataacattggctctggcaggtgagtgtacttgggcaccatcgtaggaccatttccaattttaagccagttatatatgtgactctagcacaaacataagaaagcaagtattgaagatgtgtctaactgagggaaccagcaggatgataaagcttgctgtaaaaagacggagaggcacggtggttctagaggccaccagggaagtcaaagcatcaggataaatagctgatgcatgtggggcttaacacctagctgatgggtggatatgtgtggcaaaccaccacacgtttacctgtgtaaaaaaccggcatatcctgcgcatgcaccccagaacttaaaataaaataaaataaaataaaaagctggccaatgtccgataggtcaatacaattataatttttcaggttatcttttctattagatggaaatcatttacatctctgccacatacaaatcctataaattaacatgtaatttcacagaatctgcatcttaaacaacagtaaatttaaaaataaagagacacctctttagagaatcaaatcacccttggatgaggctattgtactatggccaccatgacaaagaaggtcacacaatcttttttttttttttttgcttcattttcaagtttttataagttttattaaaaaatagaatagtcacttaaaaacaatttttttcttcaccttgatctagcaaggaaagttaaccttgagtttgccatgagccttccatacacaatgttctcagaagaaaacatagtttccaatatataagtgaagaataagaagtctctctcaataggaaacaatttattcagtatggcaaaggacaatggctatgtcaaggaaaattctaggaagggaggatttacattcttttacatatttaaattccttttcaacagatgctggcgaggttgccgagaaaaagggatgctttcacactgttggtgggagtgtaaattagttcatccattgtggaaaacactatggcaattcctcaaagacctaaacacagaaataccttttgacccagcaatcccatcactgggcatatacccaaaggattataaatcattctattataaagatacatgcacacttatgttcattgcagcatgattcacaatagcaaagacatggaaccaacccaattgcccatcaatgatagactgaaaaaagaaaatgtggtatatatacaccatggaatactacgcagccataaaaaggaacaagatcatgtcctttgcagggacatggatggagttggaagctgttatcctcagcaaactcatgcaggaacagaaacccaaacaccgcatgtgctcacttataagtgggagttgaatgatgagaatacatggacacatggaggggaacaaaacacactagggcctgtcagagatgcggacaggggagggagagcatcaggaagaacagctaatggatgctgggcttaatacttaggcgatgggatgatctgtgaagcaaaacaccatggcacacgtttacctgtgtaacaaacctgcatatccgcacatgtacccctgatcttaacacaaaagttgaagaaaaaaaaattccctttcagaaaaaataaataagtaaaagaaatcattttaactaatgacattaagagttgattatcataagagcccagagttaggtgctagccccttacttccctaataataaaatatgtgcatttaatttggacaataaatatcttgagaaagaatatacaaataagatattcatgaaaccttttatttttcttcttttacctcttgattcctgtctcttgattatcagataatgtgtccaataagaggaatgaggaaaactcacaatatttgatttagttgctattaagcagtggtagacatgaagatctgatgcagggtagaaaataaagctctttcctaaaatagggacaatagtttaagtattgttttctgttttaagtatactataattgtcccctctgcaaatgcttctacataaggcaagcacatggtaattatggataatataattatatatcattatctaaattgtatatgcttcagccctgtcccagaaaaatggattcctcatggatcctatttatcacatccaggaattagtcattgcatattcaccctaatcaatagtgtattgatgattaataaatgcttatcaacaatgagtttgcagaaaaacaaagaacatatacagaaatgcagctaatctaggggatgagaggcaggaagacatgggtaattgtgccagtaagggaaatttgacgttgaaggtcaaagatatttcctttcagtgaagaaccacacagggagtctatgtagatatttgaggcagagaaggaagcattgttaaaacatgaaaagggaacttttttgccacttggatgagcaggagaaaaagcgagaagtgggaattactctgcagccgtgattggaacactaagttcaagaataaaatcaatgcaagagaatccaaacaaacggacacaatagtcacacttagggaatgaaattggatttctgatctgggttttaagaccccgctataagccatatgctcccctaagagataaatgctaccaattctgtacattttcagagacccctgtaaattctggacaatgtaccaaattgactcacaacatgaaccccataaaggaaaagttgcctctagaaaaaacctttctgaaaatcctatagaatttaatgaagataactacatcctttcaaacaggtcaggaggacagttggaacagtaccttgtttagaggcatgaagaaggggcctgaaaactgacttaattcaaacccctaacacagtggagatttccactcaaccaaagcattacacaaattgttctcagctctcagacagatattgtaagcctaacacagcagcttatttcatggctctcgtttaacccatcaatccacaaagccagcctttggcttgcaaaataagaaagaatgaccagagtacaaaaactagaattgaggtgtgacggggagaaaaaggagaatgcaatgccaagaggtgtacctaaatagacacaagaggacacctcctacttgtattcattgctgatagtttttgtcccattgcagagacatgattacctggatctcagccggtgtggcaataggtgttactactgaccataaagatatgccattcaattttaaagctagtgccagtgtttggtattatggtctcccttggcaataaactctagagactaggtactaggatctgaagaagtatttctttttatgtgttacagtacttgggcaacatctagtttgccatcgagacagcttagaggaaaaagttggagccttttcttgtccacatatcattccctaccattgatttaacttccagcactatcagtggtaaagtatccttttgtcataatatccactctatctgaatggtagccagaaaatatgctttggccaattatactggttccttacatttaagctgatttcttaacatactctttatgaaattctgtctatcctgctgtggaactattttcattaatatttaaaggtgtgccagttggtgggacagggaaatggaggaattgtgctatccctgtgttcatatttgggcatatgaatatgactgtatacattttgttctatgagaactacccactaaccaacacactgcttacaatattgaccttctccaagtcattctcctcaattataaaagagatatcaaatgatctccctataatgcacatctgaccatggcaacacatgtttaaaacacccccatgattccccaaaagtctactgagcaatgtctaagcaaactagcatgcttcataacgcctttataaacagactacttgccttcctaggctcatttcgcatcatttcttactttgcattagtgtctcatggcaaacttataatttattctttatttcatgtttttacccagcacatgaatctttgcttggtggacttatcctttgtgagctcaggcattcttgccttcaggaatcttttgctgactctttccctgcagttgggataagtgcttcttctccatacttctctcctcaatattctatgcaaatctttatcctcaaacctaaagtgctttatggaaatccgttaatgtgtttgttcctactaaactgtaaacttctaggggctgtattctcagcatacttccctgcacagagaagatattcaataaatggatattttccaaatgaattaatagtgaaaacataattgaaccaaattctgtagtcttttctccccagccagatagtaatatgttttacattgaaatttgagtataacaactgtgttttatgttttatatagcccagcttccagatcataggtgcttcatgaatcactttcattaaacccctctatggtatcttgcctatgattgtagaattccagagctaaagctcgttttatgcaaaatcttcacttactgtgcatttctctgtggcctaaaaaagggacaaaatgactcaaccaaggccgcaaaacttgatagtggcttaaagactaaatttggtttcttgactcccaatcaaagatatttcgctatttttagatggaattatgagttgagaaattatgggttaaaagagagaaacgagtgacagaagacagaaaagtaaaaacacaaattaataaaattttgttttggaacaaattagagcgagaaaaaaattaaagtgcctaagggctatgccattttgttaaatactaaagagaacacaatttagtaagataattaggtttgactgacaagcttccaatccaattgaggatataaggatttccaaactgaaagtgtaaaggtaagtggtaataagtacaaaatcacatgtgaaaacacaagcaatactggtcagaggggtgtataagctgggaggcctgtgcctcaaagaggagaatagtgactgtggaccaaaatagcacaataagccaatcttgaaggctggataggagatggagaggctgagtggaggctgcaggctgggatgaatagcacagaggctggagagcccaggcctgttccagctggggctgtgcataggggagcggtggtaggaaattctggagacgtagcttaggcaaaattttcaaagacctctgtattatccagaattctccagagaaacagaacaataggatatatatacaaagaggtttactatgagaaattggcacaccaacatggaggctgagaagtcccacattctaccatctgcaaactagagaccctggaaagctggctggtgtaagtctagtctgagtctaaaggcctgagaacgaagagcatcgatgatgtaatctcctgttctcaagaacaggtgaaggccgctgtttcagctgtcagtcaggcagagagtaaatgctctcttcctctgcctttttgttcttttcaggctctacatgaattgaatggtacccactcacgtggagagggctgtctgccttgctcagtccaccatttcaaatgctaatcttttttggaaacaccctcacagacacacccagaaataatgtttgactagatatttgggcatcgtgtggcctaggcaagttgacacacaaaattaaccatcacaacctccaacgtaaagtcaaggtttagactaatttgtaggtagaatgaatccattatgtactttatgtgctggtgaaaattgcataaatacgaaaatttacttggggaccgtgaatctggtcgtgatttgtaaaatgaaatacagcacagccaagtaaaggctaaacgtgagatagtaatagccaaactctagaattatgaaagtgggaaaagtgagagacagttataaaaacaataaatgttaaaaattaaaacgcctcaagttcagtagcttgcctgaagttacactgcagatattcagccctagaggtatggaaaattcactgcattgctctgcctcttggccaaatgggtaaatacattcaacatatatacgtggcgcaaataactgcaaatacagtgtaattcttcagaatcttcccattttatgcatgtctaatgaatttggtaaagtcaagagggagaaaaacagctaagtggatacaaagatctgagttttcctttatccctatttgtaagtgaaactcaaatcaacaaggttgccaaaaatcacctaatgattgaagctgaagactctcccaagggccaccgctttttatttaataaaaccaccagagatacccaatgtgagttctgtgaaaggcagactattgtgaattttttgttatttgaaatgatgttgatatgtagggtaggaagaagaccggcaccctcaaaagttacccatgtcctcatccctggaacctgtaaatgttaatttatatagcaaaaaggcctttgcataggtgattaaggatttttgagatggggaaattatccaggtgagttctatttagattgtatttacaatcacaagtgtctttataagacagaagcagaaggagtttttttgtttttgtttttgttttagacggagtcttgctctgtcgccaggctggagtgcaatggcataatctcggctcactgcaacctctgcctctggggttcaagcgattctcctgactcagcctcccgagtagctgggattacaagcatgcgccaccacgcctggctaatattttgtatttttagtagagatggggtttcaccgtgttagccaggatggtctcgatctccgcccacctcggcatcccgaagtgctgggattacaggcgcaagccactgcgcccgaccctttttgtttgtttgtttgtttgtttgtgacagagtcttgctctgttgcccaggctcctggagcgcagtggaaggatctcggctcaccacaacctccaccttgcagagggagcttttatgcagacagcaggggaggaggaaatgtgaccactgaggcagagattggagtgatgcaaccacaagagaaggagaaatgccagaagccaccagaagcagaaggaggcaaagaatagggtcttccctcgagcctccagagagagcacggtcccgctgacacattaattccacccagttaacactgattttggatttcaggcctccataaccttgagaaaataaatttctgttgttttgagcacccacgtttgtgattacttgctacagcagccacgggaaattataatgcccaaatggtgcaaacacgctaagtcataaacagcctaaaaactgcaatacatcattggactatattagtctatattcttttcacagagaaagaaaaagcagggactcacttccactcagccatatctcaaagggaatttggattgaccttggaaaacagaatattgtgatttctcagattttgtgtattccgtgtgcagactgttttacggcaattctttccatactgtccatttaggtagccacgatgacaggtttgactgggttaggatgttagaattgacagaataaatgagtgctaataaaaagacgatgtgttctgctatcttgtcgctgaaccaatgcaatggtttataacagcatgatgaaaacaaataattggatactgtgatgaatttgaggtattataattttgatggtctcaggaattatgataaatgtttaacaataacagccacatttcttcttgtccacaggcccggtgggatggcttgactgggcatatcacctttaataaaaccaatggcttgaggaaggattttgatctggacattattagtctcaaagaggaaggaactgaaaaggtaacctccttaacaataaataaataaaataacaaatgaacattgttcaggcatttttactaaattgcaaagacaagtaggtgaatgatgaagtgattctctaagcatgttcttttacatccagttttttatctctctttcttttttctgcagatagaagttgatgtgctagattcttaaatttcatgtcttagtaatagcagtactaactagtgtttctattgtgcttcatttacatagcaagtgtgattatattattacatatataaccctagagttgggtgtcattaggcccatgtcttaaagcttttaacaaattgagtttagacttggaaaagcagaagctatcaatggtttatcgatggaatggcatccaagggttacccagaaattaattttaattgcacattttattccattttgagattggtgacagacagaataaagtaggatagaagagacttactggagcaaattaactttgcattcttaattttaggacaaatgccaaaaaactgtattttaatgttgggttctcattttaggattattttagttgtaattctgaatctctccatgtttaaagttctactttagttattatttagagtaattccaatgtaaactatttggttaaataataatgataaaagaatttggctcctcaatatattttactatgccaattttaatattcatgactatacgtcagaattaacacttacagtttgaagattttgcactgacaatcttatagaaaaacaattgaaacccccaaagcaatcacctcaacagaaaactctataatctgacattttttttcccactatagtgaataagacagtgtgcttaatgtaagagtggctttgggaacaatcgattgcttgattaattagattagttgggttgattttttaaaatgaggtaaggttttcatttccgttttcttgcttttgttaaccaggacacattttttttgcaggtgctaactacccctccccctcaaaaaaacattaatggaaacaaagatcatttaggctgaatgtattagaaggtgaccaccagtgtgaaatatttgaggaaaataatttgtttgcagttttgagagtacacattatacatgcaggttactcacttcaaaaatgtctctcccatcttctggcttcctcttcactctgatttgcccctctgttggtctgacatgccctgatagagcacagggcatccagccagtctccacgatggtgcatgggatgttggctggagggaacaaaagaaaaaaaatacttgttatgatctaaaagcctataatttttttaagaaaatgtctgcttctcgaagcatgagtctttccccaactctgttctcctcttatgtatagcactgaagggggaagaaaagctgttaaggaaacatctttttggctaggtgaatgatgaaatagatggagctattgttatgctttcacagctatctatacaccgtaatattatgcacattgcattggtgtttttccatcaaaggcaaaatcaaattagatgaaagtgttttgtgttggtttcttatctcttcattgtttgcaataacttttctttcttcaggtgtcttgggctcaattcctgagaaggctgattgggccttaaggcaatgagggaagccaacacatctctctcaggagccgagggaggaaatgcccaatctttttatgtcagcctctcttggagtcaatagggaaaattattagaaaaatcccattctcactttcactcaaatttctactgcccagaaacccataatcaaagaacaagtcatcaagcatacttcttctttatatgtgtgtgtctgtgtgtgtgtgtgtttgtgtgtgtgtgtgtgtattgattgatttgctggttggttggttaattgattgattttagttaccaatgccttaaaagggtcttcttaaggaacaatgaagacccttaatactgcagcatacctgtatacattgaaaagcactttaaggcatttcttggtgtgtgaaaggaaaagtaaaaattgagtcttaccaccaggtaacttctgtgagacccaagtcttgattcgtctctttgctgtacctattgtcaggctttatattgaattaagatgcaaattccaaacaatgggtgggaactgtaacactctaagcactcacacaccatgattccttctgggtttcacgctccattttaattaagtgctgtttttattttatttttctctctgaaaaccaaggctgctggcgaagtgtctaaacacttgtataaagtgtggaagaaggtttgtactctgacaacaactgcaggaaacctgggggtgggatggggaatgtcattggaaaggcctgtgcccttccaatgttaccagacctgtagctctccaattgcagtttagaagggaagttccatgtaaagagagaggagtgattgaatatgttatctctctcaacaacatcacctgtgaattgaaaacaggtttgcagtggattaaataattatggattaaatatttcccccaagattatttttgtttctcccaggcaggatcagtccttgttaggattgaaagcaggcaactgtaacagaaggagacactgacctatttatattccttctcaaatcactaaatattttccttaagggggataaaaatcacaatagatttgatccatgagactagtcagataggctacagcctcagaaggctaggacacctcctgtaatgtcaccaccacaaaatatgaaccattttcagaaatttccttttctcatgagctatcttttgttttgtgtgatatcttcatcagagtatactgtcttgcaatttgttttagagccacagttctaaagaggacacaaacgttagggaccttggaaaggaaatgagattatcttgtgaattataacacccactattttatagtttattatacagtgccatgttgccaatgaatgtgcatagatttatgtaagcaaatatgagacattaaaaacatttggatcagagaaatgtccccgtggtaagcaaacattttctttcatctcttctctctctttctcttcctcctctccttccttccctctctgtctctctctctctaaaactacttggtaaaaaaaatctatggactgatgaatggaccttaaattgcttcaggttgttcaacttgaacagttttgtcaggttcactttcatctttcaaattatcagctatgtcacagaaagtgtacacaagtttctccctgtagccaaaaaccttgtccccctcttagtagtactcagtgatgaattcaaaaattttttctttttaagttttcaaagcataggtttaaaagccttgttttaatcttcagtgaacaaggctactaagtgcatgtagaaggcgatctggtttcctcactaaaattttactggtaaatagatgaacctaaccggcacccagaaaaagaaaaaaaaaaaaaaaaacctattacactaatccatcttgagactctgggcactttgaattaatctaatacaaatgtcccagggaatggaatccaagctttgaaattatataaaggggaggggggatgtcctctatttgtcactaaactgcaagagccacacacactcccgagggttgtaactttctgatcttgatcctccatgccttcatgcctcttccctcctggtagcccatcatgttccacattgtaagttgtatatactgtggtgtgctgttttgtgttataactccgtcaaaaattcacggtaacctgagttctagcacaggcgacccactcagacccaacaaacacattgcactttttccagaagtctccaacttaaacaaaaattcaccttcatcatattgaaatcccaaaagctttcctcgtactctgacttattttagaatagtattattcacccaaaattctttccaaaagaggaaggtagcaatctttacaacatccctcactaaaatatttgttatataaggttcgtaatacaggaaacacatatacctttatctttgccctagatacctgattatttccctcagccactttagatgttgagtttacatgaatcactgtctaggtttagaagatagatactagtggctctctgaataccctttttattgcatcgctttttaaaaaaagtttgcttaatgtcatttgggcactcattttcaaatgcttttctcagttgtcctagataacacatggctgctcccttgtgccagcttacaaagtgaaagaaatcagggccaggtaatttagatattgagtgctcctccccacaagtaactgatccaccctccactacttctcactggtaaatgactactgtctgctttcactgtgaagcttgaaaactgaggttccgctccctggaggcactcctcctagttcgtagaacagtactgaaatgtcaaatgtccaggcatcttcttaactgtacctctgtctccagcacacatgaatcatgagatctgacttctttaaagggagacattcatttcctgagaacatattcatttacttcaagtaacagataaagccacatgactacttgggtttaaaagacacaggtacacacatgcgtgcacatacacacacacacacacacacatacacagttctgttttgctgattacaggtttggaaacagaagactgaggtcactcagcatatatatactgtacatttcccaggaatagcctgacctttactatattttgatactcttctagtctacatttaaaggaccttctgtaggtccctctgtagagacaataggggaaaaaatggtcacccttttctcattttaagaaggaaagtttaaactgaataggacttgggacttagttgattggattggcagcagcaatgatctcttagcttctgcacttttagtgcagatagcaaaggaaagaaaaaccagacatcaagctgtggggtgtatttgtctacaagttcaagttttattttacaagagagtgatattgctaggctattgaacactgtcagtttcaaatattacggtagttcctccaacactcacatacttgacattaatagaaataagatttaaagagaccacatcctatcacttaatcaagtggctaaaaacagttattttctccacccttcaatacttacttaattaaaaattagattcccttctcctcagtgtctaagtgaaggtttaattagaagtacagtcagggcccaatttacacacactcttcatggagctaggagtcaattgttcacaacctaaagcacagccttggatgaaaatcaatagacaggtatatttagccagagttacatttcctagaagcaagggtccctgcctcagaagaagggatggagattgagaagaaaaagaagaaaatgctgtccacttttcctgagtctaaagccagattaagaaacctaaagattcttcaaccattagacgtataatgtgcattctaggtgatatttatcacactagatcctggaaacgttggatggttattaagagtacagcttacaacccaatagacacttcttttcaggcaggaccacaatattttcaaatgcaaaaactatcccattcccccatttacctatacctgtctctttatttctccagtcaactaaccctcattaagtataggaaataaaactgaaattaaaatagttcacactgatgtgtgaacgtgtaatagtccttgaaactttttcaaagcattgatgtctctaaaagggatatttgtcaagctaaatgaatttccagctgctaaatataggcaataaatcagagtcaagaaatagaaaagcaaaggaggatggagcctaacactcctgtctgtcttcccattagaggaacatatttagggaccaagcatagctccaccctgtccatctcagagcgggtccaagtgttcatgttcctaaactgccacttgtcatagctcttttaccttatcagaatctgaatttttaaaaaaatgagtccagattccttcatgacagggtaaggttgaagaaatgactgaggcagccatttcaatgtcctttcttgttactatgtgtgcaggtcttaacaacatgcaccaacacttccacatacatcatctgattatttgatcttctcattattcctgtgaaatactttataggtaaagaatcaactgaagctcagaaagtttagaatctcattcaaggacacacagcaacaaggtcttcctggctctaaaacatacttgcaagccaccatgtgaggctggcagtaaatgcctacagaaagataggcatttacaaaatagctcaaaatccccaaggctcctcttctgggttcccacagaggctgaatgaatcaatacacttctacaccacctcacaacccaggagtgacttggccactggagaaaattgtggatcattatttttaaaaagagtaatgggctttactgaatgccagttgccatggttggttttgtgacagtaaaatcagtgaccagtaaaagtgagcatcctcactgaaggagttcacgatcaagtggacagacaagacaggtaaacagataaataataacagaagacgctagctgctgtgacagagatatgaacagagtcctgctagggctcacaagcactctttgcccagctttggctcctcaaagaagataggccctgaatttagtctacttctcatgcacatgacatgttttctttcatttatctttctctttttaaagaaaaaattactttattttttcagtgtctcgctctgtcacccaggctgaagtgcagtggtgcaatcacggctcactgcaatcttgacttcctgaacccaagccatcctcccatctcaacctcctgagtagctgagactgcaggcgtgcaccatcatgcctggctaattttttttaattttttgtatagatcgggtctcactctgttgcccaggctggccttgaacacctggtctcaagagatcctcccaccttggccttccaaagcactgggattacaggcatgagtctcggcaccccactatctttcccttttagatgctgggtctctccaccattcaccctgccccttcaccccattattcataaattttaaataaactagtgatactactttggcagcctaaggtttctatcagtagaatgtaagctccacaagggaagaaactcttgtatattttattcattgttatgtcctcagatgcctagagcagtgcctggcacataaatagatgctcagcaaatatatatataggaagaaaaatctgatattcatttaagaattcttatatattttttcatttataaaagaaaatgagtttactaaatgaaaaagaaaaagacctccacctaccctgcccccaatagcacagatatatcctattttgtctacacattcattcctctgttgtttcatttccccacgtttagtagcttccactgtgatgccccagtgtcccaaactgtgagcttttgtgcccattcctggtagagaaggggcctctctttggtgtaaatgccacactgacagccagcagcctctgatgtactgtgttctgtgtagattgggatttggaattccaacagtgggcttaacatgacggacagcaacaaagacaagtccagcaatatcactgattcattggccaacagaacactcattgtcaccaccattctggtaagttgacttcatggaattgagggtgtcttatccaggctcctgccttagacttcgaagcattcctcaactgtctttttcatgccaacgcttctgtctgcaaatgtctatttttaactaggacactaaaagcctgtgtttgtacatacttacaggaagattgaattagacgcttccaacgttgttctgaagatctcccacctctaatccattgccagtcctgctcagccccactctctgtcccctcccagctggtctcccttgctctctggctgctagttggtttcaaccatgtggagaccctagcaagagactagggaagtgggggaagaggtgggggaagagaggcaagagaagctcttctgttccctcccaactgctactagtagttttttcagaacctctgactttctacaaccatagcttctgcccatcagtggcactgtttttagggtccagctgcactgagcttcaggagtattctttcctccctcctgcctcagccctgggtggtgcaggtttcctgaagaggctgttgcctgtgtgtctatgacttgccaccaaatcagacccccacctcccttggctccctttgctctgctcacacttctgtacacagctcctttactaactgttcttgaaagtcctgcctcctattagtgccctggtcatgccccatccagccactgtacagctaccggttgcttattttccgctttttcctttctccagggagttgggcaggagtagccttccctgaaatccttgcttgcagacatcctgccttacaccagtccataatgtcaaatcaatttattgttgatattattaacttgtgagaattgttcatccaaaggaaaaactggtttgctcttctggttactactttctctatgactgtcttatgaaaacacagggttctctactgtgtttgaatgaccccattatcagtttgaggataaacctaaatataaagaatatgtctgtagtatagcaactattatattttataaaaccaaatgaggattcatttagtcaaatgagaattaacaaggttatagatgcatggtagtagggaagtgtccattatttataggagaggggactgatgatgcacgtatataagcagagaatgaccagatgtgagatttgaggtgatttcaaaaaagaaaatgggaaagatgataaaagaagaaatagaaatggcctttggaataggctaccctgaaggaaaccaatcaaaatatataaatcataagtgaatagtgaaattcagatgaaatttagataaagaaatgagaatagtcatagataggaaatgcaaagaatgaaaggaaatagttggtgatgtagatttctctgtcatgaggttcttagataaaagccaggtccgggcttggtggctcacaccggtagtcccagcactttgtgaggtgtgagggtggatcacgaggtcaggagatcgagaccatcctggaccaacatggtgaaaccccgtctctactaaaaaaaaatacaaaaaaatagtcaggcgtggtggcaggcgcctgtagtcccagctgctcaagaagctgagaaaggagaaaggcttgaacccgggaggtggagcttgcagtgagctgagatctccccactgcactccaggctgggtgacagagtgagattccgtcagaaaaaaaaaaaaaaagccagaagggtcatacaaaaaaaagcttaggtattggcacagcaggtggccaggcatgtgggcccccatttccctttgcgccttccttcttctcagacccaacatttaacagtgactgtgtatccatcacaccattcccgcacagccccaccctccacagcggaaggaaaagctcccatcgaaagacgcagaagggaaagaaacaataatataggaagtgttttgtatttatagaggacataggcaggcagatgagtgaatgacttcagtactctcagctcttcaaaatcattatcaaacatttcacatcttcaagctgctgatagggtaaactcttcctttcattataacagggttttcatatttggtttgtttcatttaggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacgtaagtaacaatatttctaacatatctgaaaatatgcataagagaaagtaagagaggaaaaaatgatgtcagaagaaatgtttcctttttttgaatcgtaacaatttttttaagaagcaaagtaaaacagcctggaaatggagtttgcttacttagaagggcaagtaaagataaaaattaatgataaaaatatatggtgcattagtttgtttttacactgctataaagaacttcctgagactgggaaatttataaaggagagatttaattgacacagttcctcatggctggagaggcctcaggaaacttacaatcatggcagaagacacttcatcacagggtggcaggtgagagaatgcgtgaaagcaggggagatgctagacacttataaaatcatcagctctcatgagactcactcataatcaccagatcccaataccccatgatccagttacttccacctggtcccacccttgacacatggggattattacaattcaaggtgagatttaggtggggacacagaaccaaaccatattatatggatccttctttcatactgaacataaacttgagtgattcttaaattaagaattttacactttgggagtctgaggcaggcggatcacaaggtcaggagatcgagaccatcctggttaacacagtgaaaccccgcctctactaaaaatacaaaaaattagccaggcgtggtggtgggcgcctgtagtcccagctactcggtaggctgaggcaggagaatggcatgaacctgggaggtggatcttgcagtgagccgagattgcaccactgcactctagcctgggcgacagagtgagactccgcctcacaaaaaaaaaaaaaaaaaaaaaaaaaagaattttaaagttttcagctcagagcaaaatctcatcatgtcaattaatagtacaaccaagttgctcattccttctttttctcacatgccctttttaaaggcatcttcctgcatttttgtctttagttccagaatgatggatatatatttgtgtatgtatatgtgtgttttatactttctggtttctctttgctgatactgtttcataaacataactgtataaattggcttttttttattagaaccaaccatcacaggagcttcatgaatgagaagcatttagagttgagaataagaatcaggagtacccaggaaaagtctagacatttgcaaagaaactagactaagctgacaattttggacttgcttttgcagagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtaagtttgagaatcactgaattcacaagaggtgtaggtcagtctcagatttctgtatgtcccagaggcagacaaaaattaggaactttaaagtgtacttttagttttgcctagtgttctattcttggaaggtttccatataaaagccgttctgtaaatgaatgttttctaattatttataaagttacttttaaaagagaggaagataatttttaatattagtttaactttatccctatttcaagcaacataaaatggttatttagccattttccttgatttataacaaaagtaatggctcaaatgatgtgtaaaatgtttccataggaattgtaaaatggtctcaagatatttgacccctagaatatttggataagcaaaacataaaaaagtcagcaaagaattatcatagcaaataaaaaacagtggagtaaaaagattgtgaaacccttaggaatgaagaaaaatactttaaaagttctattaaatttatttttaaaggcatgagaaagttaaagagaattctagaaataatgctgaaaggaaagattgcttacatacagagcctggaggcatgaaacctttgtgctatcattaagatgattcaattgaggttttacttttcgagatttaactctgtatttaaccattttgctctacacagttccttaaaggatttttatacctttcaatagatcatatattctgaatacttttgatgctaaatttgaaacagttattttatctttctgttggcttaaacatttgctgtccctagataaaccatgtaaaaaataattgcttttgtatgtccctacttgttttcaatctttttcacctttcaacaaaactcagtgaactttttccctaatcaatttttgttttccctccaggaatttctaagagaaatatttcttcatgctagctctttgtcattgtccactgtctggttttgattaatgccaggtaactctttccctggtgtaattataaagaaagcttgggaaaataacacaggctggaaaggttttaaagatccacaaggcagacatactcaaactgaatcaacatgtgctctcacatgtgggtatttatacattcaatatgaaatgaatgttttgatgttctctaggccttataaactgtacccttaccaaagctcagattttatacttttactgaccaaagctctctttaaatatgccttacttcagaaaataaaatattgacagtatgtatatagtgatattatcctttgtattttaatactctaaatcagtggttctcaaccaggagggattttgtcccccagggaacatttggaaatgtctacaaacatttttttagttgtcatggccggtagtagggagtgctattggtatcaagtggacggagtccagggatgctgccaaacatcttatggtgtacaggacaggtaccccccaaaagaattattcactccaaaatgtcaatagcaccaaggttgagaaaccatgctcgaaacaattaaagaagatattgctttgggtataaaatttttaaaaataaattgtttacctttggaggtatttttcattagtgactcctcagtgaagttaatattgcctcggaatggtcatttaataaatgactatcctaaggtgaagcaccttctaataagtaatcttgtgtttacttgttgcatacctctgcccggaggcccacacctgttgggtgatactaggactgatggagcaattcatgcagcccagggcaacagtagtttccatatttcgcagggcaaaagtgagtttccatattttgcagtctgaggctctgtctaggcagtgatgttgatgagtagaacaggcaaggtgaggttgatgagcaaatacattgtttattacatgacttgaccaaagccagtaggagaagaaacgccagcagcatccaaaagttctcacaagcacacaggctgaaagtaccctttacacttaactccaactgtgcgcttaaatctccttatgtatgtcatcagagtatgtcagaatggcacgccattcaatagttttcccctctttgtctattcttccataagctcttggtgacccagacctccatatttttggacttcattcagtttatttctattaagataacagtacccccactaccaccatcaatgcaatccattcagtagttctactcaccgagagtatcatttataagccagtcctcccttatttagcttattcttcttgtctcctcttccactgccttcttgcccttgtcttggttcacacgtggaggtgttatacatccagtgcaaacttggaaacagtatagtgacgaaatacagaaaataactccctccagggcacaagtgtactgtcatgaagattctactttcaactacatttaccttctctacaccttagaatccatccctgcttctgcttcataaagccactaaatatatatttagacttgattcccaaaaacaaaattctggttgagtagatgtaccaagtcacctttacttcctaccatcatagtttgagaccatgaactccgtcactctgtaccctcagttaccaccttagtggtttgcattccaagttagggaagtggacatgaaaaacagtaaatttcataattatctatagctctagagagactttggaatttatgttgtgaattgtattctcttatgttcttttaaaggggaaaaataaagccccatcactgcatttaagcaaatgccttcactagatagatgcctaaaaattatttgttgaactgaattaaatttataaagatgtagacatcggtgggacaaactaaggaaaacaatatttaattactatgacttttaattaagtgtgtatgtcagggtttttgttttgtggttgacaatgtttccactttttgaaaaatatttaacttcaataaattatgtccatcataaacaatttaaatagatcaaatatccagatagaatgtctgcttacattttatcatttatgttcgtcttcttaaaaatggacatttttaaagttggcatttggcaaaaaaaaatctagaaaacccttgaaagtaaattctatggttacaatacaaaccccaccattatattacaagttcaatagagcattctcccttgaaagatgaatggatttttctctcctcaatgcagcctactgtgcattctcagccacaaaaattagtcccttaattagaaaacttcagtgtgagcttgttttatatcttcaagtgtaagccaggcagaaacaaacataaacccaaagtgaactttcacatttcaacataaggctactcttctatatgcaagttttgtcacaggttttaagcatgtttcttcccttctctatcatattagtaaagatgagtattgatttcttgagagtcatttggggatagcagtttcggattatctttggtgtaggtcatatattaatcttttcaccagacttcctaatactgacactgctgtcacactggctatctttaagcaggtgttaggaattctaagctgaaatgtctacatccaggcaacaggtaggtctattgccttataaaaagccagtgtcttacagcacagcatcatgtcactgtttaatattcaccagaccacatgctccacaaatcactcagaatcccagagagaaagacctaaaatatctctgcagagcaggcagaatcacattgctgtttagacagtttttctttttgccacacaaaaattagattaattgctctcttataagtgcaaagtatgaaacaagaccaagttaaaagcagcattccaaagagggaagtgatgagctcatcgatgggagcatatctgggagagaaatgtcagaatattgaagggggctggtggttgccaagtcttacggtctgtttgaaaaaataaaaccccttctcttgaatacattaggctcttaatttatttcaattaatatttttaaattattgtacaagtgacaatgatagtgtttaagtaacgggatctttactctgcatgctgtttccattaataggttcattaatattggtattcatttcttcagctcagcaaactactatggctataagagtgtgcaaattcaaaacttaattatattgttgaaacattaattaaaatgtgttggcatggcattgtcaattaaagctatattcatcagcttcataggaacctgcatggtgtaccctgcagctgtggagaagctgcagtaatgagtcggattccattatgctggcataaactacgagactgttatcccagtccccctaagactcaatgaggaggcactgaacactttccggaaggtgtctggaggtttagaaaatggtttttcatgaggaggaattgtctgctcatttccttgtgctggattcacagcatgccctgcttttcatatagataatgtattcacctcaagcccggttctccccagtgtgtcagcaacccgccattgtttactgctgaaactgtatggctggagagcattctctgtgttctcatgggctttatggtgtttttaacattactctaacactcctgcttgcattgaaaagacccaatggcaaatggctaatcttccagtgctaaaaattactgcattttaaattatttgcagatcacttcgttgagcttctgctaatgtctttttggaaaaataagtaccacttggcaagatagtcctcaaaagtaaccacagagcagagacctcctttgggctacataggtcagacagatgcttaaaaaaatagagaaagaacaaaaaatatatttggttccacagatttttattttaagtacaccctcagagatatctggattccctcctcttcacaaataaggaaattgaggcaatagaggttgagtgaatttttcaaagtcgacttcccacactactatactagttgtttttccagaaacgtttactgcccatagcgcaccaccttgcaggtagacctataataatgctatagaaaacataccacttaccgaaccagggttgctgattaagtgaccacaggccatggttctgaaaacaaatttaaaacaaatcaaaaggaaattatgaatttgaaattctgcagtgaggcatgctatgtagttaatactaatgtgtaccactaggcctggaccagtataattccaaatgtatgccttgtctcttcctttaggatcatgatttttccccgtggactattcgaaaaacatctaatacactccaaattcagctctacattttgttcactaatttgttcagccttgcaatccctttcatgcattacaaaatcgctagaccaccacttagactccttctaaccatctgtccatacaaaccccttgaaggcaagtcacccctcttttttgtgtctcccacaggacctaacgacacaatatcttgacattgtagttactatgcaacaagtgtgtgtcacattcgtcgctacttggtggggtaaatacttgggatgagtgaacctttctttacagttcatctagttgttcagtaatatggaaatgaatgaaaactcagaagaattcagtagacatagagctgaggagtacaattccagctgaccaatttgcctataaataagaagtctggtaaatattaacgtctcaaggctctttgcactttgcccaccaaagctgtaagtttatgactatggcctttactcttttggtttgaagcttttgtgattaattgttgggttttctgcattgctcagcaggttttggttttgctggtgtcctgtgtgtttctctgatatttacagactgtttctgttaactaccacaggtttacaccctacgagtggtataacccccacccatgcaaccctgactcagacgtggtggaaaacaattttactttactaaatagtttctggtttggagttggagctctcatgcagcaaggtacaccggttgcctatctttgtcacacgcatcccacagtgtgctgacaggctttcatgctggtaaactccaccatgaagctagagggtaggatgaaacaccatctcaggaacttaagaaaatagcaacggactttctagccggttttgaagatgaagcaaaaccaatgacctatatggaactcccttgctatatatctaaaatagcacttctatcaagcaataaatacaaattttcctgtgggtagcaaaagataaggtaccttagaaatcgtttacaaatttgcatagatggagatgttggtcttctccttctcagccataactccacgagtcagcagtttaaaggagcgggatctaaatcctttggagattaaattcactgagattcttccaattgccaaccttacctaggacttccacctaattactactctggcaaaccctactgagattcatttcagcctcccagtaacttttcacaatctccctcaattggtaaccatagcaacaataaactgtaggagttggggaaataaaatttggccatagaaatgtaatatattttatacatttcctatgaattcggggattctgcttttgtagtgggggaagggggagctattttaacctttggaagaactccatttcttttgtgattttttttttcagcttcaatgtcaggcatatggtatagaaaatttttccaggattaaatgcactaatataagaaaatcataagtcacagaaactgttgtgttcggaatatatgttcatttgacaataagctgcaaaatacattggcaaaggaaaattccactgggatatacattaaacatgtttgctacttgggggtgaaccctaaggtttctcattagggaattgctataacacttgaaatatttatcttttggatcttcaaattagagagagagagactgtggaaataccaaattataatactgaaatagtaaatagttgaagaaagtgggaaaatcctagttacgcaattaagtatggtttgtgtgggcactgctaaataagtatagatgccatctgatttactagaagtaatttgcataaatttagagcatagcacagaggtataaatcctgcaggaaaccccatatactactttacccatgtatttaatttttaggatatttatcttgtgagcaattactttcagagtgaaggagacccctgctccttccctatagcttgtcttctctgacattagaaaatatatacatatatatatatatgtatgtgtatatatatatgtatatatatgtgtgtatatgtgtatatatgtatatatacacacatatatatacacacacatatacatatatatacacatatatatatacatatatacatatatacacatatatacatatatacacatatatatacatatatatacatatatatacacacatatatatatatatatacacacacacatatatatacttttaggtttcacagagcatgcatgcagctggcctgtgcaggtatatgactgtgactgccttctgtcattgagtgcacccacccccggaatttatctttcatcttttacctgtttggagtttaccatcatccacagcacactgtgggatgcagtgtctgttagttaccactaccttgggtacatgacagtcagccccaaccagactctgcttgtcattcaagaagtttacaaacatttgtcaggtgcaacaaatctttccagatacaaacttgaggtacttgtgactgttagtgcatctgtctctagcacgtggcgttgaaccaggtagttatcctctgttgctctctcttgttagcagaagcttgtcactgtactcaattggaaaacattttgttgaattttttttaaatgtgatgatcagactttctcttttctacagagcgtgagcaaagtctggatcaggattggctgtcatgtctgccgtaaaaggcactaaagagacttcagcaagtattgtctctcatcccaaatattttctagtaatgttttactcaacttttaatgtttgtataatttcatcctctagagtactaaacttacacaaatcatctctacttgaaagaagccatttctaaataattctaactaacatggagaattacaaaattcacaaaaattagataaaaatagaaaacatgaagaaacattgagaagtctaattgatgccatctaacaagggtttaaaatgtaatctcaatacgtttctattaacatttttattaagtttctaaggtaactttatccaaaagtttaaatatgcattctaaagtgtgaaagatgtgaattagtattattacatgtcaacagcctgttgttcacctgtctgtccactcttaatgccatataatacataattatacaaatatacaaataagtgaaaaccttatgttttcatatgcaaccaaataatgaaagaataaatttacagcagaaaatctgcacccataagctaagaaaaatatatctattaattgttatttatttcctatggctattttatgaaataaatggtattttaatgataaccaactaaagagctaaaataatattacattgccacaagactgctagatcaattaagtacaaagatatgaaacaaccttgggcattaaacacacacacacccacaggcatataaatcccattaaaccacaatattaaaacaacagcagcaaaccattccactaaatccttggaggcaatttaatggaaaactattataagtctgtgtaatattacccactcaaattcaaacaaacgacagaaggaaacacaaatcgctgtcaaaccatttccctcattaaaagggaataaaacacaaagatacgtaatagcattaggagaatatatccgttaattcaaagcccagaaactctggcgaccttgatctgattatcactggccttgagctggctgtgatttcctgagccgtatttgcatctgtttatagattaaaccttagcacaaattcatttattggtagactggtgaactccaattttcctttccatcttaagccattattaacgacagagcttcaacacaccctatcagtatagtaaagggatcctatagaccagacagctgacctactgtacttcactcttcgggatttttaatttagggtgtttttctttcactttttatctggtcagataaactctgtcatgccttcaggttcatggaggatatgctaagtacagaaccaatggcaaatttcaggcagatgaacaagccaaaatccacttgtgaatcagtacaactggagtgaactctaattgtacttctcatttattctaattctgctgctgagtttgagcaaaattgaactagaccgttttcaagatgtttgtcttttatgacagtaaacttagctcataaaccctttcttttagagaggaaggtttccttggaaaacacattaagtgcctctattttatcatttaaacataatttcaaatcatctgaatgacatctaaaatgtatattcttaccaggaaagtcttctttcacctaaggaacagcctgtctttgaagtgtagttaagaaacagcattttattgaagtacaaaattatgcgttgcagagaatgtgtttttttagccaaataaaaatctacagtagaaaaaagaattgtagcttttaaggtaacataagacaataaaaactaattcatccactgtcaagtatggctgcatcttattttatttgtaaaatcccaatgttttattaaagtatatgtgataaatggcatgttaatattttacaagtagctctcattctttaaccttaaataaaaatgttagcatttcaaatattttcatagttatacaaagacgcagaatattttacttcacactataagatgcatttagacagtaataaaaggcaaaaagtcttggggttgacttttcaattctaagcaactaaactaactaaattttagacatggaatgcctccaggttaaaactgttttaataccatcagctactgataaattatagttaaagcaatagtagtgattaatgatttgaaaataatccttaagattttgctccattttctataaaatgcatttatttcatctacctacaagacggtaagtcttttacaggttgatcttcctagaatagtgtcgaactgtacatcttccctttccttctgactgtgtttaacacccttactctgatgataccatcacaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaaggtaagaagctgacaaagtgttctcagtgattatctgatacttgtggtagagtataaaagaatctgtcgaaaaaaaaaagaaaaagaaaaaagaaaaaaagatgttgggtaatttttttaatgaaataaaatttataattacataatcccattataaggaatccttgaagccccagtcagcataaagcagtttctttggtccccaactaggtgtcatttactccaccccaatttagtgtactcagatccatagatcaatatcttcaatatcctctcttgcctttacaccagaaaaaaaaaatctgaatacaatctaaccactcattaattaatcactcatttatagaacccataaaataaaggttccttaatcaagaattctggtaaccagaatacttgaatatcattattttgttctttcggtcctgtacttgatgagatagaaacagatgacaagaaaacgtgttgatattggaatttagttagagaattaagaacaaaaaaatcccaggagactctggtctaatactgagtccgcattgatgaaggacagtgttcccagccatgcctgaagcttttcaaaatgtcttcggaggcaccgcaggagaattaagttggatgagtttagttttagtgtcaagggcatttcattgttgaggtctttttaattacttacccatagtaatgaaactgatttctgcctcgcttttggaggaagccttagtacttttattatcaaatctcaaatactctaattccagtgaaaaatagattttaatagatccaataggtgtaaagatcatgaagttcaactcttcactctacttatgaaaagaacaaaaccttcagaagctaaattacctgctccaagtcaaatacctagtctataacagagaaggggctaaagttttttttgggaaaaaaaaaagtattaatggtggtaaatgtgcatgtgaataaaaggaaaacaacagttgtaaacaaaataatctctaaaaacacccttgtcaaagattcatattcagattaccaaaaatggagttgtcacctcagcattgagtggactgtttggggttttttgtttgtttgtttcttttggggggcagctgtttttttgttttgttttttgttttgagatggagtctcgctctgtcgcccaggctggagtccagtggcgcgatcttggctcgctgcaacctccaccctccgggttcaaatgattctcctgcctcagcctcccaagtagctgggacgacaggtgcctgccaccacacctggctaatttttgtatttttagtagagacagggtttcaccatattggccaggctggtcttgaactcctgaccttgtgatctgcctgcctcagcctcccaaagtcctggaattgcaagcgtgagccactacgctcagccaggggtatttttttttaaataatcttttcctttctattatttccattgagttcaaaatgaactctttttcttctttcattcttatttcctttttaaacattgtttatagatttaggaggtataagttgcattttgttagatggatatagggcttttagggtttccatcacccaaataacatacgttgtaccaattaagtaatttctcatctgtcagccctgccaccctcccacccttctgagtctccaatgtctattattttttgagtggactgtttgacttgtgaaaaataccagcttagaaacaaaaactaaggttaggaaaaaaaagtacacatttctttgtataacactattggttcacaaaaataggaattaactatacaataagttataatgtttaataacaataataaataaaaaggtattgttttaaaagttaactatatctagagttttatcaagaagcaaagtaatggaaaaagtaggacttacttttcttctgtgttaaaaaagatttttaaacactttttattttaagaagtgtatcatttatttaggccgggcgcggtggctcacgcttgtaatcccagcactttgggaggccgaggcgggcggatcacgaggtcaggagatcgagaccatcctggctaacacggtgaaaccccgtctctactaaaaaaaaaaatacaaaaatattagccgggcgtgatggcgggcgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaaaaaagaagtgtatcatttatttaatgtatgtgtaaagcatggtgattgtttcttctttggacagtgatgttctaaagacaaatgacattacggctttgcaagctgcagaaagtattttcctaaaatcaatagtgtgaagagacacaagataccccaagctagtgattcatcatggtccttgtcagaaacaaggaaggtcacttgcaaggctcacaggacagaggggcactggcaagatagaatttggtatatctgaaaaaatatctgaaatgatttatctcattcagcaatatcaaagagttttaaagtactgggaaatgggctagcagaaggcagagaagattctacttccttcaagatgttcagcacaaatgtaagggaaagaggctgtgccgttctttgaaaaagcaatagacctgactttgccactgtacacaggatctatgcacaggctgtggatcccttatctgaaatgtttcagaccagatgtttttagaattttggatattttcaggttttagaatgtttgcacatacataatgagaaaacctggggatgggacccaagtctaaacaaaatttatttattcatcatatataccttatgcatatagcctaaaggtaagtttatacagtattttaaataatttcgtacatgaaaaaagttttgactgcaacccatgccatgaggtcaagtgtggaactttccacatgggacaacatgtcagtgctcaaaaagtttcagatttgggatttttcagaatagagatgctcaacccagatttacaaagtgtcctttaaatgacaaagtgtcactttttttttttttttttttccagacggagtcttgctctgtcgcccaggctgggtggagtgcagtggcgcagtcttggctcactgcaacctcctcctcccgggttcaagcgattctcctgcctcagccccccgagtagctgggattacaggtgcatgctaccatgcctggctaatttttttattttaatagagttggggtttcaccatgttggccaggctggtctcaaactcctgacctcaagtgatccacctgtctcggcctcccaaagtgctggaattacaggcgtgagccactgcgcccggccccttaagttcactttgatcttttctgtctcaaactcctgacctcaagtgatccacctgtctcggcctcccaaagtgctggaattacaggtgtgagccactgcgcccagccccttaagctcactttgatcttttctttctcatgcccctctttaagtataaaaagagcgggttctcctttttcctggcaggaccctgaatgactacattacgacatgtttggataatgcacttccactgaacaggtacatgctatgttcacaactgctgctccctgagcattttctgagaaggctcctgctttctccctggtcctgaaaatgaggcatcaatgcaagcattctctcaggtcaccaggaaaatgatgaaacaataagcacctcagagaggaagaatgtgatgatagtacaaacagcatcaataaaaatagcagtacgccctgtgcactagcccttacctgtgttacctcattttatctttaaaaaagaccagttgagcaccaggcgctgtggctcacacctgcaatcccagcactttgggaggccgaggctggtggatcacctgaggtcaggagttcaagaccagcctgaccaacatggagaaaccccgtccctactaaaaatacaaaaatattagcccggcgtggtggcacatgcctgtaatcccagctactcgggaggctgaggcaggggaattgcttgaaccagggaggctgaggttgcagtgagccgagatcgcaccattgcattccagcctgggcaacaagagcaaaactccgtctcaaaaaagaagaagaaaaaaaaaagaccaattgagctaaataccaatattatccctattaatgaggaaaatgaggcacagacaggctagataatttaccccaaagttacaaagctagcaatggaagagccaagattcagcaaaattcagagagttctagaaagtcagttccatgagagtagaaactcggtcttctttgtatgacattaagtcaccagaatctaaaagagtgcccagccgtatagtaggcattcagaaaactatgttttcaataagtgaaaaagtaaactctgggagaggtggatttctatcagagagagggagggagagtgaatgaaggagcaaaggaaggaagccgagagggaaagagggagggagagaggtggatggatacatagggacccacacaagaagagacactgttgccaagttcctcattttacaagctagcttgtggcccagcaacccagtttaccgagaagaaatgtatttgcagaaggagaacaaggactaaatccgatttagttttcccctcgaggatggtaagctgtcagaaagcgtcagagggatgtacactcaggttcttaagctggattattccacaagggaaagaaaagtttcggcttttttgctctcggggtagttccgccctaaatcactgagtgacagcaggtacagtcacaaggactcagtcctgacctggctccacatgaacatgtttcacctctgctgtgccatcagggtctccctcctccagccctttctctgtcagttaaagacaataacctctcttgagctgtagaatgaataaggaaactacctttgcctaatctaacctggagcatcctgatcagtttttggagcacaagtcatttgctaagatgggtcctgtctccactcaatcacaaggaaacttctaatgagaaacgttttctcatcacaaacagtgtaatttcaagtgtttttcttctcagaaaagcagtattcctctggcagtacccaaatgataaaaactggtctttttactttcaagttgatttaaaatcattttatagccaaagaatggccagttgcagggaggaaagggattcagacattttcaagatccatgatcaaacaaaatactcgaatgcctcacatttggtcgctaggccacaagcaagggatgtgcttagtgaagtttgtccttgaaatgtgtgcccagaagttgctcgctaaaatttcattcaaaatccgttgactttttctcctagacttggctattcttgcagacagcatgacactctacattttagatctgatgtatttggttctcaacaagaagaaaaccaaaatttagttttttaaaatagctcaggtgagattccactatctaccacctgagctcatataaggctgagggaactaagtggaattttttttttcttttttttttaatggagtcttgctctgtcgcccaggctgtagtacaatggcgtgatcttggctcactgcaacctctgcctcctgagttcaagcaattctctgcctcagcctcctgagtagctgggataacaggcacccgccaccatgcccagttaatattttgtgtgtgtgtgtttttagtagagacagggtgtttcaccatctcagccaggctggtcttgaactgacctcgtgatccacccgcctcagcctcccaaagcgctggtattactggcatgagccactgcgcccagtggaaattttttaaacaaatgctagctcaagctaagacgtgactgagacggggaggcagtggcagttttccttcagggtcattcatatatggagcaacattgctcatcaaggactgtatttacacaagagaataggattaaatcataaattcaattccacatattcttgtgaaactttaatggacatcctgagattctacctcactttgtccatcaaaaaaaaaaaaagcaactctaagtttcgatcactcagctaatgatgcttattaaggcttatgttgtcacaagatcatcaacactctggaacttacagttcaatcactatgggaaatacaatagcctatttggtcaaagggtctcaggcaccccaagaccaattagctggccaaggttaaagggaggcagaacatttatcaagtgttcaggtactgttggagatgttttgggaaattcttctctgaatatgaggcgatcggcatcaaattaattaatggcctatgtttatgggtcagtgtattaataattcagaacttcaacagactctatttaagagaatttttttttttttttgagatggagtctcaccctgtcgcccatgctggagtgcaatggtgcgatcttggctcactgtgacctccgcctcccaggttcaaatgattctcctgcctcagcctcctgagtagctgggattacaggcgcctgccaccacgcccagctatatttttttatttttagtagagacagggtttcaccatgttgaacaggcttgtcttgaactcctgaccttgtaatccaccggcttcggcctccaaaagtactgggattacaggcgtgagccaccatgcccagactatttaagagaatttttaataaaatccctctcatttctgcttgacataatactaattaataatccagatttaactctattggtttctctgttctctgctgatgaaattatttggtcctttcaattgtttctcaagtctgaacagtacaggatttccttcgctcccaactccctgggaccaccaccagcatcttaggagatgcaaagatcagtcagttcatagccaagctctatggacacaacttgcattcagctttcctaggggctacatgacctatttccatcttttatatccaagacaactgacaagatgacatcaatgacagccaattccaacttttcctttcagaaatagtatgctaagattctggttttctctcccacaggaagtcagaaatgtacaacggctctgttcttcttgttggaattctattaattaccttatgaaacaataagatagtccaaactgtggtctcacagtgatagtgtagaaagtcacattttttttccccagatgaagaaagaatagtcatgataatgtctaagaaccgtatgcagcctaaaagaatggatttcccaatgatccttgtgaaccatcatccaaggaggataatgcttttagcccatggatcagagaatgggaataccagctagtcttcttctcaagaaatatgaccaacatcttatgctgggatataaagtaaaacctacaggaaagtgtttttgttggagatctggacccagagagcctgggttctactacatataagttatgtagaccttggcaagtaacttaaactctctgtaccttgatttcccagtctataaattgaggatgacttctaactcaaaattattttgaggatttaatgacttagtagaggtaatatgtttatactaccacttagtacactgtaagcaataaaaacattagatattattgtaactatcacttataacatcatcaccataattattcaacccttacctctagctattagtcctattttttcagtctctctagatttataaatattttggtttggtctctgttcagcttccttactgtcagtcatctctgcagtgtctgccttctgctaaaggacagaaaagtccagaagaagtgtcagtgcccaagatctcaaagatttttggaggcctggccagacagcaaccctaggccttggaggcccttcttgagcacatacattgcatatgccgaagcacttaccagatggtaggtaggcaaaagatggtaaggctgcccttagaatgcagacaagaaacagagtgaggcaattcagtttaattcagtttaattcagctcaattgatatttttgcagggtcctcaatatggtcagtactgaggttagcacttaagagggaaaaaggtataaaatcatgagcaagacatgaagatctgaatagcaatacagagacaagaggtatgaatacctgttaaatacaacacaacatgtggttgcattgtgcagacaggaagtagtggcagaatttcttgtgagccaaattagctatgaagtattcatgtaagaaatacttctcagtagaagcttgccttgtaacaaatcactatcctcccagactcaagccagaggattacacagattaaattgtgattcagtctaaaatgacttggataaaataggttttaaaacatcataaaagacttgtcatttctggctttcatggtctagggactttggaccagctgtgggaacaagggattctctaacctttatcatctctttccagggagtggttaggtgctgtcaccaacccaaaagacatttcagagaagttactgggcactgcaccagtggaaatgaagcaatgagccattgtagggagacagatttcagacagttataaccatttcaggaagcagaagatgaaagccatttctcaaatactctgcataggaaggcactcttcacataagagttcctagcttatgttggaaaaatccagctaattttaccatcagtgtcagaaatgttaggtctctgtaggttaaaagtgtatttgtttgggaagaaatctatgaggtcaattcaacctttttcaaaggctggaagattgcctgtaatagaccaatctttaactctagacaggagaaaaacatgaaaaatattttagcaaatctgtttaaatcccgctgagggaattttctaaagggaatccataaattttttaaatgttggagagtctgcaaatgtcataacttttcatcaaatcaagataaagacataatcaactgcagtgttcatattatacacatttggaaggcagaggtcctaactatactataaatattttcttctgatcatcttccttcaaagcgatttttgtaaattaaatcatattttcaaaatagcatgagaatttattatttaatgaaataatatattaatcatgtctaaaagaaatggttgtttttaaggcaactattcacctctgatgtacctatttcgcaagtatgaagttctacatagccaatgtctatgtctttggttaatttttaagggttgtcttaaatcaggatttgcctaaagtaaaattaaattggagatcttaaaatataattgtttgtgatatttcatttgttctatatgcatatatttacatttataagatcacttttgataagataaaaagatcaaatatcaataacttatttctaatgtatatttcagtgtgtagagtaaaaacatacataaacacagatcgatatataaaatcatcagccatattagtgtgaagtagaattgcatgattactgattctactgaaaaatgagattatacatcctaactgtgaaagtcttataaaaactggtggaagaaataatgtgataaataatagttatctcaataaaaaagaaacattagagggatattttataaaatggagtccatcaggcttaagaccacactacaccctagaatttgcacatattttatttacattgtgtgatggaaatcctgtaactaaaaacagtgaaactatatgaaaagcaaaatactgttaaaggaaaggaaacaatataaacaagtcacattttttccaggttctaactgttgcacttcctaaaacactgtctaaattcttgtctaaacaagtgtaagctattaaaagtcaggtaaatagtttctgtacattatatgatgagtacaacagctctggctataatagaaagatcccacagctacttgtttcgattatttctttagaaaatttgttaattctgtggaaacattagctgtggaaacattagccaagccttgagtttgctgctctgtgtattaagagatagttcattccctgttgtttaagaacacagaccctggaaccagattactgggatcaaatcctggtttcctcatttcttcatgtgctgttctatttcctcatctataaaagagaaataataatggtacgtctttcatatgattaccgtgaagattcgattaatcaatatatgcaaagttcttaaaatagtgcttgctacacagtaaataaacactgcatatgttggttgctgttactattttcaataagtaatttttaatgcctgcaaacattataaactatttcccagtgagtgtttaacttgaatgtattatagggggaaaaaagaaataaataatgttcatcaaacattgatgcagtaacactcccttataacagatttgagatgaaaaatgctattctttgccaacaatgtttcatcagcatgaggatagccacataatcagatttaaacagataaaatgcatttatctaaacagatgcctctcaggattaaaaagaaaaaatcctgggtgatttcagatttaataaatgaggctttttcagttttagcaacttttgctaagaagctcagaagacattccaaatattctaattaacttttgacatatctagtgaaataagaggcaaccactatttctgtttttggaacatatattatttagagtgatttaggagactggttgacattatatgtgatttagaagtacaaaaacacccaggctgtcattttaacactttgcctggtcttttaatatgtatgataatttttcatgaagtataatcctatttttaagaattactaagatttgagactcaaccatgaaaaaaagtctgctgaaaggaatacatgtaatttactcccaacattctacttttttatctaacaaaaaataaacattactgagcgtggcatgcagcggacagaactctgcagtaaagaagaaagagccctcaattctgtgctgtctcttccactaaccctctgccaccttctgtgtgtcatttgctgtccctgacctcaggacctgcatatgtgataggaaggggttggtctagagagtagaacgtggtggttgaagcatctccttatgtgaaactcgtctaagcatgacatactccttgcagttgcctagtgatagaaaactcactataccggctgggcatggtggctcatgcctataatcccagcactttgggaggccgaggcaggtggatcacatgaggtcagcagttcgagaccagcctggccaacatggtgaaaccctgtctttactaaaaatacaaaaaattagctgggcatggtagcaggtgcctgtaatcccagctactcaggaggctgaggccggagaatcatttgaacccacgagtcagaggttgtagtgagccgagatcgtgccattgcactctaacctggggaacaagagtgaaacaacgtctcaaaaaataaaaaagaaagctcactacacctttaaggtgctgaagctgtctgcagatatttctacctattaaaaaaagttattccttagccacattttgggtcttcctgcaaactctaatttccctagcatcccaagtagcctagaactctaactgtgaaacacaataaagccccacaacagcaaactttttaaacgacgaaagagagctctaaataacagcaaaatgctgctcttcttgctcccattatgtttactattactgtgctctagtgagaatagcaaggggtcaaaggaatttataacacttcctataccttcaacttaccaagtcccctaccaagtaacagttttctgtcagagagaaagttctgccctccctgctcaaaggtgtccatgccaactagacttcccctgtagctccctgggagaggtcaggcctagaacaaccttctactccaagaaggaagatgtggatgttgttgaatttaaatccattatctctgttccatagagccatgctactcaaagtgtagtgtgaagagtgtgctggctcaggaaacattttgttactaagctgtgacaaggagaagaatactgagagtaagcgtttagaaatgttgcagctgttgaatactgaggttgcactaaactcatgacctctcttacccgtggattagaccacctgcatactgttgaatactcacagagtgagtcacaggtggtatgacctacatattcgtcccatgcaggaggaccaaagctaggtctgccatagattgaaaataatgaagtccttcacttcagatagtttaggtttagagttgaatcgtgtcatcctttcccatatccttcaattccccagatgaaatgaaggactccccacactttctccatttaccgtggatgaactaaacattgactttgtttttgacttccataaaccacaaattcagttttctaacaatttacaacactcgttttaataaaatataaatgtggtgcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaataaataaataaataaatgtggtgaaaaaatttaatgtttcataaaatttttctatgtgaaggttgattcctatttcatattaatatgtaactaactagcaacccacctcagggaataatgagtccatgaataaaagctatattttcacatgtagatcaaatgagattaaaatcattctcaaaagcattttggcaatatagacatccacctcccccaaatcagcatggtacagtggaaagagcattgaattagatattaggtgtgctggagtccagaattagctctggtattaacttgctttgtgactttttgaagtctcaaagccttccgtactaaaacttcctcctctgtgacagtagcagtttgtatgagccgatctctaaagtctctgacaactttaaattttatacttcaaagaaaattattttcccttaaggtagtttcctgatggaagaataattttcgcagctgtgcatttactgccacaagatagactgacctttctgcgcttgtatgagtagctcttttactataagtttagcattatcagactttgcaaggctgaaatcacacaacaaatgaagcagtaaacctgacccccaaaacacgcctttgttatggggacatgagctgcagcttgcagatatctccggggctgtggcataactcacaggggcccaatatgacacaatgggttccacaaaataccaatatctataaggtactgtttattgaattgttatttgtctcacaagacctttctcagggggattttcaatgcctaacaatctgaaataaagccatctgtcctcccctaactcataaaccctacagtattaacccaggtcctaaatagaggttggaattgagtggcccccaggaacacctgggcatgaataaccgtgatagagttgactccgcagtattccattttttgcttatggcccaaaaccatgttttaagctttcctgaactacggagatggtgcatcctgtgcctgccaagggatttgtctaatgtgtgcgagcactatatataactgtgataactggggttagcttaaaaataccaataattcccataatgtttttcatctctgaaataagtggagaatgctgatgcaaatgaagaaaaattaaaaaaaaaaattggaactgtatggaaattacagagtaaaatgcaaaatgtctaatcatagatcactattcaaaagaatggaaaattcatatttaagtaatatgaaaatttaggcagtatactttagcaaaaaaagataatgaagcagtggtacatatgtatatgtgcatatattacataacatatataatttattactgaatctatcaaaaagctgaagaatatgagaaaagacaaatatattaatagaacactttgaaatgagatattcagtccccattatctaaaatatgattacaattaaaattatacacataaaaaggcatataaatacagtatgaagatttttcttctttttttttttgagacagagtctcgctgtttttgcccaagctgaagtgcaatggcacgatcttggctcactgcaacctccacctcccgggttcaagcgattctcctgcctcagcctcctgagtagctgggattacaggcacatgccacgacacctggctaattgtattttttcagtagagacagggtttcaccatgttggtcaagctggtctcgaactcctaacctttatgtgatctgcccacctcggcctcccaaagtgctgggattacaggtgtgagccaccaggcctggctgaagatttttcttatctaaattttaatttgaaaagagcatttacattctgggttttctagaaaagagaagagtgaatgacagttctctcacaaataaagcagaggaagtcagtggtttactccagggctctccccagcagaagaatgctagatcaaggattgaaacttatacacctggaaacagcaaaacaatacctgctggagttgagtgattgaaaggaaaatgcatgaaatgaacagagtcctggagtgagctagtcaccccttagcccagtgggccacaatggcttatagatcaaggtctccatgtaatagctgcctccgtgcaaatgctgtccaatagtgagtgaactgggctcttctcagctacaaaagtgaagccttgagatcatcaatcttgactcccccacctgtggagaaagtatcctccctatcattatttgaaccattgggactttgaatacctttaggtcgtatttttccagccctcttctgctggtgagtgtgttttctttccctccagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggtaagacgggtagacatgaaccaagactgagatacagaatgtcagttaccagtatagaaggcaatgggctcagagttctttattccaaattctgagaaggcctacaatgccattagtgaactaataatgtaaacatccatatagatcagagacatagtctgaattacagattcccagatatttaacttaatatacttttaaccagtgtgtctttcaagttttaccaacacatgtttaagaatatatagattttattatttcaccccaaatatcttaaagagaatatatttctaattaatcctcttcacattgtttccttcaatacccatatatgcctatataatgtatctgccttaaattagaatagaagaaagttgattctgcatatggacagcaaaagtgagagggctagtgttccataatgatagatgaaaaagcaaggctatatcagtcaaaagaaaaaggataaagattaaattataagtctgatgtgctcaggcaatgttacattcaatcaatgccaactatgtaaaatcttcaaattccttagttccatgctattgctctcctaggaatattattgcctaggtatatagacccatatagcaatgcattcttgtacgtctataggagacatgaatagaatttaaggggtaattagtgatttcctttccatagaaaactccctctctattttttccctctctatagaaaactgtatcatggccaggcgcgatggctcacgcctgtaatcccagcactttggcagaccaaggcaggcagatcacgaggtcaggagatcgagactatcctggccaacatggtgaaaccccgtctctactaaaaatacaaaaattagctggctgtggtgccatgtgcctatagtcccagctactcaggaggctgaggcaggagaatcatttgaacccgggaggtggaggttgcagtgagctgagatggtgccactgtactccagcctgggcaacagagcgagactccatctcaaaaaaagaaagaaggaaggaaggagagaaagaaagaaagagagaaagaaagaaagaaagaaagaaagaaagaaagaaagaaagaaagaaagaaagaaaggaaggaaggaaggaaggaaggaaagaaagaaagaaagggagagagagaaaggaaaggaaggaaagaaagggagaaagaaaaagaaagaaagaaagaaagaaagaaagaaagaaagaaaggaaggaaggaaggaaggaaggaaggaaggaaggaagaaagaaaaagaaagaaagaaagaaagaaagaaagaaagaaagaaagaaagaaagaaagaaagaaagaaagaaagaaagaaagaaaactgtatcatataaggtcctggtatagtgggaacctgctcttcccaagtgagcccttggtaatttgttagtaagcattccaaaggagaagaatcagggactgtctagactactgggcaagtccagaaatcatagctaacagtcaagccatatcgttaaggaccccaggtaggtttgatttgcttgttggtattagtatttttgtcatttgaaagggatgatccaatatgactctccacatcatgcagggatcacaaactaaaatgcttacagaggccaagcagataccataagtgagcaaagcatgcttgtgccaggaggtagtagggaacggtggcaattatggaaaattacagaccacatgacatacctaaaagagacagctgcctttcaagtcagagagttgtagacatgtaggaatttgagaacaagattgtggaatattccattttctaagaaaataaaaaaaatccagattttaggtgaattgtcctaatgtttttatttagcaacaaattcattaaaaaagaaaaagctgcattttatatattcaacttttaattaatatgaatataactaatcagataaagttcaactatcttccatatttaccatgaatacacagccaatgtgacttcctgctaactacctggtgttagaaatatgtgctatggagaaattaactttattattattgttatcatttatgtcctccaaataactttcctgcagaatgattgggctagaagatttacagctaccttcttgcttctttatttccaataacttctactgatgaaaatactaatatcgctagtgaagtgtatattttgccccaagtggtaagctctcctataatttagtcaacatgttttccaagaggctcagggaatcatttggcactggctaacaggatattatacctctttttgactttcaaaacaatgtcctattgccccaagcaagcttcaccacctcattttagataataaaagtgggagaagttagatgctattttttatatctcatcactgctgattttagttaaacgggccatagatcagatgagaacaccaagagtaggtacctttgcctgaatttttgcagaatcaagaccctcgtagaggagtaactatagttccttaatagaaccatctctagactaaattataaagtcaaaaactgtgcttttatcattctatctcccacctcataaccctaccccaccacatttcaacacccctttttggcaccaaaattcctgtctgttaacaatgatttaaaataacaatgtgtatcatctctcctaagaacgtttgaactttaacatgagacttttaattgacattccttctacagcatggaatataacttgaaagctaaaatttctgatagtacagtgagtgacgcagggctggaggtaggagggaacaatgcatttcttcctaccactttcctaaatgaatgcagcactttgaaaatcgctacctgctttcctgcgaatgaagctgacctagtgttgagtaccattaatattaaatatacatataatacaaaaaaatatatatataaatatacatataatacagagagatccaaaggtacccattcagtctccttttggccaacctcacccaagttccaaagttgaaaagccttccccacttcctagatgaaaagaaatacactccaggaatttttcacagttgttgtaaacctgtcatgcttttaaaccaaaaacaatgaaggaataattggaacagatggcagacctcatggagaatacatccattgagaatacagctgttggaaaaatttgtgagatgtttcttttatgatgaattgactctttacaaaagattagttgctattcaggaagatatgtgtgtgtgtgtgtgtgtgtgaaatatatatatgaaatatatatatatatatttcaagtgacataataacttccaatgtcatttacttcatttaagcaacaacaacaaaaacttaagttaaaatatattcagatattaaaaattatctgtacacttctagtcttgccctgactaactcccttatggctgcaagctctgtcccataatcaaagattggcagagtcacaacacaaaattgaagactttgcttcttagagacactcaggacaacagctctggaaatgtacctcctgagagatttaaagtaaaactctgagagaataagagcatttaaggtttgaacagcttaccaggaggctgaaaattatctttctcagagaccaactttaaacagagatcagattttcatctgtctgaaatgttttaggtattgcgcagcctggaggcagaaggaaagcatcagtcaacatttactgagcacccactgtgtatgctcctaggattattactgcaacaactaacataagaatcattcttacactcttcaaagcactttcatgtacattaaagcaaagtgctcttggttcacttaattgctcacctgctatgggtatatcaatggtgctaatttttacactagccattattctgaggatatttaagcaaacagccaatatcttttaattttgttttcaatatccatttttttcaccaaaaattcatactcttgataagccataatttcactccaaagcattttgctcttcttttaaacttgcttttgaatgctgacgattatttcaggaagtcttacaaggaaaactgataacaaatgacacaaatgttaaccttctgtttttctaacttaaccatgccataggacataaggcttatgtaggggtgggagtaatggttgggaacactgtcgtgaaaacaacactgaaaagtaagaagtcaggaaacttgagtttgattcttggctgtgccagcaactatcagtttcactcatactttcagttcctaaatttcttccattctaaaatggaatgtgtactgaactgtaagtggactggactgtatcattcctaagatttcttctagtcctaagatgcctcatttatcaatgtgcttccaccaagaaaaactttaacatttgcaaatagagaaaaccagggtgtactacttttctactgagtagaagaaatgctaacaagagttcttcacattcaaggacagattaattgaaagaatcttactttgcctcttcctttgcattgattaaccaaaatccagtattgagaagctatgtctacaggtagatgttggcactttccaacccttacataattaaaagttcagtggcattactaggagatagagaataaataatattaataaagtccttgcaaattttccaaacctacctgaattttgtaggatatttgaattattcaaaacctactcttaagtttatcttaataggtgcattaatcagtatgtactaaccaacatctgcaaattttcagtggcttacacattcaatgttaatttcttgatcttgccacagtccagtgcggattgaaagagaggctctgctttctttcaatccttctattcaaagttccttctattcaagttccttctattttgtggttccatcattcctagtgacttgaaatcctttccttcttgctatatatttggaaaaagagagagagccaaagatcatgttgggaagacatcatcttagttcctattggctagaaaccagtcacataaccacactgaactgtaagggaggtgggaaatgtctagttactccccctcagaagaagaaatggcactgctggtcatccagccaagcccagtcacaatatgagacaacaaagagcctagaaaaaagtaaggtctaaataactgctaacttaaaaaatgtaaccacaatatcgataaatttggaaagtagaaatggagacttcatttcttcataattaaagggtgacaatctgcaaggtggtcatcccgtaggctggaaaacatgtgtccaaccaagatcaaagacaggcactttgaaaaaagaggggttggggcaagagctttatgccgaatgggttggctaaacatacatattaaactggttacaggcggagctatgaatatttatgaagatgatcctgacacatgcatattgaacaaaaatgcatgtaacatacaatccttgtccacttcggggtagagacttaacatttaatggttttataattaggttctatacgtcaaaatgtcttgcaggacacaatggcatgcaagggtacactctctttaatccaaccagaaccagtctaaggtcggtggtcttcttctctggagaaagttactgaaatcaggatcttgtttaatgaaaggtatatctggtggaacaggggctggaagtcagtgtctaagagttggatgagctgtagttgttttaatattgcttatcttgaggccagtgcttgtttacctccttgagaaaaagaaaagccttgtagcagttggagcatagtttattttttaagtccaaggctgtgtgacttaacccttgtctggcatggccttcagttctgtttataatttgatatcttattgccacaaatagactgctctgtctgacctcccattccggtatggctgcaaactaagttcttaagctttttctggggtccctttggttacaaaagagggtcgttcagtcaatgggggcttagaattttatttttagcttacacagtgaaatctcttgacatgtgaaaagactcataatgatctcaccagaaacaaagacatgtcatagaattcctagctttgcttctccttatttaaaaggagcaaacaatcggggccaaagttaatctcaacatgtcagctatcttctttccaattatatagtgccttcaaaatataggagtgaactttcctgtcctttgcaagtcaatttgtggattggggtctcacaacagccgtaacatagttatgacaaagatgataattaagaatacttctggatgtcttcttcaacattttggtgaccaatatccagatggttttacttccaggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggtgagtcatctctttctaggactggttagtttatagtttgcattatctgtcttaagtttgggggtttttaaggatgtttgctctttttcagtctattgaattagatgcccagaagagccatttttgagttagagcagagagctattgaatccctgccaggtgctgtgggcactgcaggtccatcatttattaacgacaaggaaggggcttatacactaaatccaattagcattatttggaaagacagtgcagaaattccaaactcagttaatttttgaactgttgtttgctcgtaagatagaaaccctagatggaaaaaggcaaaaataaatccaaaattggaaaagatataaaaagatatttaacagaaatgttaccagcccttaagtatagattctgagcacatgtactaatgcaaaacaatttatataaatatgtaaaagtcatactacgaaattgaacacttctatcaaagtaagatttgtaaaaggatatatcacctcaaatttttttttgccaggaatgtcataaacaatacaaaatgaaaatgcaatgtatatgagactttatttttctaaattgtgtttgggattataggacaactttagtagttgaccatttttgcctactacttttatttctgaaggaaatcacaccatttttgaaggaaatcaacttacactcttttgaaaaggctgattgtgatttaagataattccttcataaccatgctagaataaacaaaatataaagtttatggtcatcatagtgaatcaggctctgctttgaatttttaaatattgttagaattttaagactatgactattaatgacagagccagtttaatgctctcctgtcatcttgaaattctaaataatttttgaacaaagtgtcccatattttcatttcgcactggaccctgcaaattatgtggctggttctgattaataatctgataatagatccactttctttaagtggaagccctccttaagggcccaaaactggggatgattcattataacctggtttcacatgaaaatcttccccagaattacaaggcaactatgacaacaatgaacacccctttccaaagctcttgttataagaagctgtttctttaattcaaagggagaatgaactgatctgctttaactttcaatttgctcttgaggtgtcttgttttatgcaactaatttggaaaataaaagcttgtatatatgatgctttaatgtgcttttcatagttgccagcttcatgtgatgtaaattttcatttaaacattcattcttgcttctgatttattcatttttctatatttttttctcatttcttttgcatgcaaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcatgaaaaaggagattcagactttcaacagggcaaagcatggaaacacgatgctaattctatggacttcttttcatctttgtgaactttgttccctcctcttttcttctccctgtctcatatattgtgtagatctgcgtattttcaaactacccaaaacccttaccttttcaacagtacacacataactccataacaatgttaatttttaattgaaactgattccacgatttaaaatgtattatttacacaaagactcaaaagtgtcttagcatttaaagatttaaaaaccgtgatccacagaaagaaaactaaacttgaaacctctggtgtcacagaagagcactagctatgttgaacatcactcatggaaacagaacacagtcaagaataattcctgggcagaaattcattaacctcaaactctcaaataacatttacttgtagaatttaacagtcttctgtaggttctgagtctctaaggaatggtgatatttttcaagctatatagtacttctttgaagatcccagcaaagtcctaagctatgtactaattcatttctatttaccactcactttgcattgatgaacatctttctacgagatgttatttcacttccttcccacttaccctagatagaggggttgttcttggaacaatcttttctgaacatcaccattttcacagttatttctttggatccatcattattattaattcatttaaagtattctggggaaacgggcaagaaggaaaaaataaaggaaagaatgtccatacacattagttacagatctctgtagattcattttccatctgcattcaaagtgctgtaaataatttccatgctaactcaaccaggtgacataaaaaacctcttgcacatttaatttgttgtgacagagaatatctgatgattcctcactagtgaataagagagttgaaggtgtgtttcatcttttctaaatatgggatcagttggtctttattcttttcttaatgggattatcttttgacatatcaagaaatcccctaaagcacttccttgaagtagagatatgccatctgtgcaatcatacagcattttaccttctctttgcttagctttaaatggctcccagttttggaagccacaggcttctccaatcaactgtatatttctccagtaaagcatattcaggaaagttgactagttgattcttatcctgattgtttctcagctttgcttccttctttaaagaaatgtactcagaagaaaatatcataaattacactaacattgttttattattattaaactagaagcaacatactatttgtcccaggtcagagttcacattttcataatcaatagaatcagatgttgggatgaatatgacattattcttagtttcatatttcatggattcagtatatagaaaccacaaatttcctaagtttactctcccaaagacaatttaataaaccaaaaatgctaccaaaagagttcaagtgtgattgatgaagtattgacaatcaaaattaacaataactgacaaaacttaactttctgcagagactattacttaaaagtgtaattcagagatttggataaagaaatgatctctttcaaaagttaatatttctatactactttagactgtatactacctaattctgacatttatgtattattttatagttttcaaaatgttttcacatacattacatttgatcctttcaacaatttaaattcagctttactaacagagaagtagatatccatcatcgacctgtagttatagattttagaagcagaagaaaattttctaaaacagccaaacttagattcaggttctagcagagccacatgctgaatgactgcaggcaagttaccaaacttctcagtctcaatttcttaatatgtagcagtgggacaaaatttctggaacacaaagttttgtaggggtgtttttcaaaatgtgttcaattggcaaatgtttctcaaatagaattttcatagttaaataacccatagagcgtcactctaaatgttcctttactacatgctatctcagtgtgcgtcacaagtttttgcgcattgagaattttcaacaaagtagaaaagtattcagcacttctgaagcctattagattgcagatttttttccccacagcatcttgacagaccagtgttccacagatcatcctcaagggaacacaggtatgatcatgtgaatctcatcccataatagtgtacaagacatcttgcattgtgcttggcacatagtagccactcaataaataattatgtattctttagagtaaatttctaagcctcaattttcttacttgtaaaatgaaggtaatattatggactttatacatttactatgataattaaataaaatcatggcatagaaaatgaaataattaataaaagtcctgttaatatatatccgttaacaactgttggtaccttctggagaaactaagtattgttctctggtcacatgggcagtaactaaaatttatcaagcatcttaaaatggaatctggtttagaaaattggttttctaatttagaggctcaagctctatctctaagagcagtttttcttgtacaagcattacaaatcaatggcagaggtcactgcactcgaaagaaggacccaaactggtaatatgtgaagatctatagtagaagctctggacctcgtctctagaaattctaatttaattagttggggcatgacaatggtaattttttcagatgcccagttgattttaatgtgctggaaacgctgagaaccactaagctaaagcacaaacttatgtacataattagaactcaataaatcattgctgttgattgcttgattgattgcagaggtagagccactaatcctatgcagtatgtacaacacatgtttggcattcaatctgacagaccctttccacttagaattcaggaaaaacctgcacagctttgaggtggaaattttatgatattcaattgatatcatgattagttttaaaactatagagctagatcaactcagaattatcaagtagacagtttattgctctctctgtacccttccttcctggagaaatctcaagtacttactttcttcacacttttttttttttttttttttttttttttgagatggagtctttctctgtcgcccaggctggagtgcagtcacgccatcttggctcactgcaacctctgcctcctgggttcaagcaattctcttgcctcagcctcctgagtagctgggattgcaggcgtgcaccatcacgcctggctaatttttgtatttttagtagagacaggagtttcgccatgttggccaagctggtctcaaactcctgacctcaggtgatccacccgcctcggccccccaaagtgctgagattacagccataagcctccgcgcccagcccacactcttctctttctccctttatactgattctcaaccagttcttgccatcatgtcaatggatgctaagaccacagtgacccgaccaggaaccactgcatttcaagcgaactgtagaacaaaagacttgaatatgaaaggaaaacaatttttttttcaagctttatgtttacattattagttctcctactttggtgtaaatcagaaccacctggggaaattatccaaactgctgtttacaggctctacctctcgacctttctcctcagtaggaagagtccaggaatctgcatttacaatgaagcctgaaagtgaatgactaaaactagttgtatacattagttttcataaaaattagcttgaacgtagcagttttttcccaaattaagtcacatacatgattccttcttaaaaggatctccaatacaagggtgtttttatttttatttttttaaatagcttttcttacatttttttccccaacaatcctaacggtagttgcattatttaaaagtagatagtaaacatgagtttttattaaaactagcttgaatatagtggttttactagttttatttcagattagctgttgagcatgagtttttgttaaataataacagattgtctgtggattatactttgaaaaatactgtttaagcttagcagagagcagggaggcattaaaagattgaacaagtggctggtagtggtggctcacacctgtaagcccaggagttcaagaccagcctgggcaacatggtgggacctcatctctataaatcaataaacaaacaaacaaagactgaacaaatgcatcaacagcaatgaaacatagtgttgtccaatttgtttcctaataagtttgcttctaacctaatgaaataagggaaaaaaattaagctttatattttactttgttttaaactaaaattataaattgaattattttagagagtttttcaagcaaaattggagctatttaaggaatacatggtgggtaggaatcttgccgttgggaaaatcagctggatcatatgattataaacctatccaaggaaaattatttccaaatacctcactgcatttgactgatattatattatgttctgtatgagccatctgtggcaatgcagtactacaatgaatcccaattagtttccaagcacatgacccttataccacaaggtctatttcctagtaagcaatttagagagtctgaacagcctttaacagcaaaaggaaagcaaagcagtcttacttattagactattttctgaacatctaacagtgccaaatggtattattaattaactcttgtagataataaaaaaaaattctgcttgatgctgcagttttaacttgcctttaggaaacatctcattatgcttctcacagttatggaattttatgtccatatgcacaagcattttaaaatcatttttgctttttctaagaaaatcatttttgctttttctaagaaaatcaaattttctaagaatttctaattgcaaagatatgaacatccttgtgatagaaagtcaacattacaaatgcagtgtgtgaatttgaaaccctgcagaatttgaactttgttgttgtcagcccaaatacggctaatggcccaaagtacacaacaatgtgtgtccatgttgcaatgcatacatccagataagacacaaaaatgagtaagacctggatgatggaataaagttactgtatttccccctagcaactaaaatattttaatttaacttgaccagaattgtctttctccccagtttttcaactggagggtttagacttaaaatattcaaatattctgatttttcaacctaagacatgaaagcagtcctgatcagtttaccagccacaaaaaccaagaaattactgtcatttgataacccactcaaccttggtatttatctttcctcggtgttccttggcatattatcagatgcttccaagagtcttcagttctatttctctggagtcggatcaacttatttagcaagtgatttgcaaaagtctctttaattaggttatttttgtaatcgtgcaaagaggttttcctttgcctgaaaactcaaacattcattaattattagaaaagccaggaagcaattaacatcaatttagaaataacgtttctaatatacaagttgatgttgtcttatcaaccaaacgaactctgaacgatgggcatggcccaatagacaggtgacttgggaatcacatgccaagaactcaggtttccacactgctgctaaagggctgtgtgtctttgggcaagtcattttacttccctcaacctcagtttcttcatctgtggaatgaggaggttgcatttgaagttctctgccaaccacaatattgtttgactctagtagaaaatgggaaggaaataaaaacaaaaaacatagaagcagtgataaaaagagatttttgtttctacatttctttatatggttatgtgtctctcttggacacatgaaattcttattgccatcagaatgactgtgtcctgccagtacttcaaggcagaaaggcctcccctggatatagagaaaatggccccactagccatcatgacatcaagaagcaagaaggttcccatctaatgaatcataagcaaatcattacagacagagtgaattttacagaagtagaattgttcttgaccttaatgagcctacagaccaggtaaaacaagacaaaaaagagatacgtacctaggaagctatttgaagctgtagaaatgaatacacattcacaattcacaaaagaggatgataaatgagactggacctcataggaagactctctctattctgtaagtgtaacttagtgtttcttctaaagacagacaaggagaaataaagaggacagagtgcatttattttctattgtttttatccctacccttcttcctaccatcaagtatgggagtttttatatgaactgttctcaaactaaaaatgagttaaacttttagcttttgagatgttaagtagtccttgcagatttgtagcacagagaaaaatcttggaaaccatggtttttaattgcaagatccagatgtttcattgaatatgtaagttgttataattcaaaaaagtttatctataattggccagagccaaaacccaaaaggctaaggttggagaaacagagataatgatattttactacctgatttacctaccccagaccagattctgaccattaggaaagagaaaattggaggaaagtcacaaaggttagatactaccttaatctctgtgaggaggctattcctaaaccacttaccatctctgagccaagttcacacttgggaggatgaagaagaatagaaaccacagaaaaattaaaagggaatcctggacagaaaatgccatttttacttcacagggtgaagggccaggaggtgataagacttgtagagacattttgtatgccactgtctccggaatggcagaataacagcgtgtaggcagtgaagctatggaatgtttcatacatagtgtcttcctcaatctcagagaatgcagggaaaacagccaaaaatccatggctcttctcacccaagaggcatgtgtggaagggctgagagaaccagtggactggaagacttgaggttagagcgggaaagacacagggtgtgtggatgtgacactgggaccatggtcatctcagagggcacagcagagacagaaatcagtgttcatgacctagtaggatgtcacatccccatggaagacaaaaggacagagggtggccttggactagctgatcctgggccctctagacacttctccttatcccagctgacccttggaaagaagagaagagagaagggatgtggagagaggcttgcattaactaaaacattaaccaaaagaaagcattttaaaccaaaagtgaattaattaccttgagttgataagacacactagcagatggggaacctctaagctaaggtgagttctatttttttaaatagtatcacataatttgtttgcaaatccaagtttgtagcttgagaaaaatgcattcccactaccataggcataaactggtaccccgaaaactatgcatgtagtgcatacgtgcactgtggacaactaacaccctacacatcacggtcagtttagcttaaaggtagggccctgaaagctatgcgtgtagtgcatacgtgcactgtggacaactaacaccctacacatcacgatcagtttagcttaaaggtagtgccattccctgtagagaaagggcatgcaaagaatttcttggaagtttattttatggccctaattcagcctctgaaatgcaataaaacaaaaacaaaaaacaaaaaaatcaagcgttttccatgaggtgagggaaagccaatccatgcagaatcctctcaggccttcagtgcaggaagccagagggaagctagagggccaaggcacaaagccacactggcctctgacagtgactctgaagaggagaaaggcactgtgtggtttggattgaaggacaaacccacatttctgccacttttaagcaagaagagctgcttacttccaggtatacaaggcccactggaagcttatcctcactgcaggaatatctctctgttctctgctcatagcactggactgggccatgtttcatgctcccttttataccatcagctattcatgtgtcctttctagggcaggaaaatgttttagctgctctggagcacccttgggaggccatgggagtctcagaggacagtttcaggctggcctgatggcataccccactgacacttctctgctccattaactgcctcttctgaatgcctgagacagagactgggctatggtttccctgtgttctcaggtccccacacctatcaggctgcatgggagtttgcccccagagaaggcagaggaggtgcccctcctcagatctcccttggcatctaggctttggtcaagattctcacatcacctgattgaacttttctccttgagagcagctacgagacaaccctttctttacactccatcctcagtcctataggctgagtcctgaagcctctaagcttgatatttaatgtcaaacttttacaattcaaagtacctgccttttccttgtttcaaacacctgactgttgtaattaatagcttcaaagactgcagcgtcttctacagatccacaaaagtccatttaaaaagctcaaagctccaaatttgagtcttttttctttctatatcatccctaccctgaagataatgcatataaaagcacttgctgtaacttgaaaagtgagaaaaaggactgggattcagaagaactggaaaaaagcacacagagtaatatcaaaatattacagggcctcaatgttaactccacttttcaaagttttccatgacattatccctaacgttagcggaggatgaacttacacatcccctacttgtcaggaatgtgcactgggtagccctgcgtggccaccccatgtgcaaaattttttaaggatcattttttaaaattaagaatccctatggattgtgcatgccatttaaaaatagactatttttctgttgagagaataaggtttctaaatgaaatctttaaataaagatgaacaacaggaggaagacacttgtgtatctgatgtcatggagtaaccctgtgaccctcataggtatatttttatggtttaaagagctcatttaggagaacaaggaattctagggcatgcgttcatgcaaacagagaaacttaaatctaggatctgagatggtaaggatgttggcatcaggtcccaggtgtgggaacaaaaattaaatagagcagaagagacaacatggaggtaatgaaaacatgacattagcaaacacgggaaaaaggagttcatgaagtctacatgctgtagccaaaggaaaggaagacaggggctttcgagagtcatttcccatggggagccagtttaaagctttaaagttgcaagaaaacgggccaggcaagacgtggctgctgggtcacaggtggagattagtatgggcgaccacacttgtacattttatttcagtggctagacttccttcaccccaacattctttacacggacccaggagatgagaatcagctttctcattagctctcaggcacaaatcaacataaccactattctaaaagctaatatggtgatcaacactcaacctctaggattcactttttttaaattccaaggatgggtgcataaaagatggcccatgggttgtgaatgcgctcagaaaatggatcaaaccacaggaaatgctgcccaaatcctcagttctggaatgcaaaaacttcccacaagggtagtacacataaaactactccaaaaatctccttccacctgccttcacataattagtgagagatgattaaagcctgacctctgctcttagatcattaattctcttggaagggagtgaaatctgtggacagataggtgaccagactgtacaagtctctatgttgcaaatccctaaatacaattcttctgttcctattccttaaaaactttcctgactgtatcctcaaaccatcctaggtttgctcctacactagagcttagagttaaaaaatgttaaggaagtgaagtttttgtctttctttaaaaaatataatcattgagacactggctccacagaactacagcaggaatttgaccaagacaaaaaaaaatagtaataataatcccattatttttcaggaaactatttctttaatagtctacattttactgaaattgtctttataaaaatactccaaatcatagcttgctttcaacttatggtaggtctatacataaaatgcaaggttttacatctatacaatgacaataatatcctctttcttcctttttcctacatcctttttcttccatgtgtaatgtgaaaatttatcagactgtgtcacagagcacttcaagtgcctttgaataaggagcctattaaagggagaaacctatacaaaatgtaagatttgtattgtattattggctaggccagagcttctgaaaaataattcctcagaaaaatcctcaagggtataagcatccaaagcagttctctgaaatgtttacctatacctaccaatgaatgaaagatgtgaatgtataaatgctaaatctacaatgagaaatcaatctgacattcacaatctgatgtcaagtttgcaaccagtatgaaagtcaattccatatagtctagttttttgaatactgcaaactcaaatccaattcttgcccagagctttatctataacttaaaaaaattgttattttcccctgaatcattcttcgtgaggcagagtattttaggtacaaaacaaatagaactttattagtccctcccaccccatccagggcaacatttgcaacggaaggataaaggtgtaaagagaagatataatttatattcaggctcacacaagcttcaagaaatcaaacatttgaggttaattcaaaggaggtgccatgaagccagcaattaaaaaagaaacaaaccaaaagggaaggtaaaagaaagcaaagaagacagaatatgaaagaaaagggggtccttagggacacaccacaagcatggagggatcagagtagagaaataactttctgcaaaactgaaataaacaagcaaatctctctccttctaaagccaagagttttagttgaagtttctatttcaatctctactagactaacttgtgtttctccatttcctttcctctaaaggaaaggtcacacacacacacacacacacactctacattatttttggataatgtcagaaacagcataaatggcaagaacatactttattactataaattcatttgtaaatgaatttttctatcagacattattataaaggttcatttattaatagatggttcataagcacagagatggaatttttaaattgccggggactgtggtgagcttttatttccttctgatgttggagtgcctatgtataaagcacaatacaagttgtcataatgcctacaactacatagacacagaaacatggactgggcaaaagaagtggtaataggcattgaaaatttatgttttaacacctatgggaactattttaactaaaacactagtataagcaactcaaaggaattgctgcacagatgtgcatcagatggctcaaattaaagaaccatcaaccttttcattgtatctctcccacaaaaaaaaaaaaaaaaaaaaagaccgtgagtgcaatgaatggcatagagttaaaatatatactatggtatataaaactttattttaaagaaagagcatacttaaaatatgccacccattggactgttttgcatataacagtacattgaattatcataatagttctatgaaaatgattctactattgtctcactttatacataaggaaactgagtccaagagaaaataaataccttgcccggtgtaacctggctactaggaagtatagctgaaattaaaactcattctgataccaggcaccaattctaaactgtaattaaaagtcacttgtaggccggacacggtggcttacgcctgtaatcccagcactttgcaaggccaaggggggtggatcatgaggtcaggagatcaagaccatcccggccaacgtggtgaaaccacatctctactaaaaatacaaaaattagccgcgtgtggtggcgcgcacctgtagtcccagctactcgggaggctgaggcaggagaatcgcttgaacacaggagacagaagttgcagtgagccaagttggcaccactgcactccagcctggtgacagagtgagactctgtcaaaaaaaaaaaaaaaaaatcaagtgcaagtgtagatttattagaaatgtgaactccatcacatttttaatccaggccccagatccaggctactggaggactttccagtatgcaaagtaccagaaaatactacctgagtatcccgcctccttttgcagtacgtcttgagtaaggcagctagctgaatgccattatgtttgatactttctcatgaaagtaggatttaggaatttaaaccaacatactttaaaataatgtttctatggctctgtgaatatgaaaaacccaagcctacaaacagaagttttagaaagctacagtcattttggtcccagttcagaagctcaatctttatatgtatccttaattctgagatcataaaaggcaaattaattaatgaatatgagcccctcccaagccactctgggctgaaagatgaccttcacaatttcatttcctgtggatccaagaatgtgtggtttactcaagctcatggctgggagaggccttaaaggtcacctttccttgtgactacagcaaaaacttggaggcagaaaggtcagccccaatatcttgccattttcttttcaacagtcagagacaaagtgagaatcaaaaagaaatcattgtttgcaaccaaagaccaagaaagccgcccactgataaaactatgtttatatttgctctcacacaagcagcaagaaataaatacttggagttagtcaagagtaaagatgtttgttgtactttaaggcagtctaaaatctgggggaggagttccttttttgaaaaaataaacttagttgaaacagattgtcaggtaatatctatgaccactcttctacccaaaatagggaaaagaggtttcaatgagaccttcctctgtgtgtgtcaagtcacagtcagagattcatttgggcgatttcaatgtaaaatgaagtgacatgcctaaaatcaaatgcttgagagttcaagtaaagcagaaagattggaatttcttaacataatggtttttgggaaaattcacaaaaagctatctatagtgataaaaaatatttttaaaaggtaatgtgtagatgatttctcatgaaagctcttggtttgggcagtccagatatactgagttcaaatgcaagctctttttcttgggtaagttacttaatgtctccaatagtaaatttccccatctatataaagggtataatatgtaataaagtttgcaaacttcttgacactcttttctttcctcctttcgttccttccattttaatgccaaaaatatttcttccattgaaataaatttctgagcaaagtttgcaaaactctgatacaatactatatatcacaattacactataaaatattaatttgctcttagtagcaacacacaagctttatatggtgtaatgttaacaaattattatatttcattcatgatatacagacatgatgttttgacttacaattttttgactttgcagtggaacggaagtgatacacagactagacaaaccatactttaagtgcccatacaaccattctgtgttttactttcagcacggtattcaataaacaaattatatgacagagtcaacactgtattataaaatgggctggatagataattttgcccaactgtaggctagtgtaagtgttccatgtgtgtataaggtaagctaggctaaactgtaagttaggtgtattaaatgcaatttctccttaatatcttcagcatacattgtgtgtattgagacacaaccccatagtaagtgagaagcatctgtacttgctataacattttttaagtatagttcataaaaaactttctgacgtttttctttgtgtggcatgacacccctcccaattcactgaagccacaacttactgtttgaaagaaaattagcacacatgacatgagtttttatgtttctgtattacaggaaaatggaagtgaaattcaaatcctataaacacttatgcttaaaagagataaaaagttttattcaaagaaccagttttttaagagacatacatctgataggccaatagtttacacctagaacctaaattctaggcctggttttgaaatcaagtagaaaaaatttaaaaatagaaaaattaaaactactacttctctaaactacatcaagttatttttggaacaaaacgaacattttcaaatacacatgttgcatgctgatacacaagaaacacactagatgtttagtactttgcaaacatagaacacaaatttcttcccgtaaggcagttacaacttagacacattacctggtggcacactgtcatttgactttcaaccatatccattttgtgtgctaaggttaaaaaagtatgcttgcacttctataacctttaccaaaggctatggtttttagaggattttttttttattgtgataaaaacacttgagatctaaccgcttaaaaatgtctaagtgttcaagacgatattaactataggcacaatgttgtacagaagatctccagaacttatttatcttgcataattgaaaccttatatccccttgagcagcaactgcccccatttcccttcctcccagcctttggcaactaccattctcctctctgttttcatgactttgactattttagatgtttcatataagtggaatcatgctgcctttgtcctcctgtgctggctcatatcactagaggatgttttaagagtgacctcatcaaaaagaaaactactttttagaaatttctctaaccaggacattatagaaatttctctgagcaggaatttttcactcaaaggtcttatcttggctagaaaaatgacagcaaattatgttttattggtccatttatgtactatgcatgtgaacagatatagcataattgcaatgcagattatatatattgtctgtatatgtagaacattttttaatcataattccgttttccattttcttttgtattatgccatcgtttttgctgtgaagttcagtaccacattatttttcatttcgaccacagctgcatcattgctgctgccagaatctctgttttttggagaaaatgtacaatttaaaattgtttttttttcttttttttttatcagaaaggaaagtcatcaagaattagattttattttaggaacaaagtaaggtttcatgggagaaaaaaacaaagccttggtgtagagaaggtttgttcattttctatagcattactgaagtgtccgtatgccttgataatcctatcaatgtttggatcatctcagtgggggaaatgacttaatttaactctattttggtgtctcagcaaaggtaagttatctattttgagagccctgagtttgctttaactgggtagttttatactactgcatttgtgaatgaaatcccaaagtttgcccagctaacttgccatctcagtttccccgattagaaaaggtgggtggccagcgggtggaggaggaggtgatgggaactggccaattgtgacagagctgccttcaagccaatatcttgtgttcataaatacctaggcaagaggcaggtcaacggcacatgcgataggcttaattaagctgatggtctgtatctcatgttccctagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaa

SEQ ID NO: 173 - DNA, 523 bp, Homo sapiens
gaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcacctgt

SEQ ID NO: 174 - DNA, 324 bp, Homo sapiens
gtcagcccaaggctgccccctcggtcactctgttcccgccctcctctgaggagcttcaagccaacaaggccacactggtgtgcctgatcagtgacttctacccgggagctgtgaaagtggcctggaaggcagatggcagccccgtcaacgcgggagtggagaccaccacaccctccaaacagagcaacaacaagtacgcggccagcagctagctacctgagcctgacgcctgagcagtggaagtcccacagaagctacagttgccaggtcacgcatgaagggagcaccgtggagaagacagtggcccctgcagaatgctcttag

SEQ ID NO: 175 - DNA, 1717 bp, Homo sapiens
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttggtgagaggccagcacagggagggagggtgtctgctggaagccaggctcagccctcctgcctggacgcaccccggctgtgcagccccagcccagggcagcaaggcaggccccatctgtctcctcacccggaggcctctgaccaccccactcatgctcagggagagggtcttctggatttttccaccaggctccgggcagccacaggctggatgcccctaccccaggccctgcgcatacaggggcaggtgctgcgctcagacctgccaagagccatatccgggaggaccctgcccctgacctaagcccaccccaaaggccaaactctccactccctcagctcagacaccttctctcctcccagatctgagtaactcccaatcttctctctgcagagtccaaatatggtcccccatgcccatcatgcccaggtaagccaacccaggcctcgccctccagctcaaggcgggacaggtgccctagagtagcctgcatccagggacaggccccagccgggtgctgacgcatccacctccatctcttcctcagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaaggtgggacccacggggtgcgagggccacatggacagaggtcagctcggcccaccctctgccctgggagtgaccgctgtgccaacctctgtccctacagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaatgagtgccagggccggcaagcccccgctccccgggctctcggggtcgcgcgaggatgcttggcacgtaccccgtgtacatacttcccgggcgcccagcatggaaataaagcacccagcgctgccctggg

SEQ ID NO: 176 - DNA, 1739 bp, Homo sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttggtgagaggccagctcagggagggagggtgtctgctggaagccaggctcagccctcctgcctggacgcaccccggctgtgcagccccagcccagggcagcaaggcaggccccatctgtctcctcacccggaggcctctgcccgccccactcatgctcagggagagggtcttctggctttttccaccaggctccaggcaggcacaggctgggtgcccctaccccaggcccttcacacacaggggcaggtgcttggctcagacctgccaaaagccatatccgggaggaccctgcccctgacctaagccgaccccaaaggccaaactgtccactccctcagctcggacaccttctctcctcccagatccgagtaactcccaatcttctctctgcagagcgcaaatgttgtgtcgagtgcccaccgtgcccaggtaagccagcccaggcctcgccctccagctcaaggcgggacaggtgccctagagtagcctgcatccagggacagaccccagctgggtgctgacacgtccacctccatctcttcctcagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaaggtgggacccgcggggtatgagggccacatggacagaggccggctcggcccaccctctgccctgggagtgaccgctgtgccaacctctgtccctacagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtctacatacttcccgggcacccagcatggaaataaagcacccagcgctgccctgggcccctgcgagactgtgatggttctt

SEQ ID NO: 177 - DNA, 1546 bp, Homo sapiens
gcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccaggtcagagggcaggctggggagtggggcggggccaccccgtcgtgccctgacactgcgcctgcacccgtgttccccacagggagccgccccttcactcacaccagagtggaccgcgggccgagccccaggaggtggtggtggacaggccaggaggggcgaggcgggggcatggggaagtatgtgctgaccagctcaggccatctctccactccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggtgggtccagaccctgctcggggccctgctcagtgctctggtttgcaaagcatattcctggcctgcctcctccctcccaatcctgggctccagtgctcatgccaagtacagagggaaactgaggcaggctgaggggccaggacacagcccagggtgcccaccagagcagaggggctctctcatcccctgcccagccccctgacctggctctctaccctccaggaaacacattccggcccgaggtccacctgctgccgccgccgtcggaggagctggccctgaacgagctggtgacgctgacgtgcctggcacgcggcttcagccccaaggatgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagc

SEQ ID NO: 178 - DNA, 1734 bp, Homo sapiens
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttggtgagaggccagcacagggagggagggtgtctgctggaagccaggctcagcgctcctgcctggacgcatcccggctatgcagccccagtccagggcagcaaggcaggccccgtctgcctcttcacccggaggcctctgcccgccccactcatgctcagggagagggtcttctggctttttccccaggctctgggcaggcacaggctaggtgcccctaacccaggccctgcacacaaaggggcaggtgctgggctcagacctgccaagagccatatccgggaggaccctgcccctgacctaagcccaccccaaaggccaaactctccactccctcagctcggacaccttctctcctcccagattccagtaactcccaatcttctctctgcagagcccaaatcttgtgacaaaactcacacatgcccaccgtgcccaggtaagccagcccaggcctcgccctccagctcaaggcgggacaggtgccctagagtagcctgcatccagggacaggccccagccgggtgctgacacgtccacctccatctcttcctcagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaaggtgggacccgtggggtgcgagggccacatggacagaggccggctcggcccaccctctgccctgagagtgaccgctgtaccaacctctgtccctacagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggccggcaagcccccgctccccaggctctcggggtcgcgcgaggatgcttggcacgtaccccgtgtacatacttcccaggcacccagcatggaaataaagcacccagcgcttccctgggcccctgcga

SEQ ID NO: 179 - DNA, 64559 bp, Homo sapiens
tggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcaggtaacgggagacccagggccccctcccttcctggatatccgtcctgcgatctcccttccccaaagccccggtcccaggagccccagaacctagagagaactccccagctcgggattctggattgggagccagcctcgtccagccctctggcccatcgcttgcacagccaggagagacccgaaggggagcggaggttggggtagaagcccccggccctcctgtattactactgcggaatgcgggggaccccgcagacagccaggctcccaggacggggcacccttggggcttcagtttccctcgcatctccaagctcgctctgcgggcgatttgccaggagaggggtccatggagagagcgggagacgaggggcgcccggctgaggaatagggcttgcctcctagcgagtgtcgaggtccccgggtccgtgcgtcggtctgtccgtccgtttgtgtgttctcgcggtgaacgcgggcggacccccagtctctccgggagaaacttgggtctgcggctggcacgaggtctttgtgtccgggtgtctctccggctgcgagtggttttccgcgtctccgctggggggcgggggacagggggcggggtgggggagggtatgagggtgttgcggcgtccttcccccaccccctctcgcccctataactcgctccctccgtccctctcggactcggactcggggccggtgcgcgactgagctggcgcctctagccgactttgccaagagggcgcctcctgcccgatccgcgctgaccctgcgcgggacgcagccccaggcggctgcctagccgaggcgggagcccgagctgagtcgagctcgccggagcgggtgagtcccgagcccgatccccgccgggctggaccctggcgcgcagctgcggcgtctccggggagtcgcggcagggggaatggcgtgtcgcgccctggcggcgggagctgcgggagggtcggcgacgtggcggccggcccagggtatttacctgctgcaccagtgcccggcagccacgctcgccggctgccgcggggcttctttgtcccgatatctggagggtccggggcgggagggagtactgggtcgcgtcccctccatgggggaggggctgggggagtgagaggcctggagataatgcggagtgggggtggggagatcctgcaaggaccaggacgccggggttccaggagactctgcaggctccatccctccttattcccccaccccgaccccagtagcgctgggcctaggagcactcgggagttgctcagtggctctgcaccgctggcgcgggaaggggagaaaggggctgccagaggcgggaatttggtccccacgcgctgctccagggacgagaagccagggaccggcggttctgggagcaggtacaggtggggtaaactccccagcggctgcaggtcccagggtcctgttttctttcacttgaggttaaaggtcgtatatagaggtagatacccgtgaggagcagttcgggggagggggcggtgggccaaggggaggcttgtgtgtgtgagggggctgtatccagccttggggtgagcggagcccacctgagccctgtgagggtcgtaggaggcgctgctgtccctagttgtggcaatgtttagtcaatggtttgatcactgcagcagaagggactgaggttagacataaagaacttttagagggtggtacagagatggaggttggggaagttgattccctgccttggagattcgcagaacacattaggcctaacaagttattattataagactctggttctctggtgccatcccctcctacaccacgcatacacaccagacacagaattttccctatcagggagcctcttcctgcctctccctactccccagctcccttccgtcttttccaccaatgatccatctccagtggagccttaatgctggtcctgaccctcagagcctagagggtgagaacatacctgtggagttccatctgggatggaagctgactctcctgtctgttcagggcagaaatgctgggggtgacggtggaagttgctggaagtggggcagggctgtatgtgtgcagcacatcttggtagggggaggcacaggtgttctgactccacagagatacccataatctggaatgacaggtgcctggatggccaggttgagggtgagaaaagcctgaggggtgagagtcggcaggcccagatgaattactatgccttccctgcaggctgcatcagaagatgagttctagttgttagctcaggaaaactttaactttggctgctgagtcacaagtcccaggaagcccagggtccaagctgagaggctgaaagggatatggggaggcaggagcagaccctttgatcatagcaagagaaagatagtggttgagagtggccttgggattttgagaatttaggtgaccagagggtctggggagatgccatggagttcaggaccaggccccagctgttccgcctcccagcctgctctctgggtccagattctccaaccagcacaatgctagagcttttcatttgttgcagttttatgaaaaatgcaagtggctagagcaggcccagctctgtttaccattttatgttttcccttgacttcttcctgttctaagtctctagcttacagatttctagtaacaccctgagactgagattcagactccactgtcatttgctgagactcctctataggctagagtctgtgctaggaattgcacaggaagtctcagttaatcagaccctgacttggaaacacctgtacacaaactgtccaaactaaaagcaagtttcccctttttctttaaaaactctgaagccataggcctgctattctccttaatacaccccaagtgaacactaataagcagttctccacctttcattgtgtcatttgccttgtagaaatgaatgaactttttccataagccaagctgcagaggtttaggtatggtcagcatgggttctggacttaaggtagcaagcagaggtccagaagtgctccagcaaatgcagaaacctgacaggagacctcaagcttccctgtttttcttaggctggcagccgggagtggttaactccagtttacttgtggccatgaaatttatgtgatgtttgtccttctcactggaaggatggaattctgcagattttgccctttttgaggaaaggtacaatgcacaatcctttagaacccaaggagatgatattctgactagtgtgttttgagctttagagttctagaagcagggtccagtatctaagagttgtagagcccttagatttatagttctagaagttttcttctccctctgactttgatgagaacgtcaagtagggatggtggtttcagtatgtgtcatccctctaagctctgtacaaaagacatgttctcttctaactgtctgaagtttatcttccctgtccacagagttaggggtataacatgtggctgcaaatagtgaggagtggcattgaggcatctggatcaaaccaggtttctttatggtctgtatagggttgtctggagtggggaaagcatgctaagacaaagttccgactaaactgggtggcaccctttctattcttgcttaggaaaagaagcctctaaggactgagtcacacttaggaactgaaatcagaggagtctctgaaagtagaaataaacaggggcatccagatctggaccctccaagtataatgacacaacctcatccctcccttctttcttctaggagcactgaactctttcttgctccccgaggacccaggcagacccctcctctcactagttgcaggtacaaacagggagagaagcatagagggaaaagaatttctggctgtctgccctccacctccatcactccagccttgatcccacattcagaagggccacatgccctgacccctcaagcagaaaggtacagttaccatccaccaaactaataatattaataattgttaaattagtgccaatgttctgttagctgtaacactccacattagtctccgatttagctctgaatcccctaatgatggtggaagtgagcgcccagtcataaagcttggtgcggccgtaattagcttggcattgtctctcctcatcacagctttttcaggagcattaattccttctctgtttggactctgctaattatccccattggtagctcagtctggatctctgaaagaagcaaaggaagcaaaagccctctgctcccctccccccagccctgaattttaattacaccggttctcctaataaacttacaagccctggcagagcttattattaattattaatgggccacgtctgagcctcagtacagaatagctctgttctcccaacacacacacacacacacacacaatctctctctctctctctctctcagatattcctcaggtacaccttttccagaggccactggttacttgcctggtggctggtgggcaacctgaagtgtcagctttccagggaagaagatggggcaggtggtcaccaggctggtcataatctgagtctctggggctctgtccaggttcatagggtcaggccaaaaagtgggagtatccctcccatcctctcctgagtacaactaagaaatgcctgcccccactccaacttctctgtccagcctgggactccacagctcaatctgtagtcctcccagatacgtgattcaagagcccagatttgggcatcagcaagtcctaggttcaaatcccagctcttctccttaatgcactgtacccttgaacaagttacctggttaacatctctatgcttagtttctttatctttaagggtgtataccaatttcttagggaggctagaaaggttaaattagataatgtaaagggcataatgctcactatgtattaataaataaataaataaataaataaataaataaatgatattattagtattttatgagtggttctgcccagaatctcttctcttcccaggctaaacgctcttcttccaagctcctgggcctctgcgtcacttgctccctggcctctgggctgtgctttgtctatgtctctgtctgtgtctgcacgagagctccttggccgaggcagctcctgctctccccagcctgagcactgaccgtttctgagggtccaccaccaattccaggccctgaagccagccttctctggctttggggtgagtagggaaaatggttctttctttttgcttcctcttcccagtttatctcttcaattacaatctgttagcaagaacgcctgttactgttacaaaatggatttttctgatgtgggagcccattagaaaaatgggaacaatagcaagcaataagaattgctgatgaattctaacactatgggtggagaagaggggagggggcactagggctgtctttggagaaagaagtgtcagtgggggaagataagaaagccctgagctgctatttaataacccagcattttctggaagaggagggagaccatgggccatcaccccaaccagacagtctcatttaaggtgacaagcagatcctatcctgatggccttgaaggggatctcaacttcccaggagagaagaggggcctgacgtccctcagattctttgtcctctgatctggagtctcccttccctgcctcaaagacttagcttagctttgtgtctgttctgtatacacagtcaactgttatcctccaccaaaaaacaaaacatgaagaataacagcagcttacattttggggacattcactgtgtaccagggcctgtgctcaaagtcttagcttatttaatattcacaatgattctgcaaagtaggaataattcgaatcctgactaaataaaagagaaaactaagatttggacaggttaaataacttgctcaaggtcacgcaattagaaagcaatgaagatgatacatgctgtgctgtcggtcattctggcactgccgcccacctgagatgtccatcctgtgtctgagcacctgtgagttcagtttcacagccagggctagaagccatgtgcccctgtacaaggctatgtcactggggtgtgatcccaaagcctagttccatagctgttttctctcccatgagactgctggagagttggctactatggtttaccaaatcaggtgcccatgaaatactagagctcctctgatgcctgaatgaaaacattttacaatgaatattgagcaataggcttcttttccccaaatttcaagaaatttttcaagaacataggatgttctcaattataggtttttcttccatgatcttcttcttacttctttggaattcattcctgttcaccagctggctggtgatggtaacaacaaaacaactgaggaggcagcaagcaaatgagtattagcaggaaaagcctggagatgtgtgatctgaaccatagtttgtgttacgtctcaagatacagacggacctggctatgtccaaaaccattatattatttctgctagtaagattgttcttggtttgtaaagacaaggttaaagctatctctgttgattaatgttcaatggttttcaggtgttctgcccattaaacaaatttcaaaactaaggactgtttcaaattgggctgggcataactaattctaataaaaataggtgatatttattatattgcttattacatcttaggcactatcctcaacagttttggtctcatttaaacctcacaatgaccctaaaggtagatactattattacccccaatttatagatgaggaaactgaggctgagaagtgttacatagtttgccaaggtcacagtttaaaactagtagaggtagactgttagtgaggccagtctgacttcagggcaatgcttccttctctctaagctgaagaagaagtaaagaagaagacagggaagaagcatccaaatacctaggaggtactttctctttttcagtgctgggctgagccctctctcccttactggaggcttacttctagcttttcctgaagtgaacgtgtggtgtaaattggaagagcactggatcaggactcagaaactggcagagttgcccatcaaagttctagctgcctcaaggggtcaaagttcaaacaagatgtgaatgggaaaagggttttgaaggctatttgtgcacctgtgatttcctaggggacatgtcccagtgggttggccccagcaagcccagagtgggaaggcatacagcttaggttatctgggcctttatgcagcccttaggctgtacagaagcctacagccctttctaatctcaatgtaacttaaactaggagatgagggatgtctgagttcaaggccacatacagtgattttaaatgagctgaatcttctacagtcacctcctccctgctgcctgcttctggtcttactagccttgctcaccaaccttgcatctcctgtgaagacaaacccactcagtgtttgagacctaattctccttgcactgcctgccagtgagatgtcaaaagcccaggctcctctagtcctgcaataagattcttcaggcataggacgggcctcctggtctcatataaccagtattgagtgctgggtgctgattccaaaaaaccatgccctctgcctcccctaatcacagctctgagggaacagcagctgggggtcacatggagaggcaatctaaatagcaaccacaccaaggaaaacctcattgtcctgccccacccccttctcctacctctcttttcatttacgaattcaattatttgtcaggctgaacatttaaatgcactctatgctctctagattccccctactccccttctcattaaaattctaattattaccagaacaagtaagatgtatgatcaaaggaaagcaaagccctagaaacaccttttgttttgaggtgactcatattgcagagaatgcatccagaacagctgtaacagagaacagatgtgaagggctagagatggccagatatgtagaataaggacacatatagctgtggtgacttccctggtgagcccactaggataaagacctgaagaaagagtctccaaattatttagatcatgaactcataacaggttaaaaaaaaaaaaaaaaaaaaaaaacttaatacctccaatatatgtttttttgttcccaagttacatacatgttccacagaggtgatacttcagaaccagactggctgggttgtagcccagtttcaccacccactagttgtgtgacctgggaaatctatttaaccttctgtgcctcagtttccacatctgcaaaatgaggataataatcatacctttttcattggagaggattaaatgagtgaatagatataaagctctttgaaccttagacatagtaatgttgaataaattgcctaaatctaataacatgctattattcctatcaacctgtatattaaaaatttgatttcttttaaagattataaatattaaaatggcttggtttttttctcttgtgtccacctgccccgagcttcaccccattggagacaccaccacattggagacctttagtatagaagttgacttagaatgagctttcccggtgtctggcagtctccaggtgaaggactacctccagctcctttggccagggaaaggctctaatgtccctgtgcagggagccaggtgttgggaaggcttgggaagggggtggtggtaggtggctcaggacttgaggattctctgctattattacctattctcggaggtgataactgatctaggcaagtaacttgcagcaaaggaatcaaaaggcagtgctggcttcccagagagagtggctgatatcctcaactccttcttggcccctgatgtgggatctctttccctggagcctatgtgctgtgggagtacctggatccccttagcaggggactgggcattcaagccttgctcagaacttggcacatggcaagtactcagtaaatgttgcttgaccttaattgaaatgagagctaattacagccttctcatacatcattctttcagtcactcattcattccatgtgccagtttctatgtgaggccctgaatcagacaaagaggaaaaacacgtgtcatagtagcctacagtttaaccagagacagacaggtcagggcagaggaaagagtgccagcctgggtggtggacatctggaccctagtccaggttctgtgtctgaccaacctgtgactccaagcaagtcccttctgtgaaccactgctgccatctttaaaggcacagcctggcctcactacttgtggggtcatttcttaccttaaatagtaagatttttaaggcatttggacaggctaatacagaggcttcaaacttacaagctttcaggggccagacagggaacaggaagtggagggttgagctggtgaggacatatccttacaaagagagtcaccagttcccaccatgtgggagcccatgttcaattaccaagtcattggtcttttccagtgaattcagaagtctggggtgacgatgatgatggaatttcttaacgtttcaatcattaagcaagccaaacaaaactcttctgctagtttgtccacagtaacctttttgcaaaccctgcaaagtatgcccttggttcagagccttctaacttctctactccgagcaagaagaggccttgggctcaaaggttcattcccaaatttggagagggaagtgggatgggaggtctgcttaataatttctcacaaagaggggcatccctcataggggcatacccctttcttgggataatgggcatccctggggtcaggggtgggctgggggtgggggagtgagagcccacctccaaaccaatcacaacatttaaaataccagttttacagcaaagctcttgaatagccacaggaatggaggaggacagctctaggaatcatttgtacacaaataccttggagatattgtaggttcagttacagactactgcaataaagcacatatcaaaataaagcaagtcacacaaattttttggtttcccagtgcatataaaagttatatatatatacacacacacacacacatgcacataagttatatataacttatatgtatatatacacatataagttatatataacttatacatatatacatatgtatgtatgtatatatagatatatataacttttaaactgtgctacttttatactatatatgtatatatacacacataacttttatactatactacttttatactatatatacatatatgtatctaaaacttttatacatataagtatatgtaatttatatatgtacacatgtaaacatatatataactttgtgtaattctattgtacacttaatagactaaagtatattttataaaaagaaatagaattattagaatagcacaatagaattaaataaaatatatatagtataaaatatactgtagtctattaagtgtatacagtatatacatatatgtatatatacatatatgtgaatatatacatatacacacagtataaaatatactgtaatatactgtaaatataatggcatcaagaatggtgaatcctattcatatggttttcaatttactttgcccagatccatcagaggaatcactatccatggcagctaaagccttacaaaaagtatacattgtaatatatttacctatatatatacacatatacagtgtaaaatatactgtagcctattaagtgtgcaataaaattacacccaaaaacaatatatacaccttaattttaaaagcttgattgctaaaaaatgctaaattgctaaaaatgagccttcagtgagtcttaatctctttttgctggtggagggtcttgcttcgatgttgatggctgctgactgaccagtttggtggttgctggtggctggagtggctgtggcaatttcttaaaataagacaacggtgagtttgctgcgtcaatggacttttcctttcactaaagatatctctgtagcatgcaccgctgtctgatagcattttatccatagtagaacttctttcaaaattggagtcaatcctctcaacccctgccactgctttatcaactaaggttatgtaatattctaagtcctttgtggtcatttcagcaatgttcacagcatctttacctggagtatattttatctcaagaagataaaatatttactcatccacaatttatttactcatccacaagaagcaactcctcatccattcttcaggctccacttctaattctggttctcttgctatttccaccacatctgcagttatttccttcactgaggtcttgaacccctcaaagccattcacgatgtttggaatcaacttcttttaaatttcagttaatgttgatattttgaccttttcccctgaattatgaatgttcttaatggcatcaagaatggtgaatcctattcagacagttttcaatttactttgcccagatccatcagaggaatcactgtctatgacagctaaagcctaagatttgaaagttgaaattactccttgatccatgggctgcagaatggacgttgttttagctggcatgaaaacaacatttatctccttgtacatctgcatcagagcctttgggtgactaggtgcatagtcaatgagcagtaatattttgaaaggaatcatttcttctgagcagtaagtctcaacagtgggcttaaaatattcagtaaaccattcttaaacagatatgctattatccaggttttgtttttccatttttagagcataggcagagtagattgagcataattcttaagggccgtaggatttttggaatggtaaataagcactgggttcatcttaaagtcatcagctgtgttagcccctaaaaagagagtcagcctgtcctttgaaattttgaagccaggcattgacttcccctttctagctatgaaagccctaggtggcatcttcttccaatataaggctatttcttctactctgaaaatgtgttgtttagtgtagtcaccttcatcaattatcttagttagatcttctgaatcacttactgcagtttctacatcagcacttgctgcttcatctttgaacttttgcattatggagaggacttctttccttaaacctcaagaaccaacctctgctagattcaaacgtttcttctgcagcttcctctcctttttcagtcttcatagaatgaaagaaaggtactgtcttgctctggattaggctttggcttaagagaatgttggggctggtttgatcttctgtccagaccactaaagctctcttcacatcagcaataagactgttttgctttcttatcatttgtgtgtttgctggagtaacacttctgatttcctttaagatctttttctttgcattcacaacttggctgtgaggcacaaaatgcctcgcttttggcctgtcttggcttttgatatgccatcctcactaagcttcattatttctagcttttgatttaaaatgagagtcatgtgacactttctttgacctgaacacttagaagtcaaagtaaggttatcaattggcctaatttcaatattgttgtgcctcagcaaatagagaggcctaaggagaggaatggccagccaggggagcagccagaacacacacaacatttatcaattaggttggccatcttacatggatgcagctcaggacgcctcaaaacaatgacgataggaatatccaagatcactgatcacagatcatagatcaccataacaaccataatagtaatttaaaagtttgaaataatgtgagaattaacaaaacgtgacagacacaaaatgtgcacatgctgttggaaaactggcacagaaagacttgttcaaggcagggtggccacaaatcttcaatttgtaaaaaatacaggatctgtgaagcacaataaagtgaagcatagcaaaatgaagtgtgcctctatttagctttgaagtgcactgtgtagatcagattccaacttaatagaagtatttattgagcctactatgcacagagttctgggagtacagaagaacataatccttgcccttaaagagattatgctcaatctcattcacttgaagtcaactcaatgtttattgagttcctgtcttgggctcagtggggatgggataaagaagaaaagaggatgagttagccagcctctgccccccaaggtatcacaccctgttaaggaagtgggctgtagacaaaaatgactctaagtctggccatagtagcagctttaatagaaattcaaacagcatctcaacatgaatccttcacaaatttgcacatttgcttaggctgctatttaaattattttcatttccctgtgcacgtgccaatagccagtagagaggacagcccaggtgctccccaagctggctggggggataggggtgggggcgggagagaggatgatgctggaagaatcagattgaggtgaacacaaggctgtacatactccaccaagtggacaatcaagagtcaaccctgaaaccacctctccctctgacctggcagctttctcatgaccattcttctctcttcttccgtctttgtcccttccgtgtgccccctcctccaacaccctcacccgcttctccccgcctctgtctgtctgtccctccctgcctggctcatgccgagggcaggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggtgaggagtggaccactcccttccctgacccccacacctccacactcccttaatacatctatgggattccagcctgtggggatcacagaccagaaataataacacatatcctttgattgacaaatatgtcagatgatgtgagccatgatgggtgatcaatgaggaggtgggcaccaggaaagacttcatgaaagggaaacctttgaggcgggttgctgtatatgtggtttgcacttggggtgtgtgtgggtgtgaggggaatggaatagtggaataggggagtgttggatgtttggaaggaaagacttcaggcagaaggaagagaacagtaaaggcctagagatgtaagagttcatggtgtgtttagggatatgtcagtaaagcctgatagctacagtctgcagtacatggcagataaggcaagggaatcttaatagtttgagaatcaggattcctttaaagcctttcagagttccctgcatgacaacaactgtaaatacatacagcatcctttaactgaaaatagcaacaagaaaaacataacgacaaaaacctaccctaaattcagaagcacttttaaaagatgtggtgcaagcatgcgtaaggcattgtatttactcaaaacttagggctctgatggactcctaggtccctgcaacggctctccaggccctcaggggaccaacaaaagagaacgaggcctggtcttcagactggaggccaggaatgaacatgctgggaggtcacactgacagtctgtcatatggccttgggcaagttcctcaccttcccttagactcactttttccaactgtaaaataaggctgatgacttttatatggcagttgtgaggagccaatggaagaatcaatgtgattgataaggagagctaacacatatattgcttatgattatgcttggctctattctaagcacttcatatgtaatcaattcatttcacagcaatcctatgcagctgttacttttattatcctcgtttttatggcacagagaggttaaataactttcccaagatctcagctagaaagtgacagagccaaaattaacctatgcaggctaactccaaagcccatgcttttaccactctgctgcctgccgtatagcaaatgcttaacaaatggtgatggtgatgatggtgatgaagtgggtgccacattgaggataagaagggatggtccttctcttaaggaatctcatgatttaataaggaaaccagagtcatgtctactaggaagtaaacctagaaagcaggtaacagaaaagcaggaaaaagtgattatgataacaatggctaaagtttattgagcttactatatatcaggcaccattccaactactttacatatattaagacatgtaatgctcaccacaaccttgcacacaaagtgtatgcagagcaaaagtggggtcaagaagaggaaggaaaagggggctcaacaagggataagatgagccagggcctccaggctcgtgtttgccttcatcccccttcccctgagccctgaccacactccctctgccccctcctgccctctaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgtaagtacagccctgttccttggcttcttgaggatttgtggttctgggttgggtgggacatgtccccaaaccctcacttcctagagacaaatgggcctttgccatttgggatgtgaagagggactctggaaactgcccagtggcccagtctacccttgcactctgccccaggttgggatggcagagagcagagtccccatgtagctaggaagggaagggaatttttatctgtggcttctggttgcatgttctggggtggttctttctactgagagtactgatgtgcattagaaacttggcataggcaattgaaacaggccatatcaatcagactgaactaggctatgctgcagcagcaaacagtccgaggattttgtggctttagacaaccaaagtttatgccttgttcatgtttcatgtgctttgcagctggactggggactctgctccaccttgttacctggggacccaagccaacagaggctgcatttagacacgggcccccacagttaaacatcaggaggaagaggaagtggcaaatcacgcactgtttattaaaacttccacgcagaagtgacacatgtcacttccactcccattagaacaagacacgcggtaactcctaatatcaagggagaaggggcaaagtaatcctaccgagtgcccagaaggagagctggacatatgtaatgaacagcacgaatgacgacacacagcagagtccctttgcttgggcattgttttcccagtcaggtatgggagatgggggaggccagcccaaaaggagacctgactaacacctacacaggaggtgggtgctgggctgtttgcaaccagctggaattaatcagggaaggtttcaaggagctggggctcaagttggcttttaagagaagggagcacaggtttggcacagagaactggagaggacacatctggagcccttcggtctggcatagcccttcgctccagtcccctgggttgaggaagctgtgtagctgcatcctgcaggtatagctagtgtcctctctctaagcacccccaggcagctgagagctcagtgggggcattccctccaagctccagtggccttgcatctgctctcttgagtgctaacaggttgaggggcaacctggatatttcctccactatatctctgaggaggggcaaccccactctgtctgcagactcccgcttggatagtcaatactcaatatctctgtgttgagcctgtgaagagaggggctgggaaaatcagccctgctctggtgtgcaaagggcataaatcttgttttgttcaaagagagaaagcttagtgggctctgcttacaccccaggaagggtctgggggacacgccattctcatagcttgtgctgactttgaccagtccagcccaatggctcagtacctcccccacctttgctttcctgaaatgtcatccctaagaagaacataagtagccggctggccagcaggcagacggggcgagcagacagggcggattggaacagcagctctgtggcagccccaggcccgagcgctccactccataaatcactctgaagtttacatttggtgcagctcttccctgtggtctccttaggctgtggcttcattatggtaactggacaggtagagaaaagcagctcagtcctcctcacagtgaggttgccacccagggagaggggtgagggccaggggctgcaggaagcagagctcagcccagcccttctaggagcctcctttgctccttgccagagcccaccatctggtgtctttggctccaggcatgaatggaagcctcatgcctggggcaggcagtctgtgcccaagcacactcctcacctggatgcacctttccatatccaagaaccccgtggctgtcctgcccttgtcccatccccacttcccccacctggcttctgaaaagggcagatcaaccaaagagcataggacaaatcaccatcatcctcatcatcctcaactagtatcattatagccctcctccatctcctcctcctaagaacactgtgccaggcatggggttgagggtggggctggggtagaaaacagcttctttgacccacagaaacttgtcatgtaattacagagacaggaaaagtccatgcagtagctggtagtgcaaagcagcaaatacgatcctctgggtatggttgcaggatccttagagttaggacagctggtgaaggtctccttgatgaggagaactaaatcaggtggggaaggacagttataaataactcgacaggacaagaggaagggggagcattccagccagttgcagagggagtccaggtgcaggagtttcccaagctgcagagccccacccatgctcagacagcctgtcttaccgtctgtctgagctggatgttccttctcaagtgagtcccctgccaccctccaacccacagccccaccagcaggtagagttctcaggagcaggctcatcaccctgccaggtaaggactcaagcaaaagagggggaagaggtgcgagaaggctgatgcttgtacctatatgtggtgctgtcaaattttaattatttgggggccaaggagacccaagtcatcacagtcaccaggaatgacagagcactaagcatatatgaattcccataccagcacaatgggggacagtactgatgagatgagcgcagccaacagccagctcccatctctcccatgtgtctgattccattcccagagctgccctttggacctgagctcaggaatctggcagcttctgaaaaacacctgacatttctgcctcttgcctttgccaacaaggttctccatgtcaggcagatctgttcccacctctctgcctggtgcaaaccaatccacctttcagagcctacctgccgtcatcctccatgtggcctcctggtctcacagcagctgcctctcccgtgtgttctctgtatccccgagttatatcctgagtcatattctatcttgtaaagtcctcccaatggctcaggaatggcttgtgacccacatttgactttctcttgtattttccctcagggctgagtgtaagaacccagtactttcttgttaaatgaccagtggcttacttaattcaattaaaactatatatgggtacccaaggaaaagactattaaagaagcagttggaattgaatggggttaacctgggaaggcttcttggaggagaagcagctcaagtagtatttagaaaatggcttagagccaggcttggtggggagagacccagcctgtgcatgtgttcagaggtgaatgggatggtttgtgtctggggtaaccagcccgatcaggtagtctggaccaaagcagagagcctgtgacccgcatgctgagcagaaggaaaggcaccgtgagaaaggggacttggaggttgctctgtgctcaccaaagtgatgtgaatgctgcctgtgttgctccttgagtttgtgcaggagagtcggattcggccctggcaggtggcaccaggcaggtcccttgttcccacccccaccctggtgcttgacttgaagtaccaaagcctgaaacatttgcattgttttctcacagccacagaaccctgagctcaaggctagtggaggggaggtacacatccgaggagtctagctctttgttaattgcaaatcttaagcctcaagggacactcacctccccagcccagattgttccagagggaagtctgggcagcacagcagctaacatgccccactggctggagagccagagcaaaccgggcctgcagggcagtcggaggcctcgtgcattgcatggaattaagaaactcaggcctaggatggaaattttgggagttcactgcacccattccagccctgggaagcactgccctgctgtttcccccatctctccttctgcctggcttgcccaagggcccctgatagtctcctgggcattcccagaggtttgccactgtctctccaaccagagcttcaattggctaagatcaccatgctcttccctcctagcatcttctgcccccagtctcattatttctaaataaagctgtagatttatcattataatagagctgccgtcacccgggtttgctaacatctctaatcttgtagttattgctacagaggactcagaccccaccgcacacaactattcctgtcgctattccctctccttcactgtggcaggagacaaaggctgtaactggggccataaatatgtgctgtgcttggtaatgctaatggattcggccatcttcctgccttaccaggtccctactagtttagagtatgcgtgtgtgtgtgtgcatgtgtgttgtttttggactaggatagagtgtgtgtgtgcatgcatgtgtatgtgcgtgggcatgcatttgtgtgtgtgtgtgttttaggggtgatgaagtgttccatatacttccagagagcctggactgagggtatgcagggaggaagggaggccttaaatggtagaatagcctctggcttggaaatgagcagagttgtgcagaaggagtgcaggctttattgtcaacccaacctgaattgcattctagcttccttactttctagctttaaaaccttgggacattatctaaactgtgcctcaggtttgacatcagcaagatggggattaataatggcttctagtcctattgttattatatgtagtaaatgaaacagagtacacagccacccaggacagcactgtcacagagcagcttgctgagccctattcctctggtgcccttcctgctggcttagcccatgtgtcacttctgtaccactcccaggcctgaccttccccttcagtccaggtcatctgttctgactggttgttggacattattattcattttttatttcttgtcttggctatgccatgtgttttctgtgtgaccttgaaaaagtgactttccatctctgggctgcattttcctcagtattaaaccatctctagaatcctgtaattctcagcttctcccatggagaagttcttggctctcatgctttcacagaacagagctacccattctccgggagtgtggtctccacagcagaggccgaaaccccacagtgataagccactgggcagaatttccagacatccccactctttccttaaatatcaaagagtcaggcctctcttcaagcccgtggggaatgtcctctaggaggtttctgccacaggggaggccccatcaacaacccttcctcctctttttcccatgagccacattcctatgctggcactcagctccctcccttccatctcctttctgatccccatttactgggatgcgctggtcattacttattgagctcctgctagctgccaagggcacaacctgctttgccatgtttcatcctcaccacaacacttatggtcatcccccatatgtaaataaacaaacgaaggtttgaggttaggtgacttacccattgtcacccaaacagaaataataaagccaagatttgaactcatgatccttgcaccgccagagggaagcatggttacattgtttcttgggacagaaaataaacactgaaattgtgcagctcatcaggggatccagaagagtgttttgttctgttttttctttgtggacttgttaggttctctcactcatctcaaaatctggtcatttctgggagtgggtttggtgctgacattggattcctttaccctttcccccatttcctttctgtgagcagtgggtttgacattgtttctttttagtttaatagctattcattgaatgctgactatgtgccggtcagtgcatcattgggcacttgttgaatgcagagccatgggctgggctatggaaaggaaggtaaagcaagagccctccatatcagggtgcccaggctgacaaggactgtaggggatgccctgtgcccccaagtccccaagcccctcatacacaaggcacacacctggggacagaccagttcaggatgcttacaacacaattatgcaagctgctgcactgcaagagatgtgcagaagtgttaggagacatgaagaaaagaaatcagagtcagatgagattgctctagaaaagctgcttctagaaaagaaaagttttaggccaggctatgttgatgacagtgaaggacagagcatgataaaagaggaagtcagaggagggcgagtatgttcctctgttctctttggacttggggaaggatctagagagattttctctcacataagattgggtttcttttctttgtataataactacttgcagagtaattactatgtaccaggcaccaggctgggaatatgacttcaactccagtcctgccctcaagacctcgcagtctgatgggggaggcaggaaaccagttctgctgtcttggggacatgcaggtccctcactggcccagcatgttgggggaaggcaggcctcctgaaatgaaattgcttgcttgcttgaaaaaaatttcagttgcatcctcttctcacgcccacacactcaagtcgaatgagatcccagagtggccacaaaaggctttttcaagtagagccaaagaatcagctaattgatccactgtgactcattaaatcacccgggggtgaagcctcccaaagcctcattgactagcagtttgagacaacgccttcgaagtgtccatcttggatctcaggtttctaggtctgtcctgggcaggagtaagaggtaagcatattgaatcttcatccactaagcaggtcttcaacgagccctcaaagaacatacttgggtcctagaacaactaactgggtattgaaggggcaaacatagtccttgctttcaaggaactcacagttgaacagaggtttcagagcaagtaaaaagctaatgaaaggaacacaattatttacattacattaaaaggaaaaaggggagatggaggtgagtattgaagcgaggagagtgagtgagtgggatgagggatacagatggcagaaggagaattcaggaacaagaaccgagctttggggaacgcccacagccaggatgaaggagaaagagggtcaggcagcaaagagcacctagcaggaggagatcaagagaaaggaaaaagaggaagtcaaaggaggaatcactcgggaattattcattcagcaatgacctgtttgagcatctgctaagtgccaagcatggtcctagatgctgaggatgcagcagtcaacaaagtccctgctcttgtggagcttatgctctagtggaagaaggcaaatgactaagataaatagtatgtctgagagtcataaatggcatggagaagatgaagcagggaaatgtgataggaaagttgggttggggagggtgggttgaagggaggacagcagggcaaaacagggtgggcaggggagacctccctgagagggtgccctttgagtagacctgaaatatgggagagaaccctgcagatatttgcaggaagagaggtccaggcagagagaaaagaccctgcagtgggatggcatctggcatgatcaaagaacaggaaagaggccaggcacagtggctcactcctgtactcctagcacttcgggaggccgaggcaggaggattatgtgaggccaggattttgagaccagcccctggcaaaacaaggagacctcgtctctacaaaaaattaaaaaaaaaaaaaaaaaacaggtgtggtggtgcatgcctgtaatcccagcaactcagaggctgaggtgggacaatcgcttgagcctgggagatcaaggctgcagtgagccatgattacaccactgcactgtgatccatcagactggccaacagagcaagactctgtcaagaaagaaagaaaaagaaagaaagaaagaaagaaaaagaaagaaagagaaagaaagaaagaaagaaagaaaggaaagaaagaaagaaagaaagaaagaaagaaagaaagaaagaaagaaagaaaagaaagaaaaaaagacagaaaaaaaagaaagaaagaaagagaaaaacaaagaacagcaagaggaccagtgagtgtggcagaagcagaaacagggctggggaggggaaagagtgaaagatgaagtgggagaggtaagaggcgggagaggtaagaggcgggagaggttaatatggttccacaaccaaaagtttaaaaggatcactgcagctgatgggcggggactagactactgtacacagtcagaggaaaggcaggaagtcagtggggatgtgattgtcttaaaaaagagatgaaaataggttgaacaaatatggtggtagatatgtaagatgtggctagtctctgaatatattttgaaagcacagccagcagtatttgatgacagactgggtggagggtctaaggtgtagagaaagagaagaatcaagattttcagtccgagcaacttgggatgctgagttgggaaatcttggaggaagaacccatatggggaggaagattaggagctcagatttggacatgtcatatttgagataccttttggacatccaagtggcgatgctacataggaagctggatataaagtctggagtccaggagtgaggtcttggctaaagaaacagattttggagatgtcggcatataaatggtgtcaagaggcatgaaactaattgagatcccagtggaataagtttagatagaaaagaggaaaggaacaggatttaaccatgaggtactctaacaatttatgtggggctatgaagaaaacccagcaaaggagactaacagcagggaaaagaggaaagccaggagggtacagtgtctcaggaaacaaaggaagtgtttccagaggatgggggtaaggctcagctgtattagatgctatgaccaatcaagtaagatgcagactgagaactggccagtttgttcagcatcaaggagcttatcatcggccttgacaagggccgctttggtggaacccgagtggggaagatcaactgtggaacggggacacgggccgtgttattctgggggaattttctggagggtgcaactcttgaaatgggtttttaaaggtctaggagggttggtttggcagtatgccaagaggctggttccatatatgggccatagcttagggaaaagttggggctgggacagggaggtagagtgagcagccctgactgagagcaactcagagcaattcaggccaagactaccctttccatcagaaatttgcagaaaggctcagtatccctagtattctgccttaaattcccaagtgtctggactcccgcatgcaggtccaagccaggatggaagcagagagggagagttttctgaaagaggccagcagggcaaatcagggttacacggaagccccagtgggtgtaaaggtgtgcctgagtctgggggcctgggtggcctgcccaaacccatgaagactgctccccaggccaaaccatgcagccggagcactctgaataatgcatgaagatggccagtcctgtggccctctttgagcagtccaagtgagcccagcagtggccctcccagctgcctggcccccacccacctgagtcagaagccaccgggtccttggtagggctgcaaggctcccttgtgtgtttgctgctcaacgggagctgtgcagctccccggttgtctttgctggatgttcatttgcccccatgctcccctgggcctggtctcatcatccttgttattctctggcaccccctcccttgggccaatcgctggaaatgtccagtgcatcctactcacagtttattccttccactcctgccaatgcagagatgggtgggacctctcctttgtacctctcaccaaagaggggaggaggtgaagagcttggttgcctccctggaaggatttcttggtcagatgggaacatcaagcaaggagcagcttttcctgctccagaatagtaacagcagccctaacctcagacctcatgtcctatagtgactaggaggaaattgggggttggagggtgcagggaggggtccctccatgctcaaagctcagatcctgagaatgtgcctcactgtgtccagccccaggttctaaagccaacaggaccttgacttttctgggactgcccaaggggccaaggctcctctagagaaggattgctgaaaatccaccaagaacccagaaaggaaagaggagaggtgtgggttccaccctccatcccacgggcagccttcactagggcctccatggtcaatccaggagtcaagtcacacactcccacagctgagcagcagcaggccccttccaccacaggtgaggactccaagtccacaaactgttcctgctgcagaggtgacccttccacacactctcacttgagccaaaattaggacctgtagctgttcttggctccagggggctaaaggtttcccatgtgatgctggaaaacaaagctaatggtccagacagggctctgacctgcagtaagcagagctactcagctctgctggccttgggtgttcttatttaagttgtttctaaacttggcctttcacaaaagatccttctctgctgcttcagaagaaatggccttacaaagctgccagaggcccagacagtggagacagttccactttcactcttgatgagttccctagcctccagacagccccattgcccactcaggccagcttcctgtagggtacggctctcactggcaaccagaccgcagccctgtcttccctccctccctctgctcgcagcctgcttcagcacagagctggtgggcaagccgaacctgcccccggccaaatgtgcccctcattagtatgctgtgcctttggatggaataaatatctaatctttcccttacaagaggatgaatgggaaatcattaggcaacaagctcatgcatcaacaaaaagcgatttctccaacacagatgtacttcccgttgcttccccccaccttgctcccagagcatatgcacttgcttagtgcttccaccacctaatagcacacagtgacattttctcctggagagagactatttggtcgcaaggaaagcaacagccaaacatcccctctgggcactgtcacagacttttgaactccaggattcatccaggaggaagggaatgcagtttcctagatcagcagcaattcagagagactagggtcatggggtgtaactatgaccagaatagcaaccaacttgggagaattggagcagtccctgagggacttcacattttcccgcggaccatggtgttatgactccatattttcatggacttgggggtggtcagagctagaaagagcctcggagatgacctggctcaacctcctcctgccatagatgagcaatttcagaccaaagaagtctcacaccttgcttggggtggttgggagtcaatgcaaatctgggctccaaatcaggtctcatgagacccagcccatgcccttcctagtctctgggtttttataggaaattctcttgccttgttttcactctttccttcccaggcccctgcccactcactgccttcatcctgtgcctgtgagcctctctatactgtagggaagaggtgaaagacagaatttggagttaaaggcattaaatgtcaaagggcacagagcaaagaccccctcccctctcccaaaagttagtcttttccatgcaaggaagatctaagaccagaaataggcaaaccaacaagcaacatcagcaggaaaaccaaggaaaaaagaggccgtttatcaaagtgttttgatcctgagccaattaacccccacccaaaatctccccatggtacataaatatttctaccttagaggaggaaggagacaaggtgagctgtagagtataggtcagccttgtccagttgctatcatatgtttatggtgttttagtgtcagcagcaacacagaaaaatttggtctctacagcagccatcctccccctccctccagcccccacgccactgccaaccccgagcccatctggccctcattcatcctcatcagccatccactgtagccacattttcctctcatgtctgaattgacacctactcattctccatgaatatttaatatcttcctttctggataaagtccctgagaccttgagggcctctctagggctgcactgaaatctgagtagagagctttccatgaagtccacttggccttgggatgagggaattagagagacagcccctgggacaggatgagccacagcaagatgttcatccatgtctggccagcacaggctggcattgccctccatcttgatggcctgaaaaacaccaataattgcttcaaaagactgtcattttagagtcctaccctgctgatcgtctggatttgacacaacttggagttcaccaacatcctcgaccatgggtcgggtttccctaggagatattttatgttttcttcacaaaacctgtgtctgatgcacttgaggtgggagggaacagaggtgagatcaggaatgggtgcaaaaacaggcctcagatgacaatttatgtgcagaattccaactgcacgttaagcagggtgtccaccagagcttcttggcctcctgtgtgccaggctgtaagtgcattgtttattcattcctcacccctgccttgcagggtaggtactggtgttatccccagtttccagatgaagcaactcaggcaatctgctcaaggtcaccaggccagtgagcggcagtccacctgggccagccggttgcatgtgctccgagccctcccccatgttgccactcaggaactggctaacaggggctctctccatgcgtcctgcctcttcctgggttggggagagcatatatgatcatagtcccttctgccaccaacgttccacctcttctgaaatgtcatcctcctcttggtctccgatggctcttccttcattgacccagtcatggaacacgggtctagctccaccacactccaagcaacacaaagtgaggagcagcacttaactgaaggtctgttgtgatggaaagtgccacttcccagtggcacagcagactgctggtgggcacctgcccccagctccccaccactcccatcattctatcgtcttccctctcccttccccacaagttctaggcctcaaatccaaaccaccaccacacgtccctctttaaattgcctgacttctgtccagccccagccccatccccaggtgtagctcagttccggccccatcttctcacatttaaaacccaacaagatttctaactgaataactggccatcatttccaggagcagtggggaccctaagattgttatattgcctttaccaggctccaccctccatagaaggtttttgtggtttcaaatggcatttgctttctctgtttcctaagaattgctatggccattggcatttctgtggggcttgtaaagccattttcctatatatgcagagagaggcccctccttagggcttgggtggagttgccacctgagataggaagggggaagccacttctatctcaaccctcccagttctgcaagtctcctgagaatgaaccagtccttccattcaaaatgagaaggaggccccagccggatggggtctcagccagaaaagagacagagtgttagaggtaaatgtccataaaacagaggatgccactccacagggacaggcagagggctgccagggaaagagccggggaggggcctgtgcaagtgtcctggccacctggggctggagaccctgaggcagtgttgtttgctttgtctgtggttatttccttttgctcacccttagtatttgaagaagttcttttttatattaccaggctctttcagggatgtgatgggaaccaggagcagggttgggtctacacttgagttggagctttaaagagaatgcagggacagaacatgaaggagcacctagaaccagaaagaaaacccaaaaggaaagacggagaatgtgcagggggagagacagagggtccagcttcagccaccctggccacctgccagccttctccagggctcctctctgctgcccccaaaaggctttgcactttgtttgaataaaagaggtcactgctttgtagaaggagaggggagaggacagccccttgagccacccctgcacccacatgcatgggaacagcactggcctggggctctttcccagggtgagtccatccctcctcgagcctttggttgactcacatctctgtagtgacacattggaccatgtgctaggaacagtccaacttccagagagaaaaaaacagctctggtggtgtgtcatgacaacatgataagcatttcccttcttgagaagttggggacagggctagctttgtgacttgaggcacctgcttgaaaatgcctcctccacattgtcagagccatctccagctgagtcactcctgcagggccctgtgagacactgccgggagccctgcccagcccctcacaggatcaatacatcagaggaactagctgaaagtcagctggaagcaaaaaggcaggaaggagggcacgcggaacagccaagctcagagtgcctcgcgggccccggagaaaaggaggtgtgagtcaggattctaatgctgacaagctgtgctgggcgggcagggcccggacaggcattttgaaagtaggggattagggctcaaggtgactttgatggggaaaattttgagaaccaacctttcttggtgctgctgggcctttttggtaggtttgtggagaaaaagaggccagggggaaaggctggcagtgaaggcctttgtaactccaactcctgctgaaagggcgtttttagtgaatcctatccaagtgcaggcagccatccagctctttttagggagtgggtgttccctaggaaagtattcccccaaccctatttggagaatttttaccagagaaactctggctgcgctcctctctgcctcctgcaagagatagggaagtagaatctcagcagagccctctgccacccaccctgagtctggccagaccccaggcagccccacgtgtgtgtgtgcatatgctcatgtgcgcgcacacacacacacacacacacacacaaatgtacatgctgtgtccatcacacgccagggaagcagcaaagtgctcattcctgttccatcttgtttgattggctttctgtcaaccctcctccccctggaggactccagtccccaagagagggacattttttggttccgctaagaaattctgtttggaaaagaatttcgaggagaccttgcagcctgaagatgatgcgcttaggaataaccttaagtgtgattataataaaacccaaaccacttccatgtcaggttgcatctctcatgtgttgagaagggagaacaaagatttcactcacagggaagctgaggccctgataatggtgcagcaccttcaaggccacgcagtcagctctgcgctgtcagtcaggatccatgagaccctgcaaggggcacggatccaacggcagacttggttccaggccccaagagcctgcaggtaagcaagagttggagtcaggaggctggggcttgaaggtggctccactgtgtggcctgtcaaaccacttcacctctcgctttcccccttagccaaatgtggacaacaatctctaccacagggctgtgactagggtgcaatacaatttcaatgagacaagggccttcctaggttcttgccatggtttattgctcttgaatctaacaacaacaataactaatgtgtttataagtaaatttccaaagacgtgttctcatttaacctcaatataggaagatatcagtatttccattttatagatggggaaactgaggcaattccttgaagtcacacagttttaaaatgatagagcagagaaccaaaactgatatcattttccttacacactatataactaatatattttacccttctttgcctcaaggtaaagtattacattcttattttagataagttagaaaatacagaaagccacaaaaaatacgtttcactataagcccattctcccaagaatactgcaactcccatttcgatgagccccagggtcctcctgttgcttagaaaacaatgtgaatgcagtgaagggagaggactaccatggaggctgtgaggggttgatgcactggctgggttgggcctgcaaatgttcaggattaaggcattttggaggaatgctggaaagaagggaagatgtggagtgaagaacaggagggaggagagtgcgaggtgtgcagggccaaggctccaaggagggatagtgaggacaggcctgaagatctggcaggccccaagccagccttctcaccaaagaccaaggccactgcccatctcatatcagcaagtccctgagcattctgagatgttaggagtaggaggggccatggtcttctcagatgatgaggttgagatcccagaagactctctggagagtcctacaacctcacagggactgccaacctccccctgggggccttggtggctatggagacatcgcctgtccctctctggccagttagctgcccagtgggcagggcggtagggacagcttcaatgaaggccctgcctctaggcacggacagcgtgaggtttgatgcagctctgttctccagccagggcagcatcagcagctccttcaagccacacaaccctgggtgtctttccagtgacgtaggagggggtcctagccagccacaccctctttaccaatccctgagtgcaggtgccccaggggcagggaccccatcttgttactaataacaacaatattggtaacaagtcaccttgcctttatataccactgttgaatttacagagcctttttgcacacattgtctcacttaatcctcagcaggtaggaggaattatcctaattctgtagatagagaaaattaagctaagagagactaagtgaattatctgaggttgcacagcaagtaataaaaacgtttatttattttgcttgtcactttgtgttgctccagaaaagatttagctagctcataggacatgcgacaagattaaaaataagtttgaaacatcattaaagagtagcaaaaaaataagtgaaagaatgtgaaattctggaatccagcgagtcccctacacaatgtgcacgccctgccctccaaacctgccacacaactgacttgaagcattctggcagataacacaataagggaaagatagtcacagaattcagcgtccattaagtaaagacaaaccagaggcttaggaaacactaagctattcctggttctaagacaagaggaaattttctaccgagggcatcacacagtgaacaccatcacaaggagagatcatagtgtggtctttgaattctgagacctcatcaacacctctatgccttcggtttttcaactgcaaagtgggggtaattataaaacctagctcacaaatttgttttgacaaatacatgagaatctttaaaagagatttttttttttttttttgagacagagtctctctctgtcgcccaggctggagtgcagtggtgcgatctcggctcactgcaagttccgcctcccaggttcaggccgttctcctgcctcagccgcccgagtagctgggactacaggtgcctgccaccatgcctggctaattttttgtatttttagtagagacagcgttccactgtgctagccaggatggtctcgatctcctgacctcgtgatccgcctgcctccgcctcccaaagtgctgggattacaggcgtgagccaccgtgcccggcctgagagaggtttttgaaaacaagttactgagagaatgtgtaaagccccgtcaaaccctgctcagtcagagctccagaagcattgggtgaacaattctcagggacaacctttcagaaaaccaagctggcttggcatggtggctgaggtagaccctggggtctggctgcctgggttcaagccatatctccccactctttaacgtaatatctccatgcttgttctctcatctgtaaagtgtgggtaaaaataacccttttccataaggttattgtgaggattaaagaagagaattcacacaaatctcagccaagtgcccatcggcacacagcaagtgctcaatgaatgccagctatgtgtagtatctttaaagttcttccttatcgtcatccagtgttagaggtaggtagttcctggaatttgggactgtccatgtgccctggagccctgaaccctggccttgcatccagtaggtactcaatttatacttgtgggatggaattggaaagtaagagaaagggattccagcttagcctgggagctggaaaactccaagtagaatcaccaggggcacacagcccttccaagcctctgttttctgatatgtgaaatgaacaggggcctgtaatctcttgggacccttgagttctcacagtgatcaccagagagggctttacacttcaactactaactgcagaaggggcttggctgggaatcctttaaagagagacgtcaggccgacccgattcccacctttatctctaggaaggactgggctgggactgagttgctggatgccctgcagaacaatggtgtgcacggagggcagtgatcacggagacataggagccaccccaggtccaggaatctgtgatttctcgctgctggacctggaagaaaggggcctgggtatgcctgggaatgggctatttccactcccgtttgggaccctgcccccttgaggaagcgttgcctcagctgacaccgacaggagatggctctgtctggtgtgagaggagaggcagatgggggtgggggaggatggaagaggtgagagaggaaatgctgactgctgtgtgggaagccagagaaagctgggcatcgcctgggagaaggaacctgagccgcggggacagccggggagcagcaggcccctctgcagcagcagcaggagccccagggacaccccgccggagggcctggcatggcctgcgtgctgtggcctccccagatgccaggcagcgccattcctgagcagggaggtctccaggttcatacagtgcaaagaggcagtttaagccaaagggaggatctgcaaacttctgctgtggcactcaggcgacccctggcaccagggccgtccagtgcctcggcttctccctgggcctctctcctcccagcctgagcctcactctgtttctgccactctgcacttggtgcctggaagggaggaaataactattagtgtcacctgcttaccaatgagagacattagctggctctggcagaacatgcggcctgtaatttttggaggagttacaataatggagctaatttggcgctttatcatcgtgctcctgggtgagcagggggaagggaggcctggggcctggtttatagcaacctcccagcaaagagctctgtacttcctgggaaatctctgggatcctggccccatgctccctccttcctgtccccctctcccacaccgcttgcttctccttccagtgaggcattgtcaggatgcagtttggagatggctgaagccaacccactagcggccagaggccgctccacagcaggatggaacaggaaggggcccgaaagtgtctgaagagtttgctctgcactagatccctgtgaggcgtcttcagtgcatacactcattgggcttcacggttcaccctattttactaatgaggaggtgaggtcatctggtacaatgctctcattttacggctgaggatgcacagctcagggaggcacagtgacttgccccatatcattctactgattcgcagcagaaccgggatttgaacccagacctctgagagccagcttaatttttcccttaagttctcttactgggaacatctgaactggagcctgagaagacacaggatgccctccccaatcctactgattgaaggcgctgctgggtagggaagcccagggctgggagggaagaaagagccagcaaatcagctcagcttccatggggccctgcaggcaggagctggggcctctgaaatccaggctagaagatgtgtcgttcccaccctctacccaggaacaactccaaggcagctgcctcttcctccaacttttgctgacttagacatccatggggcacacctggcccctcagcccaccaggcaggcagtggggactgcacacccagtgggcttagtgccaccacctgcctccatgtggcaggagaatgaaaggcttacaaacagattgtattcttgctatatgcacgtctcggttttcctactagcagctggccgtgctctccccgtggtttcctcttatgcctgtaaatcagggcgaaaggcacctgcttcacaggtagccacctcaagcatgacaatactgcccatcatcagaaagggtcagagaccttcagtgagttttacagtcacacagctggaaagcagcagggcagggattcgaaccccaggttctgtgcccaactccatgcatcgctccttggaactgtttatactaaaactcctgtagcagactcatggttcttcccttctggaatcatgaatcaggagttcttcgttgatgattagtcgtgggtctagatgaaggccaccaaaatgcctaaaacatgaggccaagggaaggttcttggttttggtgaagagaaggtggagtcaaaactgatacagtcttagaaggcataacctctaaattatgatgtaatagtaggtgggaactaggagggaaggcatagatgccccaggaactgggtcagccatttggggggacttcctgagttccgggcgggggtggaacactggaaaagaggcattgattgttaagctgaatgtggtcttgctgggaagctgggactgggtaagttggctgatcacttggggcctcttgcttcctagtggcatgtgatgggagttgctttgctctgatccttaaatatcccgcaccaagggaatgaattttgagatctgacaccttcaactctcccaagaagcctgtagagatcacagaccatctcctcacccttcctcaagacctaaggaagcaaggaaataacagtgaggaatataactacacctttacaggagacaggggaaacacttcactggctcaaaactttttcatatgtgggtttcctcctcccagtcctggtggctgctccccagagacctcaggtacaaagatctgtgcagagagggcccggggttcttccactgaactgccgcgttggggacaagaattttggcccaggggttctgcccctgctggcctagcttctccccctccctccttcccctgaggcagtgtctgctgcagcagtttggcacttggtgagagaatgacttaacaggtgactttcgtgagaaatgacgggctgaggccagggtgctgcactagcaggtttaagtgagcaggatgtatcctctcatagtctgtaacgcagggtgacaccatccattcatcttctttcaagagaggcaggtgggggcaggcagaagggaggtaatattctaagtctcagagctttctctctcatgcttcttgcttccagaacaccaagaaatttcaccttcaaaacctacacggtcctcggcagccctaaccctcaataaccagggacagaaggtggggtggagtggggtggagcatggacagtcccagaggaggctgggtgggatggaggagaagagcaacaccttcagagtcaacaaacctgagtccaaagccaagcttagcacatgagaccctaggcaagttatttaacctctatgagtttcagtacaatgtagagatgattatgcgctcctcccaggcatagagtatgagtaaaatgaacgtaatatgtgttaagagctgggtgcagtggctcatgcctgtaatcccagcacttagggaggccgaggcgggcagatcatgaagtcgggagtttgagaccagcctggccaacatgataaaaccccgtctctaccaaaaatacaaaaatcagcccggcatggtggcatgcacctgtaatcccagctactcgggaggctgaggcaggagaattgcttgaatccaggaagccgaggttgcagtgagccgagatcgcaccactgcagtccagcctgggcgacagagcgagacactcaaaaaaaaaaaaaaaagtgttaagtacccaacatagtgcctacaaactagtagatgctccataactgttaatctcctcctctcttgactttggctttaatcaccaaaataaatagattcaaagaagtggaagaaacttcaaaatcctgtccagagtattcgtgttcaattggttcttccaactagacaaaagcaatggttgtcagttcctgagacttccctggggcatgttaaacatagattattggccctgccttctggtgagggtagggcccaagaatttgtgtttctgattagttccaagtgatgctgatcttattggtcaggaacacatccttggagatctatggcaataaggaatatttacagagtggtgtcagatatctttgaaacactgtctttgcttaatacctaattttcttaaaccctgtaaatttggataaggcagcttctttctaaaatatacccagtgtgccatgtggtgcacaggaaaaaggcaaagggaagtaagtggtgagggccaggaccagtccagcagcccacatggcttcgatccttcagaacccttgcttgtgcctaaaaaaagagaagaggccttttatgccttaacttttgcttggcagctctgatatttaatgacttcagttgcattaggacatgttccatgtcacagagattctaatagggtctgacctggggcaacctcagaatctctcgccttatatcacgaactgaggctatgtaacactcatctgggaagcctgtcaataatgcaaacatccaggccccgcctccagagatgatgactcagtagatcttgggcgcagctcaggaatcaagtctccacctcccaagcttctaatgcagggaatattcagcccacccgctgaggaacacctatgaggctccaccctgacaccatctcaataaccacagcaaccctcctggggagaccagaggctgaggctgaggttaagcaagggcctactcttgtcacccattcattttgccaccttaaccaggtgagccccacaaagctgagttgctcattaattcaacaaatacttgtcagcatctgttatacaccaggcaccgtgctcagtactgagaatacagtggtgagtaaaatatgaggttgagattagggtgaggcgagtgaagtacccagggggcagaatggaaggggacactcactcttggatacatgcatgaacctgacagtgagcacttccttcacttttgtacctgggcacctgctttgcctcacccttgtcctggccctggcaaaacagacccagatctgtccttcgggaacacagttggcagcagagggaggcgctggaggaagtggcctgagatgagtgggtctctgccatgtgaagagctggggaaagaacggtcaatcagaggaagagaaagtgcaaagtcatggggcaggaagagcctggggcatttgaggaagcctgtgaggagagccctggcacggggggaggctgaagagtcagccccgttcgtggagggccctgtagatcttgataagtgcttttgtttttattcctagtgaaaggggatgccattggaggttttaaacaaggagtggtacaatccattttccatctggggaagagcactctggctgctgtgtggagaatggggcgggagagcaagggaagcagggaaggcagataggaggcggctgtatgctggcaggggggtaggctttggcctccgtgtggcactggagatggagagaggtgggtggacttgagatggaatttggagttagaattatcagggcttgatgatgatctaaatccaaaagaggaaggcagatgtccacaaagatgtctcatttctggcttgagcaactgggtggatggatgggccaggttggggaaaattagaggagaatgtaaacagaaaagggcaactttgagcctctgagaagttttagatttccagccacatggccatgtcattttggatatatgagtctggagtctagaagagatgtctgcggaggggccataaactcaggagccatgagtggggagatggatattaacattatggctgagtgaggagagaaaaagcttgacaaacttcactgtttagaggcagggatgggagaagaggctggcacaggaaacctgaaaaaggcagccagagaggtgggagaagaaccggaaggaagtggagttgtcaagagcagggcagtcaactctgtgaaaggctggaaagagcttctctatggagcaccttgccatggcaagacccagagattctggagtgtggggagcaggaggtggggaaagatcttaatcttcagggtgactgtccccaaagagatgatgaagctaaagccactgtcacgcagtgcaggcctgtgcctttggctgagaccaaagccctgcctatttggcatccccctcagggcacttgtttgcaagaaacattcctcagctgccccaggagactcatcaggaaaccaggaccaaggtatcttccctcctgctgagagtcccagcccccacagccctgcgaggggcagagagcagatctctcaccacggggagatgtctgccctctccccaggagaaactggcagctatttgacagccactcggcaagacaacttgtgacaagaaattaagatggattttcatcattaacttcattaatgtaccctttactacccccaccacccctgtggttaatgaagatgacagtggaaggaccagatctgaagtgaggtcctcggctctgggctctcaggcacaagcaccctacggcacagacttcctggcttgaccaggcattactgccatctcttctaaaatttctccaaactccactcctctcaagctcctttccactctctcagcccctcttcttctccaccctcactttaaaaagtcattaggaagagatctgcacctcccagtgtgttctgactcacggatatttgcccaaaagtaatggtgcgtgtgaaatactaagcctcttttcaagggcaggttcacgaaggggaggctgagaaaaagtttcctaaataagaccatctgtttctctgaagatgctcagatgctgaaacatttgcttcccgctgatgtgctttagtctcaatgggtccctaggacaaacccagactcaaggatctcacccacgtcctccgtgcaccgctgctccacaccggcttgggggtgcccgcttctccatggggcagtccttagctctgtgtccacactgcagggtgaagctggagtatactgagttcgtataaggagcctcaattctggttgatcatttattcataatgctgcaaggcccttggggcagagaagcacttgagagtaaaagcaggcatggaactcagaacaaacagaacctgccccagcacccagcaggaagccccgagcgtcacaacagacacatcccacccttccaccccagacacccccagcattcttgctgaagccctaggagcccgggcctgaggcggagcagggaatcaactcacgtcacccaggccggtgttcacagcaggggccccctctcggcaccctaggaaggagtgcccactcccacagctcctctctcccaggcgagagctgagccagctgtgggaacgtggggcgggcagagcgtcagtctccactctcctcctgcagcccctcacccggcagtttagcacatcctgccgggttcctctcggaagtcctgactttgccttggggcagttgtaagatttctcccttggcctttaccacccaagggcaatgggagcacaaccccaggccagaccaagggagtcagaggaggtgacccaagagggggtgacaggacagctggcctggaaagatcagagttgtccaggatggtcagagggatggagaggttatttcaggtggtagaaagaacaagatgaagtcatgaaggtgggaaagatcttggagcatttagtgaggaggtgtcatcaagaggcaggatggtgtcatggctgaaagtgggggctctcaagcttccgtccacatcctggctgtgccatttagtagctgtgtgcccttgggccacttgcataacctctccgtacttcagtgtccccaggtaaaaagtggtgataatagtagtagccatctcccaaggcttttgtgaagattatatgacatcatacgtataagcacttagggcaggacagcacatagtaaacactcaatgttatggttattatggctggagtgtacggcacctggggcagaacagtggaaggtgaggctggctagaaaggcgagggccacccggtgaagaagcttgaatgccatgtgattctgtggattagtgatttttcatgccgactcctaaaagttccaaggagggagcccgaggtgttgaaggtactctggatgccctgtttctgagccactcttcagctgctgtatatgattgggcttttggatgatacttcatttgaagaagaggctttccaactacaaaacaagtgtgaaatgagaagccactgaagaattctgagcaggagaccaaccacctggttacagcaaggaggatggattggagggagtgggcagggggagttagaaaactgcaaggatctggcagagatggtgcaggccagagctgaggtagtgcagcgaggatgggaggagagggcctcagagtttggggacactcagaagggagaagctgtgcagcttgggaactgagtagctgtggaggccgtagcatctgaactcatgctcactttctcccggcccctgccacccattctttacaagctgctgaagtcccaaactgctgcaagtcctcaaagggctctgcttttcataggaagcaaaatccaagcacttgcaagtcctcccttaacctccctcttaccctttgcttactctggtatcatagccaccatccgcttcccccagccagacccacagcactctttgctagcctctgctgagagctctccttccattcttggctgctcctccccatctttcaggaccactatgaataaagcggccgcacacccactcactacccttggtcaggtccctggctccctcgctgcccttgggtaccatcttgcttagtgtacttttgtcttcctcccttagaatacaagttcctggagggctgggactttgtcttatcattactatctctccagatcctccaacatttagtgggtgtgtgacaaatgaatgacacacatgaaaatggtctctggtgtgggtgtctgggttgaaggtgacacagtggactgagtaggaagtaaagcaggaagggcaggggtagagccagtctcccattgtctgcagaatcaaggacaaactcccaagtatgggctaagaggcaggcaaggctggcccttgcctggggccctgtttctagcctcatctgggagctctccgcccctgtcatcaccatgctgtcagccacagggaacctctcatgcgccccgaacactccctgccccttctgtgtctttaggcactgttgatccctctccagagaaaaaaagcaaaagcgcttgcttacttttttctgctagaaatctacttttactgacctgtctagatcctatcaaatatcaccctctttgggaagcctagcttgaaatctggggctgaattccttcttccttgctctgcatgcccacgtcttgtccacacctctattactgcaccgaccaaaccaaacagtactacctactgacatgcctttccctgcccctgttccaagaccgtgagctctttataacagtagtaataattataatagttgccaatacttactaagcacctactctgtgccagccactgtgctaagtaagcactttgcacaaattacctcatttaatctctgcggcaaccctaagaggtgggtcctatattcatcccactgtacagtgtacaggttaggaagccaagattatgaaaggttaagtaagccatactactctcttaggagtacttaagctttcatagtcttaagagctggaagctggatctgcctgaccccaaatccacattctcaaccatttgttcattagccagtatttgctgagcacttactacacatcaggcactgggctacacatgagaggtataaggatgaataaaaccagaccccattcgtgccttcaaagagcatacaatctggtgagaaacacaggcattcatcatgtagtccccagatcaacataaaagttagagttgtagtgtgtgctatgaagaggaggcctgtgttgctatgggaggagatatcacaggggctggctcagctccaggtatctggcttccacatctgactcatctctgtacccccaacacagagccccaggcctacaatgcggggtttctttagccattggagtccaactggcttctacctcatctctcttccagcccccctaccctcccacaacccctggggaacttaacagcacttcctgcccagtgcttctgagatctttttaggtctcctatggctttcctgaaagtatagcggatgcttctctgctgatgatgagagattcagacaagccacttaatgactaagagactagaagtgctctgtaagaaatggggaagcattgttcttgctttgcttagcctgcattcccaagatggactcacaggcactgacgccactcgctgcttattcaggaggaaacatgactggccttggagaagaacaaaacatttgaggggcaatgggaacttaaaaaatgggagcatttggatttcaaaacgaaattgctagattccctgaggcaggcgatagacaccacttaagcatccttgggtcgtctcagttggtgatggctgatagattttccagttggaatcttgggttctcatggctgacagggaccttgaggatagagcatctcatctagaacaaccccttcattttatagcccaaggaccagagatgggaaatgatttgctcaaggtctcacagctaactgggggtagagggtctaaagtccaggtctcctgattcatggttcactgctctttcatgggcagcccacaaataggatctctttttctatgcccaggactatgtgactgcatcaagtagagagaagtgctttaatcagttgttgcagatgggcctctgggaagccagggagcacagtgttgtgctatagataggtgagcctttaagaatcttactctccagatgccctgtgcactgcagccaaggagaatgctactaatatgggcagcgacatcaggtggacaagttgcactaaaggacagatttctccagaagccaacatcctggcttcccctcccctgccagcaggtccacctcctgcaagcactagccaagactttcagccagctgctactgagctcagatctaccctatcagctcctaggttagaagtctagagggctacgctggtttctgctgctttctggacagcagtgacctctcctgcaccagagagctcattaccagtcaggggccctaaggcagcctctcctgacagcaggtgaagatgaaagcaataatgtgctagctgttctgaagcccctggtcaccccttgttttattgaagtccaaagtctcaaacacctctaatgaggataaaaggctggtaagccatgtgggatctgactgaaaccgcctgagagagggtagtgcagagagaggacctggtgagggccgagctggggcctggctttccagagagagagagtgactaccaggagatgctgaccctctctgtttagctctcatctcttatttactcaaaattaacctgtttaatttcctttattaaataatccagtcctccgctgcttgtgtgtgcaggggaacagtgaaccaagagctgctgacttgccaccaggcacagtgagggccagccactcccccgtgcgaagcctggagccaggcttttgtcttctggccctggtttcctccctgcctccaggtcatagtgggatcttgagccagtcctttcacctggctgcgcccatggatggagggtgcagttcatttttgggtgcacgggccacaccacactgcagactcagcacctgcatgtcgccagctgccacggtcctatgagaaagagcaggggtcctgcaaaaaccagggaggtctgcgggtcactgctcccctggagggagccatcctgacagcagttcatagagcctggggcaatgctgtttaccccgagggacccctcatatccccaggcaagcctcccaggtccataacaaatcaactcagactcccccaaaagagacagcctgtgaaagcgcaggcaactccgcatctgtaggacttggtggtggggaaatggtgacagtggccttttgtttgctccctctcagaggggccacaggagcttccagagttcttcccagggccctaacttgatcataacactgcgtgaagaaccactccttccagagttcttttactaaaatgtgagcacccctttctgcaagcatttctgtagctgcttttgtgtcctgctgggcatgctgaagcacaagcaggtgcaaggcaaggaccctgtcccaaaaggggctctcgtcactagatgctggggggcacagctgcagggcaaaggggacttggtgactcctgtgagctgttcgaggacaggaagccctgcaggggtgttcgggagagatgcttactgtgggctggaccctgggcaagggtccatgggggtgtggtgtgggggcatgatgtaggtataggagtatccaagcaaagaggagaaggggaggcattttgacaagaaggaccaacaatataccagccatgtggagcagagggttggcacagagaagggagagagcagcaggtgaggaggtaggacagggcccagttgctgaaagccccaagtgcaagctaagaagatgagccttgatcccagaagccaaacaaggggaaccactgaaggggtttgagcagtggcaaggatatatgaaaatctggcaccaaagcactcactagtcacacagccttgggccagttatttaacttcaccaaacactaattttctcctgtgtgcaatagggatgatgagagagagagcacctacctcgcagggctgaggtaagactcaccgagataatctagcaaagtacttagcagaggcctggcacacagtccatgtgcaatgggttggttcctagtactgtgctcactgaatctaaagagtttcagtaacttggggcttgaagggttattaagggaaataaaggggcttctctttacacctcagtgcctatgtgagacatggaatatttagccagatgtgatgctgatctgccccctgccgcaggacccatgccagggcacagggcacttgctatgtgtctctctcttgactaggggactagggagccaggagatgcacctgagtgagatggggactccagcaccttcttttaactggttacgccccgctagaccatctgcatgtcgagggtggggactgcatactctccacaaagcatggtgcctctggcaggcactctgtaaatacgaatggaaacaaaaatgaacaagtggatggaatgtaagccaaggtgcagaagggtgagggttcccttgagcagcttcctagatgagctggaagggcattgctcaaaagcggagtgcaaggaccactctctcgagagtcacgagtccaagcagctggcaaggcttgtaaacctgagcaagttattcgtccgtgaaatggaggggaaaatgccaacaagcctgcctcgcagagttgctgagagcctcacagctggaagtgatcttcatggaggcgcttcacaggggctggtgtgggatggctggctctgcggaggccacgtggttctgtgtgcaggaggggtggctgtctccacagtgtgccccgccctggccccagccaggcccttcctgggaagctgggggtattcaccttctgctgttcctagaatttgatttggggggtgacttttttcgggggcctggacaaaaagacaaatctagggctaggaaaagagggtgagggtgtcagggctgcctagaggagagtgcggtgagcgcaggctctggaggtagggggagacagggccttggcttattctccagggggggaacagggctgtaggagtctccaggagagggtggctctttgcaaggagaatggacaaaaaccctggtgtcaccctcgactcttctctctcccagaagtcattatctccttagagaggtcttctctagctaaacattcaacaactgtagcctcctgctggtcattttatattccacttctctgccttttgttctccttgatacttttgactatctaacttatatacttacctcctttattgtcctttgccctaataaaatgtaagctccactcgtaaagatggcaacaatagacactggggactactagagtcgggagggagggagggggcaaggtttgaaaagctaactgttgggtgctatgctcactacctgggtggcaggatcatctgtaccccaaacctcagcatcatgcaatatacccatgttacaaacctctatatgtaccctctgaatctgaacctaaaataaaaggtggaattttttttaagttgaaatttattttttaagttccatgaaaacagggatttttgtctgttttgttctctcctatatccttagcactcagatcaacacttagcacataacaggtgctcaataaatagttgttaactgactgaattactgaatggatggatggatggagggcctcatctgaaatcaccctaaacgctgacctcttcctcctcaaacctgactctggaagccctatgggaggaaatgtctccatatcttggagtccctcctcaaacctgtgggaggaggcttcaccgtgacagcgccctccttcatcaaatggaggaagcaacctggcaaggcactgtttaatgccacagatgggtgtgcttactgtctttgaggttttcctgttctctcagaaactcccaggaatccctggccatgacaattctggggttaggagaggcagcagagcgtgtgctctgtgctgggtttatttttaaaggatgaccacatttaaggagaaaagagaaagtggacctgaggcctggcatcaaacacttgccatcagatgggatggaaagtgtttgtctccttggttggctgtgattgacaaagaacaactgcactgaggggcagaagaagaaaagaatcatggacctgctgggagaggggacagctgaagtctagagcatgtgtcttgtccaggacactgtcatgaccacatgcctggatgggcaggaagtcaagggggtcagtgactgagaagggtgggctggaggagaacaggaagaggccacaaaggggctggtggtttgaggctgcagccaaggggcgcatggagatcaagtcaggccaaaagcagaacagcaaggaccagggtcagaatgtggttgacattgagagggaatattggaaggggcaaattgtactgaagaggcaatattgtttccattgccttttataccctgttacttgcagcatggaggccagtcccttagtcttaaaaacacagcacagtgtctccaagagcctcctcctgaccccagagcgccccagcagatactgcactggacatgaggcccatggtctgcaagcccctcatctgccctcttgtgtgcttctttgcaggaaagcgtggacttgggagagatcatgttctccctttgctacctgcccactgcaggcaggctcaccctcacagtgattaagtgtcggaacctcaaggcgatggacatcacaggctattcaggtacctctcttaacccaagtggcctgccagcagcccagacattaggatttggaagggtgttcggggagaaggagaaagaattgtcagcattcttagaatagaagcaccagctctggacacaaactgcctggattcgaattccagttctgccacttctttgctgtgtaaatgatttggttttctagtctgaaaagtgggagtaataatatcttacatgggttgctttcaggagaaatgagttaattcatgtaaatgttcagaatggtgccttacacatataagcactcagtagatatcatctgttgctgtcattctttctcttagaagagggagataacaagaagtaaatatataggatttaaaaattaaggataagttttcttatttatgtgaggccccagggttatgtcgtttgagtgtgtaaatgtttgccggtctatgcaggcttatggcagcaattctgtgcactgagccaaggaaacaaatccactgaaaagcaaaatgcatttgtatttgaggctttgctgcaggcctcctggcctcagcctcagcaccaagagagctgctaggtacagcaggaacatagaaatatagtcttattctagcgacagaggaaatgcttgtttgggggcagctgcacagagacctgcaggatggacgtagtgtcagaggtttgagtctttccccacaattctgcaagttgtggaaggaggtatttgagtttggaaataacagaggagtagcttgagtcttgggagcctccttccctcatcagctcagactgctctgaggagtgaaatggggtgaagcctcttggtctgggctgcactcagaattgcaaatgtggaaaaaagctcagtttgtttccctagatcccctgtcctcctgctcaagagactctcgatgattcagattaccaacgtaaaaccactcaggaggtgcttctgaacttagctgggaatatattaaagatttttcctcatatttgctttgtattctttatttatttgctggaaaccccctaagttgtggaagaaggtatttgagtttggaaataacagaggagtagcttgagtcttgggtataatcagttgctggaaagaggtgatggcccagccgaaaacacctgggctcaggtgtaacctggtgcaactggaagaagaggaggtatcaggccttgaaaactgaagtttcaggacaaggtgctcaggaaaccctagagtaacatgtgtttgttgcagctctgagtccctcagagctacccacacacatcaggatgtggggaagagattaacggacctcttctggcctgggaaaagcttaggcagcagcaagtcagcttcccctaaaatacagccaatgtagatttcattttaataccaaaataagtgcataacagggaagaaaattcactgaagactctcaaggctgctgagggaaataggattttgctgcctaagtccccacactatcttctctggtgtaattaaattgatgtgctggagagaaagcctatggtgaagctgctgaggtcatcacaaaagctgctctgaatcagagggtttggggtgtgagattttgttcttgctaagttctaacctccctttcacaattgcccctctttttgacctgggtttggaacctgttattaaaccttggcttgattccgaagatccaggggtcttcttttcattacaagtttctgtctattttgttcattgatgtaagcaagtatctggaacagtggataaaacacagtaagcattcaataaatagataccgaatgaatggatggttgaatttacagcatgaggaacctggcccaagggtgaagcagtgggggtgtacttgctaggagcctctcgaactagatctcctgttcttgaggatgagtttgaggtttccctcagcccagacttattcgatgttggactaagctaggtattgaatggagcttattaattgcctattcttgaattgtgtggcattgatgtctaaaacccaggatcttcctattctcaatgatctaaactagccctgaatcaattctctaagcctatctgctagaaccatgacactaaaaatagcacaaaataataataaggaccagtatgctacaaaggggtggtgagcacattctaaatgctggattttgattgctcccatgacaatgaggctgaaatacactgctggtctttgtgtcccctccctcagctgcgtagagcatcataggctgttagagaggaaaggacctccaagatcatctggggccagcattccactagaaaccgcagacttttgccccagaaaagcctagggaacggtcatctgtctgcttggcttcatggatgctggtgaaagtgttggttcctgcaagggaaatatgtgcactgaattttataaatttcatatcagccaggcacagtagctcatgcctgtaatcccagctactcgggagggtgaggtggaagaatcacttgagcccagaagttcaagaccagactgggcaaaacagcaagaccttgtctcttaaaaaaaaatggatatgccttgtaaggatgaacagagttggggaaggttgctaagacatttgctcagtggcccatgggacaagtggctctgcctctatttttccaagcctcatgatatggaaatctgccctgatgtgggagtgtatggaaataggtagagcaggggaatgaggcggcacctgagcaacctcaagtctggagccactttgcaagaaaaggtacatccttatggattttgcaagctgctgtgttaaagacaggtattggggctagctctgcccatctgtctacctgaacctgaataatgtcctggggcatatccatagagaatggaatctgtggaaaccagagcctcatgccggttctcaaaactcttacttccattttactgaaaatccctaagagagggtcctttcaaatgtgtagtttgagacagcaggttgattaaacacctcatggtctctccataaacccaacctcatctccccatggttaaggcatagctactgctgccacatggattagtcggcagctcatttaggtgtctacaaaaatgcctttcaggcttggagtttctgatcaggtgtcacagttctccctaatttccaccagggatgtgtgcctcatctgccatctgaatgatgccagggagtacagggccctagtgggtgctcgatgtccaggagatagaaccatatgcctatgaatcacagagctggggagcagctgcttggctggcacctcctgacagattcacaggagccctggcttctgggcaacaaggtgtctcagcacatcagcgtctcgaaagctattattacctgtgagccgccctcccatttcttgagctgtgcagcataaataacaattatgatggtgaccgagacacctgtgctatgagatacactaggtttcacttcacttgggtgagtagaaaatttcagggtagaaagatgaccatgaaatacccattcagaaaactaaagaaaacaaaaggatgggaggcacatggaagttcaataaaagcatctctttgcaggatggagagaatccaagatcccactgagaaaggaaatgtcaaccagctgccctgagtctccccgggccacagctccctcattctccactgtccagaagtgggcaggaaatggcttccagggaagcagagagcagggccacttcacgccttctagatgccaaatggaaatgggattattgagacaatgggacccaaaattatgttgtcaggtggggaggacatgaacagcattgtgattgttgctgttcatttcactctgacacattgtgtctccctggccattgttgagtcctatttttaccccgccccaaaacctttatcctttggtttgtaattctggtaaaacaaaaaagccactcaaagaatagtactccacataggtaaaagaaatagtgtcattgttcagcctcatcacctttttgagtcagccagggattgacgagctgagatttagggctgtgaactgcatacctatcggcaggtgtcatgtctgatatggggccagcttccccattagtaaaagtccattaggcgctctcccaagaatactgaggtagctaaagactctgcatttattaagcacagagtgtcctcagagacaggtgtgctacataaatacaaggtggtttaattattttaacaacccactgataccatctgatgagcagcagtaggtctagggcttcggtccctttgctgcaaatgatgtttgcagacatctgtttaacatactccattcccttttctctgtccccattggcacagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcggtaggtaggcgtcctagagggacgtaattctacccctcactcccactccagcaccagcacagggctccttgaccttagaccttgtgattcagggctcagctttagggttcaggcctcaaatctatctgtacccaagaagggtgcaggagtttgaggaagagcatagattctcccttagcaaaggttcaaagttcttttcccaactggcctatctccgtcaggggcagctctgtccatcagtttccctgaattcaccccttgctattcccattcttccatctggcaccaagtcctattatctggcctttgaaatgcccctctatcctctctatttctgctgttgctactactgtcaccctgggatggctgtgcagcctcctagctgacccctgcctccatcaattcctgccacaattcggtcaacatactaaggacacatcttcctaaatgacagctttcttcctggacctgcccttctcaagaaccatcaatggctcctgtgatccaggcttttcccttggactctgatggccttccctaatctggacccagcatatccatccaatcggatctccccttcctcagatatttttcgtctcttccactcatcctgctcttccatctaggctggctcaaaaacatttttcaactactctggtccccataacttcttctctccacttgtcactttagctaaaggagaaagaaaccatgcaataaagcctcaatacaggactttcagcccaagttctcaggcatagtattgacgaacatacttaagagataattgatgttcttaccgagtgaataaatcacattccagccactggggttttggagaaatggtgctcagagactgtcgatttatttgcaaatactgatgtctcagtgaggttgtaatgtgttggcggggtcaaataagtgaagagacttagactgtctcacctcgcatactcaggctatctgcccaccacttcttgagattccaaacaagtttataacctttgctcatctgcctgtgtccagtgtccactgaaggggactaggcaaaggcttcaccgccactgacacccagaagccctgccaagcatctgttttcagagctcagagttctgagttagacccatcgggcagagtcctaccaccccccacactggacctccttttctgagggcatgtctggtagccagtgctgggacttttgtttctccctcagagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagaggtgggtgaggtcacctggcccttggcatgtttgctgcatggcagtgtgggctggagaatggcagtcagctgcagtgacaccctcggccttttgtggaaaggtgggcatgagggccacatgcttcttacccagtgtgtaataggccaaaaggaaatggaggaagaaggtggaggctgccaacacaaagcccctggtgttgggcattttgaaagcaacactgagttcttaatggaaagcaagaactgtgaagaagacttcccagcagaccactgtgccaggtctgaaatgctttcacaaagcccttggccaagtctgtcctttaggagaaagccccaagggggtgagatcagagcttggcaagacattctacccctgtcagaacagtaagttccctgaggctcaagcaaggaagtcacttggcagttttcactgcttggatagagatgccaaagagcagattcctcctcttatgaatgttggttcttgcccttgttggggaagggagcatggcctcaaggtgtcacgctttctggctaaagctgtggagctgggttgcgttgggttctaacagagacgtaatggagacagcactgggctgggagtcccaagacttgggctgcaatcttggcccctcctgacttgctgtataatcttgaccctgtcacttctccctcaactgcaaagaaaatatccctttgagtaatatctgcaaacttctccaccctccgctgaatcccaccgacttaggatcctgtattctatcaccgtggtggtccccaggcctgctttttctcaaatggattggaagtgtgggtgaccaaacaaggcttaaacctcactcacaatatctcatacctcggtctgtatcctagaaagctggatgaatattctgtcatcttaacaggcttcaaacctaacaagtctagagagctgtataaattggaaattctactaatacaaaataaagctttatccctttcactgcatggcccctcggcttaaaattggagtcaccttcaaaacagagtcatcccctccccacactctatgatgcagagaagtcaggtctgcaaacccatagaacctgccggctccctgccctctcatggaggacaagcccatttccacctgtttctggcaggctgaggtgtctcaggagagcctgagagccaaggggattggacccatggaaacataggtgataaggacctcagttgttgggggatggaggacaggctaattgaatcacctccctagacaggcagcatgtgctctgtgcagctcctgccctgtgacctttggggcagcatcaagagataaaaagaagcaaagtttctggcagttgaggcttcatatttctgtcttgtgggtgccttgattgtcccatagctgtggagctttaatgagtgaggccagtccctcatctctcagctcccccaggggagcccctgcccctcttttccagaaagacctttctgcagagtgtgggtgaggagcccacaatacaggaggcactgctgggcagaacgctagacaacctgcagacagcatccagcacctcactgaaggctgtgttggttcaacccagggagaggtcatgacagccccatccaccccaccacccctcctcccccacttatcttcctttggagatatttaagaatagaacaagtatactaaactgtttagggtggcttagggggagggcatggaatgagagctaagaggcctctggtcggctgtagggccttagaaaactcactgcccagccaggcatagtggctcatgcctgtaatcccagcactttgggaggccgaggtggatggatcatgaggtcaggagattgagaccgtcctggctaacacggtgaaaccccgtctctactaaaaatacaaaaaattagccaggtgtggtagcgggcacctgtagtcccagctactctggaggctgaggcaggagaatggcgtgaacccgggaggcggagcttgcagtgagctgagatcgcaccactgcactccagcctggacaacagagcgagactccatctcaaaaaaaaaaaagaaaagaaaactcactgccccactctggtctttgggttccttggtaaaatgaggggataagcccttcccatctttgcttttctaggaaactctgaccctaagcaatggctgggcccgtgagcccccatcttgtgctgtgactgcctttctaatcttcaatccgcaataacccatccctgttaccaggctgggcctgcctgtggaaaatggaaagtgacagagcagcggctacagctgggggtggggtgttgagtaccacagatgggccaggacttggccccagaatcactctccttcatgatgaatataacctaattaagccaaataattgattccaagtccctgtttctttgagaactctaactcactggttcagactacaaaagaaagataaaatagaatcaagcccttgaaaatgaatatttgatgagacagtaatgggaaagtaacagtatatggaaaacaaaaagagaataaattgatatcctttgggtttacttttttcctgaccttgcaggccaagctcccaggaatgccccctcccccacgcacgatcctgccattttctgctcagctgatcattctctatatcaagaagctaaaaatgacactcgtctcagcaacctgggatttccatagttcacgtttatttaaaattgtcactgacacatttagcgcccacagtttaaatatctttattaaaatgcatgtaaacccccacagggctgacattaagtaagcaccttgtgtccacgcgatgcattgtgcttggaggcaatcctcccgctcatcctcagagctcacatcctgccttcttttcgttcccgttctggatattgagcaagaactttgctcctgaaacttgtatctcccatttgtataatcataaagaaatctcctccagctcctgggaagataaatggcatcatatccgcaaagccctctgtatttatcttgaacctttcttaagggattttcaagtgctgtgatcatttcttttttattaatgagaacagagggcattatacttgctcacttgtttggggctcaaaataaggctgaggggaacaaattaactgaaaaggtgtctttccctgctgggattctttcataaataaaaattcattgagccatcacaagtggcctttcccagctgcagcaccagcccccttccctctcagcccagagccatgtgtcatcattgttaccacacacagagttgaccagcgctcttctccaaggcattttattacgggggccgggttcagatcatctgccagagatgttaaatctctgttggaacgtgacccatttcagagcaacaaaagaccttactggaacacaggcattctgaaacaataatctccctgtgtgctggggacaggtatgctgccatttcagagccactgtaagcctcctggaatcattcgcctttccattgtccacaaaccccatctcctccctttgtttatcttcataggaaaactcagactagcaggggagccagtgttccttcttcatttgttctagataaacagttatgctccctgctactactctttgggctgttacataaaggaagaaagacactctgtgtagtccttttatgttttctcctctgacctggcctatcagtcaggttgtttaagtggcatgcttactcagggaagaagccagtgattataatgtacctttcaccaacagtaaaggttgtaacagaaaagtagaactcctaaaatgaaggtctgttaaataagagcattagtaatcatgtgttgtcaccttctggttaagaaacacttgagtcagaagccacagtggcctcaacaaccaggcatttatttatctaaaatatttcaccagggaaaccctcggttgtgatttcattcacgtggatgctgcaagcagagagactgccacctggagttaggagtaagtacctggtgtggacccaaagacgttaggttgcttattaccttttgtctccttcttcccctagtgtggccagatgctgagatagcagcaggatggagtggaaagaacacttggttgggtgttaggagacctggtttcgggttctggctctgcccctagctagctgtgtcttgacttctctgtctttgttttcttatttgcgagaacaagaaggttagactggatcagcttccaagcctgcctccagtgctgacatgctaagattgcttaggtctaggtcacataatggtggtcatcggtacctgattgtctggcctttggttagtcataaagatcttcagctggcctgaacagggagtcctaagaagcccatgaagaaccgagcccagagaagggtaacagaagctttccttagaattgaaagcattaaggtagtttagtaggtctgggtccttcctgaacttcatgggtttcccatctactccgcaggtgatgctggatagaaagtgatctattcctcaggtggctcggcccttctaggaatggctgtattgagggagaaccacatcctcccccgaccccaaacctccatgtatgcatgatgcatagtagcagcttctactcagccccctcactccatagtggagaccctcaacgctcatgagaagcagaaggggctgcacttccaggtcaggaaggccatcttgaccacctacctacctcttaactctggagctctgtcctgcagacacccaggacagtactgggtctcttcagcccactccaaggatgggtgagcagtggacactgactcactttgaagttattaacataaagcccccaggcaggtcaagaatattcatggggtcagatctttgctcagtaaatattgctggggttatgactgctgcagcgatgactggttaaagaaggattgaatggttcaagtccacccagcctcagccctgtccttcactccattacgcctcattacatcacccctttcacagaagggttagagtcaggctgataggaggcagtctgtgacctaggagaactggggaggagaaaggggttgcagaagcccagaagggtctgctcacacctctacctctccacaagtcaggtgcaaatgcccataggaagaatgaaaaacaaaggagacagctcaaagctaaagcagtatcagatttttagctgtactgtcagctcccagacaaattgctaataatgcatgaccatgggttcttggcagtaaggacatattctgcacactgcctctttcgctgctaacataatatgattttcagtgtgaaaaatggctgaagcacacagaaatggcccagtcagagcacctcattctcacacacacacacacacacacacacacacagagagagagagagagagagagagagagttaagaaagctttaattatctctgcagtaggtctttttgaaaatcaggtattccaaactagaagctctaagctgtttcccttatgtttttgcatggctgacagcaaaattcaagaaagcttatgagaagctaggaaaggtgaattcagtgcattgggccagttcagttttgcaagttgaaatgtaaattcctttagcaattaataaacagattgttctcctctttgcagtggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgccca

SEQ ID NO: 180 - DNA, 7237 bp, Homo sapiens
tggggctcctaagagccaaggggggaagacgggctggctctcaatcctcgcctcgccgggtggcctcccaccctgcgatggggctcctaagagccacggggggtagaggggctggctctcagtccccgcctcgcggtgggtgcctccccgccctgcgatgggggtccgaagagcagggggaaggagaggggctggctctcagtccccgaatcgcgtggggtgcctccaccccctgcgatgggggtccctagagccagggggggaagaggggctggctctcagtccgcgcctcgcggaggatgcctcccccacttgcaatgtgagtcctaagagccagaggtgggaggggctggctctcagttcccgcctcgcggtgtgtgcctgccccgctgcgatggaggtcctaagagcaagggggggaagaggggctggctctggtagattgcaaatgacctgctttttttctgatcccgagctgcgttcggacccctgtcggatagtaaatcccaggtaaggtacctgcggtcggcaggtctgagctttcttcttggacacctaaaacccccagtcctccaggtgggtgctaaggatcttagaatccgcggtgggggtcctaagccagcgggggaagaggggctggctctcagtccccgactcgtgggcggtgtcttccccccttgcgatggggatcctaagagccagggggggaagaggggcgggctctcagtgcccgcctcgctggaagtgcctcccacccatgagatgggtgtcctaagagccaaggggggggaataggggcaggctctcgatccccgcctctcggggggtgcctcccccccttgcgatcggggtcccaagggccagggggggaagaggggctggctctcagtccccgtctctcgggtggtgcctcccgccactacgatgtgggtcctaagagccgggggtgggagggtctggctctcagtcaccgcctcgtgaggagtgcctcccccgctgcgatggaagttctaagacacagggggggaagaggttctggctctcagtccccgcctcgcggggggtgccacgcgcctgcattgggggtcctaagagccatgggggggtagaggggctggctctcagtccccgcctcgtgggggttgccccccccctgcgatgggggtctcaagagcctgggggggaagaggggctggctctcagtccccgcctctccgggtgtgcgtcccccccctgcaatgggggtcctaagagtcagggggagtgagcggctggctctcagtccccgcctcgcagggggtgcctcccccgcctgcgatgggggtccgaagagcctgggggggaagagaggcaggctctcagtccccgcttcgcgggggttgcctccccgcacagcgatgggggtcacaagagccaggggggaagtggggctggctctcagttcccgccttgcggtgtgtgcctccccccctgcgatgggggtcctaagagccaggggatgaaaaggggctggctctcagtcctcgcctggcgggagtgcctccccccccgcgatgggggtcctaagatcctgggggggaagaggagctctctctcagtccccgcctcgcggggggtgcctccgactcctgcgatgggggtcctaagagccaggggggtaagaggggcaggctctcagtccccgcctcgctgcgggtgcctccgtccctgcgatgggggtcctaagaaccagggagggaagaggggctggttctcagtcctcgcctcgcggggagtgcctccctccactgcgatgggggtcccaggagccaggggggaggtggggctggctctcagttcccgcctcacgaggggtgcctccccccactgcgatgggggacctaagagcaagcgaggggaagacgggctggctccggtagattgtaaatgacctgctttctttcttttcccgggctgcgttcggacccctgtcgattgtaaatcccaagtaaggtacctgccgtgggcagatctgagctttcttcttggacaccccatacccacagtcctccaggtgggtcctaaggatcttaggaaccgcgatgggggtcctaagcccggggggaaggggggctggctctcagtccccgcctcgcgtggcgtgcctcccccgcttgcgatgcgagtcctaagagccgggggtgggagggactggctctcagtctccccctcgcggtgggtgcctccccgccctgcaatggggatcctaagagccaggcggggaagaggggctcttctctaagaatcaaaacactgtcacctttagcagtgaaggatccagtgagatccagtttaacggtcataaccgcctactggtccaacgttcagaagtaacacaggcacctggacaatacacagtagatgtggaaggacgcggttgtacatttatccaggttacagaaatctgcctaagagggtgatgagtgtttgccagtaaaagagtcagactgtctgttcagttctacgtgaagtgttatttgaccgttttgtgtatttacatgatcaatagccaaaattgcaagttactttatgaaaagctactcagctgtctaagagaagtttgaggaatattgctattagaaagtattctatcttcattaaattacgttattctgaaaactaaagaatttaacctgattccctgatgataaagatgtaaactgcattagtaatagaaataaacaataggttctttctttttaaaaatgttttatttttaatttttgtgggtacatagtaggtgtaaatatttaccgggtgcatgatacaggcatgcaatgtgtaagaatcacatcagggcaagtggggtatgcatcacctcaagcatttatccattgtgttacaaatgatcgaagtatactcttagttattttaaaatgtaaaatcacattactactgactatagtcagactgtataattcttaatacaggatgggttttcttataatttgctatcctttctaggccacccttaagtacaatgttctcctacctaagaaggcatctggattttctctttccttggaaatagtaaagaactactctttgactgtttttgacctcacagtgaacctcaagtaagtgtcatattttgacagtaactcccacgtgaacaagatggtaaaatattttaaaagttcaaacagtagtgaaataacaaaatataaatcatggtaatgagttctcatgttggtggtgacaattctacagcacagtcactttttagccgtctgtccggacaccacaatttagtacatcttcagctaaatcagagctaaaatgaggcaagaaaacatgcagtctatgtgagcaggatttgaaagctttcactgcactgatgtttcaatgatactttttattctgttgtatggaagtactcctagttttgaaaaacagagattctatatttctttctcaagacaagcatgcatggtcatatagtagcaagcccacaaatgtttattttgtaactgtaaagagtaacattttagatttttacttttcagaatagaaaaacgaaatgatcctcttgaattcaagcatgatttatagatgctaaaggcttttagccttagttaatatgtggaaaacattgagtaaaattagtttgggagatattttttagaatttctaaataaaaatcgcttgagctccagggctaagaactcaatgaattggggaactctttttcttttttggttttttttttttttttttttttttgagacagagtcttactttgtcacccaggctgcagtacagtggcacagtggcacaatctcagctcactgcaacttccagctcctgggttcaaaggattcttacggctcagcctcctgagtagctgggattagaggcgtgcaccaccacatctggctaatttttctatttttagtagagtcagagttttgccatattggccaggctggtcttgaactctgaccctcaagtgatccacccaccttggcctccagaagtgctgggattacaggtgtgagcaaccacgccctgatgaactatggaactcttaacttcataccccaatagtcttatccagaagcaggaaactgagctagaagttctcctggggacacatctactctataattatgctcatataccaccttttaagcaaagatgtcctctaagtgttacgcaactctaacactaacctaagtatatgtaaaagatttagaagctctgtttatcagttcaaactttgagactgcaggtaagcttaaaagcagggtttggggaagatttcatgtccagataattcattatttgctccaatttctgttgctatgtatcatctctttcattatcattctggttgtgcctattcacagatgcttgaaaatgactttcttccgatattttctcttcagcttttacctgtcctccagatttctagccaattagtatttatccacctggcactctcattatgagataagtcactttttaaaattgatatctaaacgagtgttttcttaaaattttcagatacactggaattcgcaataaatccagtatggtggttatagatgtaaaaatgctatcaggatttactccaaccatgtcatccattgaagaggtaaataatagaagcctaatctttcatcacaaagacagctacatagagtataaagataaaataaatacttgtttagccgtagtttagcaaaacaaaactatagaattcttcttcaacattcacctttgtatttttgcgctaacactggagagctggtgtacttcatttgtaccaattagcagtcagtatttcccatggttcatcatatgtttttctttagttgctacctgtgtttatgaaaacatcatggcaccaaggaatgttccataaaacagaacgtgacgtagaaaagagtggacattcagttctgcagtggcgctgtcatttgttctaatatctattctctatccttccctaacaatttcttcaaagcttgaaaacaagggccaagtgatgaagactgaagtcaagaatgaccatgttcttttctacttggaaaatgtaagtttagccatatttttttttctttaaagtttttcttttttccttccaaggataattggatgcttcaatttcttatagatatgtatgataggatttgtaaaaggaaaaaataagggacgttaaggattaccagtgttttatcccactgatcatcttctccttgctagttccaaggctatttcatatatgccctggctatgtgactagatagctttccattttagaaacatcatctccctatcaaacacagtctggtcacagagtagatatgtaattattttataatttgactaaagtcttacaaagtttgccataattttttgaaattacaattgtgtattgaaggtatgtggtgtgatgttttgatatatatagtgagctgattgttatcatctagcgtgactatatgtgaattagctggctaacacatccctctcttcacacagttacctcttctttttttgtgacaaagcacttaagatctactcccttagggaatattacatatacagtacagcattgttaactgtaggccaccgctgtacctgagatttgtagaatgtattcatcctgcacagctgaagctttctatcctttgaccagcatctccccattttcccatccctgataactgccattctactgtctgcatctatgaactcaactttagatttaacttacaggtgagatcctgcagtgttttttgtgtgtatctggtttgtttcattccacataatgtcctccaagttcttcagtgttgttacaaatggcagaaattctttcttcttttaaggccgaataatttgtatgtgtatatgcctcagtttcattatccattcatctgtttcgaacgcttaggttgattccttatgttggctattgtgattaatgaaagaattagcatgggactgcagctgtctcttcaaaatattcatctcattttctttggatgcatacccagaaatgggattgctggatcatagggtagttctatttttattttactgaggaaatgccaaactatggcatgcgctttagagacatcctttctatgtgtattgttaccactcacataaatgcctacattcctctgagacttccagctaaattcctctcacctcaatgtaagcaaaggaacttgaaattttatatgatttaaggttaacaactcattattttgccaatatgtaagttaatcataccctagatctatttaattatgtagatcataaacttctgcggataattttctcagtgattatcttttctcagacctgctacaatgtaattataatttgtgtcatgataggtttttggtcgagcagacagtttcactttttctgctgagcagagcaaccttgtgttcaacattcagccagccccaggcatggtctacgattagtacgaaaaaggtaggcaagcaacagccatgccctaaggttattgaatgtggtgtttatatctaacattccctgagctactaaactttccaaaatcaacctctgtcttcacagagtaaacaataaatggcattactttgtgttctggtttctttatcccatgatgtgtcttctgactgaacccattttccagttaccagagtttttcaacaccagaatccttgcaatataacctgacagggctccacttgaacttgaaatacaagccacactaagcttccaggtctttttgttattgtcattgttgttcatgctaagactgactgttccaagctacttctgtggactttgacttaaaaagaggagtggggaatattctgaaatgttaacttaaaaatttgatagattaatttctaaaacatatactaaaatgttgtagagaccatacaactgttccctggaaggttggtactatttatttcttgttgaatgctgtgtgaagtttgtggagtgtttgaattctgtctctatcatttactaatagaatatatttcatcaagtgtcttaaatattattagcatatttctgcataatgtataaaatgggaaagtaattgtctctatttcaaaattattggaaggattagatctaatgtgcttatatcatctatttaataaaaatacatgttccctttattttttcagaagaatatgccctagctttttaccacatcaacagtagttcagtttccgagtga

SEQ ID NO: 181 - DNA, 4771 bp, Homo sapiens
ccgatcagctgtcggcgcgcactcgctcccggcccggcccagcccagcccggcgcggaggccgccgcctgccctgcggggcccgacgccagcggtccgggtagcagctccagggccggcccgcgcgtgcgcccgggagccgcgcgccaccatccccagcggggaccgaggagcccggccgagcccgagaagcccgcggccgcgatgcctgacgagctgacggagcccgggcgcgccacgccggcccgcgcctcctccttcctcatcgagaacctgctggcggccgaggccaagggcgcagggcgcgcgacccagggcgacggcagccgggaggacgaggaggaggacgacgacgaccccgaagacgaggacgccgagcaggcgcggcggcgacggctacagcggcggcgacagttgctcgcgggcaccgggcccggcggggaggcgcgggcccgtgcgctgctcgggccgggcgcgctgggcctcggtcctcggccgccccccggtcccgggccgcccttcgctctgggctgcggaggcgcagcgcgctggtacccacgggcgcacggtggctatggaggcggcctcagtcctgacagtgagtgagggcgcggggagggtgggtcaggcggtggggcccgacttcctccctgcgcatttgctgggggacttcgggctcgtcgccgcccgttctgggccatcctctcccttctgtggaacggcgtctgggccttgtggggcccccaggagcccctggttgggctggtttggaggcccaccctctggggcaggagctccgctaacgaggaggttttgcaggccatagcttcacccattgccgggctcctccggtcccagggaggctggggacaggggacaacaggaggccaaagaaaaaagaaaggagagtgaaagaggatagggaaagatacaggagaaggcgaaagaggctgagaaagaaaatgggaggatggaggaagaaaggaatgtgctgcgggagagagaatggggtggggggaggggaagatgcaggaaaaagaaacccaagagtgatccgagagagaaaagaggaggaagagatggagggaaagggagacaaagtagcatcagacgtggaaaaataaaagggggcattgagcagagggtgcagtgttgtgggggtggggccggggaggggagccatctaacatggcagctgtgcccccccagagtcctgtttcctctgtgcccgctgcagacagcctggggcaggggcctgggtctccctcttggtccttgaggggcatgggctgtgccaggcaagaagggagcctgttctgaggcccccagtccaacccctctctcttctttttctgcccctccccctccttgcctttgttccctgctgagggcttgagactggggctgggggttctcaaccccagaacccctttgcccccttgcttgggtatctgaccccttagttctgcttcccctccccagggttccagggtcgctgcctcccttttgtacctgccctttaggaagacccctgggaggaaggccaggaaagccagtccaaccccccaagccctggcttagccagccccccacccccaacacagcctttggaccttgaggccagctgaggacgtgggccctctgcaggctccggctctgggatccatgctgtcctctgtatgaatattagtgtgtgctggggagtaagtggcctacgaccctcactcacttgttagataaccctttccatgtcgtggagtgatcctttgcaaaagcccccacatctcggcacccacactcaggaagtctaggcccccacccccttcacgtagacttgagcagggcttccgtggtttcccagaaatcgagcgactctgtctagtgcccttctgggggagactatggaaagggtttctcagggtgaaatttgttctccactcatccctggggtgcatcccctcctgcagcccaggtggcacccctgcagaggcggctcccccttatttcgtgccatgcgggttagggtcccacttcctcactggagctggcaagtcagcctagtgccttgtggcagcacatgggcctctgtgagtttggggtattggggggaggcagggactccccagatctagtagcatgcaccacaacctgctgcctgactcccctgtgggtgctgtgagggcacacaccatggggattggccacgggcgtgagtgggatgtgcacactccttgggcatgaggcacagagctggaaccacgcacagaagcccaccagtgtgcgcaccccttgcatgagcgtgcaaatgctgcaaatacactgcaggcacacacccggccgagtgcacagccttccaggggcccagggccaggccaaactctgcctccacctctaacctgtcaacctgggcctgccctttgcacgggaggctccagaccaaggcagaaaagcagcgggtccgagtcagcctccagagccctgcagtgggaggctgctgccctcttcaatctgggcaagtgcttctgggtcccggctggcctctttaacctgacatcatcccttgccagcctgtgggcctcttcttgttcctaggagatgagtaggggagcttggtacttggaacatgaactcagacaccgcctgtgagcttctggtttcagcccaaacccatgaggctgaacctccagtcttgaaagtgtttggggcaggactcagctgctgcatgttgcttagagtggcatgtgcccgtgttccctttgagcatgattgtggctggtgtggacttgccttgtggacactgggtcagggctacaggagtatgtggtgtgggggtgacagcctcacctgatgggagttctcttttggggatcctttgcattggtttgtcctcctactatggaatgtttctgtgcaagcgggcagagggcgcgggaagaggcctgtgaactcttcattcctccttctggggagcttggcgtggggctggatgccaggtggcagggggtgtcctgtgcttgtttttcggtgtgaacatttctcggaaggacatctttcctcttgtcccgggacttctgcgggaggtttgtgtgtttttccgggccgcccgtggtgcagctgggagtggggagtgctcactggggtcagcctgcttttcttgtgtagtatttttgtttcttttctttgctctgcatccctttgttgtcctctggcatgggtgtgcgtttgtgtttgtgtgttgcggggtgttggtgtgttgcggggtgttggtttggagctgctgcctggtctctgggccgcctcccacggttctgacaatgtgtgcatccccagagctgctgggtgcccagccctgtgctggaaggtcttcctgcttgtggctgtgagcgacctcaaggtggggacggctggcctcagtgattgagtctggtaatcagtgccctagaaccaacggtggtgccctctctcccctgcagccagcgaccgggactcaccggagacgggcgaggagatgggccgtgcggagggcgcctggccgcgaggccccgggccgggagcggtgcagcgggaggcagcggagctggcggcgcgtggcccggcggccggcacggaggaggcgtcggagctggccgaggtccctgcggcggctggggagacacgcggcggcgttggcgtgggcggcggccgaaagaagaagacgcgcacagtcttctcccgcagccaggtcttccagctggaatccaccttcgacctgaagcgctacctgagcagcgccgagcgcgccggcctggccgcctccctgcagctcaccgagacgcaggttaagatctggttccagaaccgccgcaacaagtggaagcggcagctggcagccgagctggaggcggccagcctgtccccgccgggagcgcagcgcctggtccgcgtgccggtgctctaccacgaaagccccccggccgcagccgccgctgggcccccggccaccctgcccttcccgctggcgcccgccgcgcccgcgccgcccccaccgctgctcggcttctccggggccctcgcctacccgctggccgccttcccggccgccgcctccgtgccctttctgcgggcgcagatgcctggcctggtgtgagccccgcctgccgggccctctccccacgaccctgtggacctgtgtggacgcgcgattcagcggcaggcgcagggctcagggggcgttagggaagggatggtcgctcctgcggcctcctagatacctcgggagcgcaggccgcggccgggcgggcctcagcttctgtggggagcgcctctagaatgtaatgggacgccccacccatttgccaggctggatccccactcgaacagggggccatgcagagactctgggctgcgcagcccccggcgccacggccaccccccggcctcagcgaggagcggtcggccatggccacccggggcagctgccctcaggccaagcccagcgcaacaaaggaaaactacgaaccggctgtccaaggctgagcggtgactgtccccacagactgcccccaacactaaacgtccctttcctgggacccagacagcaggccggcccggagggctgtgctacccctctcgcgggtgctggtggagaaaggaccctggacctgtgggtcccatcgtccgttccaggagcaggcaggctggggctctctgcagacgtcgcagcctccgggttgttgtttttttaaatgaatctacttatttgcgtatggaataaaaagggacattttctggac

SEQ ID NO: 182 - DNA, 115859 bp, Homo sapiens
agactagatttaagacaggtgaaactgagatgctttcttagtttgtcttagacagatttaagtagctaattgaccgattgtgaagttttccggttgctgataaaactattgagcgggtacagtcgagtagcaacctgtcatccgtgggattggtgcaccatttttctcactgtggaagggcagcaaaggtgtttgctaagtaaaactgagtggatgagattggtatggaaatcatggttgatctctgagcgggatgttagtgtttaagatccacggagtcaggcgcaaaatgagcacatttctctcagtattcagaaatgagtagataatttttttcgtctttgatttttgtcacaatggtgaatgggcagaaaagggaaagatgctctactgcactgtcgattttgaacggagtcacaggctcggtcgctgaatggggactgtcagacccaaactagttacctgcctttgcattccgtgttcgccatccggaatctggggttaaaaaatgtaaatcaaggtgtgttacatttggtagtatttctttaaaggataaaaggtcgttttgtgttttgagttaaaatgggttgttccttgcccagaaactggaagaagggtctttgcaaggtcaaaccccgggtggaaatcagaatgatgaataccctcaggggtacaagaatgtgtacgtggaaggagcgaggagaggctgatgctccctgcatggtggaaatgatgagtgctccgcattgcctgatcagtgccctgtgagatgccagagtgggaatccatttttctagagttgccctcctgtccgtattttggaaactaaaataaaatagaattgttggtggttgtggagaacactaagtacatactatttgtgtatcactttccagttgaaggcaagaaaagctggggagttttatttctacatattaatatttattttaatttctaaaggaatttcaggttgagacaaatttaaaatgaaactcttgtgaaaacacattttacccccactatcatttaaactgcctacgtgtgtttgtgtgtgtgtggtgggggggagtagggggtgatcctacatcattgaacaacttacttttgaatgcactctcattaagccttgggtatttaataaccccagaaaatgctgcactgaagcaggttggcagaatgggcatgaggcagaaagatgagaaaaaagcatggctagtgcgtgctggatttccacgaaataagcaaatccaattttggggatgaaatgaaataaattttccctcaaatcgggtgtgggggccatcaaatagggctctttggccctttgatcagtccaaccatttggaacccctcaaaggaatttataatttatttaaatggatgaaatttgtaattgaaaattcgagaagaacctctcattggaaatccacagtataaatcatactgccttgtctattccttctttccttactccagggcagaaggactaatcatttgtcataattgagccatactccctgtcatcattgagcattggcatcagttcgatgaatggtgcaggtgttgacactgcattgataaagaggggtggtagaggaaaaaggggggaattaggtatcaaaactgataaatgcttggtcttggagtccctggctcataggttgacagagaggatcaagttaggcagagaccctgtaaggtatctagtccaaaccccttgctttgtagatgaggaaactgaggcccagaaccatggatgtagagaaaagtcaattaacttctagtctatggaataaacaattaaaaagtaatgttgagtggaaatgtttccttctctctttcattttcagcagtctcagtgacattgctgcagacttcaaataaataactgtctgctctccagcacatcttttgaaattgtctctaggggtcccttttataccacctcatttctcttccttgcctctctttgtcttgtaaggtctctttctctctcttttttattgcccctcacctctaatatccccacctctttggatgtttagtctggcttttctggcctcctctgcatctcagacaatttctttggaatccttggcgtttgccgggagcactagcgtatcagaatctgcagttcctgtttgagaactgcccagggcccatttccatctttccctgctgtgttccccaaaatccttcagggaatccagccttcaaagacactgcagttacattcccacttttctccccatctgtcctcctccaaaaccactgcagctgcagagattaggacttcgtggagtgaggaagctgcagggtttccagagtggactttgccagctcacctctggctcctaggaggcagaacccaaattagagatgcctgtctccagccttcctggaaatcctccagataaagccacctgcggagaagggaaagggaagggacagaaagaccgaagaaggcttgactggtttaacctgaagttgtgctatagaggagagtagtgcagctttttcatcctttaaagcttttaaagcatttgcatagcttttcctcaggcagatcttttgttttattctttcgcagtttctgctctcatcttgctggatgagggctgcaaagcagacaaggtgacccgcctaactggccttcctaccttcctcctgttttttctcctttttttcctcttttgctttctccatttcttcctcattttctccctttcttccataaaaattctctgagtgcctatacaataacattctatgcctcctaaatatagtctgggccttcctgtttcttctccaaaaatgtaatctcccaggcactcagaaagatactcacaactaccacaaatggggaaatgctaaggattcttacatgaaaaaagctgaggcattaggaaaggaggagcttgatgattggaatgcaaggccagaggaagtcccacttgggatctctttctcatttcaaagagtaggtaactactcttggaagttgttgaagcttttaagaagcaaagtggtgagtttctcaacacctttaccaattaacaatttaatttaacccctcctctgttggtaaatctttacagaattgggatgagctctgtcttggatggagtctgtttctaacaaatgctctcgggttagttagatgttacctgatcttgctgatatacccattcatatacccttgcagaatacccattccagggtattctgaacaccagatagatagcctttgcagagatgcggagatttgtagttgctaagtgccccgctttggtttactacactgtgaatcacctccccattacatgtgagtcacatgtgataggattacagcatcaggaatattgtcttgggcaagctatagattttctatttgggttgcatgtagttatgaattccaaacattgtggagaggctccctagggagtttcacagaataacagttcagcatcagtatcaaacatatggtttcctaattgataacagcaatatattttcactgttctcaaggtctttttctttgttttgagtgatttctatgctcctaaaattagtgattatttaggaaaataggaaggctctctccacagaaatgatcacatttaattaatctaaactgacagtgtccatcttcattatgcatagtgaatataaacattaattttcctaaagtatcaaatggtacagagatatattaaagaatgattgatagttttactatcccaatggttaattcatatgactaatagaacatatgagctggacaagatccatataagtcacctaatccatccctccaatccatttttaaaatagtatcttcaggaaatttttttatcttaaagacacccctacaatatgaattcgttgtctggaaaagcaatgattttaatgaccttttaaaatatttccacaatatctgtacaatgtcttttatagtggaaactcaatatttgtcaattaaatatttgttctaataagaatcagttgcatgtaccttgttaattatatcaaaaattaaatttctactgaaaccatgtgcacaattaacatttctttaagtatctttgttagtaacgaaaaaaactagattaaaaattattttatacttgaatgacagagagagaccctatctcaaaaaaattattttatgatttattttttgtaaagatattaaagcattatattaatacctctaagagtgctttaaaatctatttacatgtttatcctttttgtctcttaataagtaaaaagataaagtatttttacctatttacaagaataagaatattgataagtaaaagagggaatataaatctagactgtggtagctatgtgctccacttagatcatgctctcttgagctatggaattattttaacatgttcaccctgtgaggggaccacatcattgcatttctcatttacagtttgtttctaaaggtaacttatgcactcttaagtgaatcaaaatagtttgcgttgctcccagcttaaatcattgagaacttttactaatggaagggtcttggggatgctttagaaactatttaatgaatgaaacagaaatggaatagtaaattactgaggaatcttcaaagaggtttgacactttaatcataaggtgcctgtgaatatgttcaagagctgttctatacccctatcagctaacttaaagtatgcagattgggtaattttcacaattcttacactttctctggatttctccacctctttacttaatttactgcagtcctaacacagacgacctgctgtgtaaccatcaattgtttattcttttttttaatgcatggtaattccaaggacttactggattatttccaggtgagcattctatttccttttgttctaaattacaattaagacttggagtactctcattcaccaagtggtcttcaagctcaatgtacctaatacaataattactgaactttttgtagaaagtagatctcttttacttaaaaacgattttatttttatgaggcattgcttataaaaggcaaagtgttaacaaatcagttaaatttatctgcaattattatcgatgcatagaatgaatcctattcattgctgcccatataatacttttctgaaaatagaaatctctcactttttaagtatactttttcctcctttttttggattttgtttattatttcttaggctctgaaagactatgaacttttgaggagctttatgtaaatagttttttgttttttttggcaaatcattaacatgttaaacgtactttgaaacctgggtgaattttttctaatgtaaatcaacagatcctaatatttctgttatcttatattttagaatctttttgcagttcaagagttcttgaaatagtaaacgctggtgttacaggagactagtgttttatattttgcattggttttagtaatttgtgattggcgtgtttatttctgatttcttgaagtccaattttaaattttgagtaaaatgtcccgttggagacccatcaagcattattaataaagttgaaatgcttattaatataatattttgcttttaatgtatcaagtagtgctgcacaaggctcactttcaattagcaagttctgtttgctgaaattcttggcatttgatgttacgagttaatggaagactatcaattttgttaattccagaagttcaagagtttctgtaactttatataaagtgcttgatgttttttgctttcttgttcttatgaaaaattttatgaaaaatgaaaggaaattgtgaagtaaacttaaatcctatgtataaaattgttattcttttaaatgattataaaggtattcattcttgagtgagatgaaaaccactaaactattagtctttcctcatttttagtttgtgaatgggaaacttctaaccatgatttcagttggctcagagaaaattatgagaggaagtataaagttcttcagctaggtatattaatacttagacaaaaattcccagggccatagtttattagttctgtgaccttgaataaattgtttaaactctcagcctcagtttctaatagtaattcacaggattcttgaacagaaaatagaagattatatatgtaaagaatataatggcttattattgaaaatgtacaataaataatagttatccttatcattagcatcactttaatcagaaatcaatagctcataaaccactttggtcactgagttgaagcaatctccgttcattgcacaacttctaaataaggaatcaaatagtgaacagtttacggtgcttaccctaccttataaaacttagatttattgagaaagtgtgccaagctctgtgtagtcactgcagaacaaaattaagtaagatacaatcccagccttcaagaatttatgcctaatggagaagacagataaatgcaattttaagtcaagtgaaatgaaaaggtggtatggatgcacagaattatttcagaatgaaataaatccctgcactaagacttcagattttctcttattccttctttaaatgcatcccctttccattatgcctttactttatcatcatcaccctactatataatgccagcatataattgagtccagaatatggaagtgaaaggaaatttttgagtttatttccttattggatatattttattatctatgaattactgttcagtgtagctaaataacacgtttcccttctcccccaacctgcactcacagttgatcactgaacttcaataaaaaacgtttcaggagctccgcttttttggttaaatattacactgtgatacttctatcttttaatactttcccaaaacaggatttctatctgatactctccccacacctcctctatttttccaacccatttcgcgactaatcattcaatgtgtgtctgtgggaagagtctcctatgagctactctttcattcttttctcccaggcttttacaataaagaaaagataccttccaactgctctttcctactgaaccaaaaacaatgtttctagcccctctccacatttcccccacccccacacacatcaaatccaaagtgaccttattgtttttaactcctcaaagagcattttcaatttccttcaggttttccccccttcttcctctatttcctgcccaatttcctaggaaatttcaggcatatttctaatctgtagataaaaaaggacatctttttctctttttgaagtctacaaaacttgcacctaaattctgaggtttctttgtataataggacaactcctggatgattcatagaattgagtagggttattgttctaattaatcttttgagtttattttctcactggtgaaaatagggataatgtagttatcttatatgaatgttgaagtcctaatatagtgatgtgtatatagcacctgaaagagcttggaatataaataattccttctccccctgcacaccccaatcttctttcctgcccacatcttatcttttctgaccaccttctcagttacatttcaccatttctccttggctagtgttctaggtgtcctgctgcattttttccaagtatatcttcctaattggctcatagttaaataataggtaacataacacatatcccaggtagcatggtgagcgcagtcctagaaagcgtgtgctaactgaatcaatgccctagcttaggcctgtgttcctgcatctgtttagaaaacctctttcatttgtttaagacatgtcttctgctaaacttttcagagcctctagtgactaatgttcagttgatgaacagtcctctcccactccagtgattctgtggtgctcttcataaataatgtcagaggacatctgacagtgcttaattatcttctgatttttatcctcttttttccattaccttttcccccaaggtgccctgagcacctgttaaacacttcaggagacgcctatgcctcaactcttatgcaggatctggtgatatcacttgcatatcttttgtttatcacataaatggttctcaaataacaccaaataaatggcagaagagggaggccatacacacaacacatgttgcagaacatgttcagatcaggtttagcctatcagaaccttcatttgctgagtgtttgtagaagtgtgcactaatgcagattgaccaagtgcagagaatggtactcaaggtagggctgaggtagagatgcacatacatccagatagatagatacatacatacacacatacatgatatatacacagtatgttcaatgtactgtaatagattgttttgtatagttttaagcaaaatatttaagagtaatagcttcataacaaatcattacttacaagacagcattaaaaaggaaggcctattgaaatttcttcattctagatcaagtgcataattgaaagggaggatggtttaaatttggtggtaagaatacctatcagcgttttggaaatatatctttacagaaacaaagagttttttgaaacacttctttggggaaaaatgcttactaaatcccactcttcgatattcccagtgctcattttcatgttaataataagtctgagtggtcctgtggtaaagaccactgaatctgtttagctttgattaattgtatatttccaaacctgtttgtacaggaaacttatgtgaaaatatacttatcaacatttcattgttgttctgaagaactcagttagaaaaactgctttagaaagacaaaagctgaactatgtaatagaaagtacacaaacttagtagtcattaaatgtgtgttttaggcatcacacctgtgctttaggcatcatagtgtgtagctgtggaagacttacttctctgagttttagtttcctcatgtgagaataactatgatattacctaccctttgtagttacgagatattgtgagcatacttcacagactgcataatagcatgtgacaataaaaaatttattgttcatatcattcaactttagaattttagattttaaaaaggtgatttataatcaaattattgatcttctgcaaattattatattatggttatatctgctaaaatatgtcccctgtcttctccccacccctactctaggtcctgggaaagaatgatagatctatgataactaggtcttcacagttaaattgaaaaaatgattttgaagtaaaataatctggaaggaaaagcctaaattatggaaggtttgagacacatctgtatcgtttaaatttgcctctggatttctcatgctctggttgtagaacttgagcccacagccatttctcagtggtgtgaacatgtcttggcttccaaagagacccttgtggaaagaaaagcaaccacagtcaagctcacgtgtttgctctagcaaagaagctttggaaataagattttcatcctactggggttaagagaagcccatgagagtaactgggacttcccttccaggaatcagcatgcatatacagacccaaataatgtgagtaaggacagtaagaccaacaggagaaactaaagagacccacatatgcatgcaaacacaggtactctgtcttggataagctcttgaactcatgaacagagatgagttctcttcaaggactatggaaatcactttgcaagagctgttctgattatgaaaatctgaaccttacttagatatcctaacccagtcatcctaagggaatgcaacaaaaagttgcttctcagtcctcttagcacatctgaacacataatcactgtatacatgccaactctcgcataaaactggaaatttcttgagggaagaaatcatgtctgatacatgtctaagtcccctttggagagctgtaccactgaggccagcagaataggtggagcagtaagtcaactgtgcattgacccatcaataaattgtggagtttggaacttcccagtcaggagttgttaaagagtcctcacacaccccaggataatggcaaagcatttgggcatctgactcacagagtgccagattacacaggcaccagtcaaataagaccttgtccatttcctatatagtccccttctctgccccctccctagaaacagcagagcaagtaatacaagagggaagccagcaggacaaaagaacgtattaccccctctccccactgctagattgaaatcctagttaaggaaagactgaattggtatagtggaaatttatatttaaattagactaaactttttaatatctagaaacaaccacttttctggtacctacaagtgacagaaaaaatataaatcagcccaagatatcatcttggaatggggaagggaggcatgatagagcatgtttgcagcagtgatgagagaataatgtagccaatactttgataaagtggctatacaaggaataataaaaaatggcatatgattcattcttaaaacaagaggccttggccagaattgctggtatgggtattagaagaaatccatgagaactggaagaggacaggggaaagtgatctagatccaagtcaccaatggcataggagaaactgggaaagctgacattcttccaaagaggtgctcagtagaagaccatgtacttagaaggcttacctatatcattcatctttggctgttagccaaaattgaattaatctgaatattgaaagttatctctaggctaggtctcaagagcaagtaaatgaaagcagaaatcatttatgccttctaataataatagctagcaattttgttaaaaaaaaaaaaaaaaaaaagcccaggcgtggtggctcacccctgtaatcccagcactttgggaggccgaggcgggtggatcacgaggtcaggagatcgagaccatcctggctaacacggtgaaaccccgtctctcctaaaaaatacaaaaaaattagcagggcgtggtggcgggtgcctgtagtcccagctactcgggaggctgaggcaggagaatggcgtgaacccgggaggcggagcttgcagtgagtcgagattgcgccactgcactccagcctgggcgacagagcgagattccatctcaaaaaaaaaaaaacaaaaaaaaacttagcacgtacagtgctctgtgttggatacttacacgcgttacttcattacttacagcttttagaggtaagtgtctgcaaggttagcttcattttatgactgagaaattgtgtctctgagatgaaagtaatttgcccaaggtcacatagatattaagtgataaatgtgttgttcaaacccaaaaccctcttgttctaccaaactacaaccaatctacacacgtctttttattttttaatttttttattagggaaagcgtacatatttggagagaataatataataagcccccatgtacccatcacccaatgttaatcagtattaagtccactttgtttcactgccgtccccatccttcctctctctaatgggttaatttgaacgaattaagacatatcattttgtgtgtaatagtttacatatatccacaatagtattagcacagcaaaaaaaatcacttaatatcatcaaatataaagccagtgttcaaatctcctaagtattttttttaatctcctaaggatttttatagtttatttgaatcagggtgccaattaagtctatacatcccagttgttgaaaagatagcaccctgtttatatgagacatgactgcatctcactggagagaagtatattgtggattaaagagatgtggctttaaactaaagataggccttatcactctgaacaagttgtctaaattttggaaaatgaaaattgtactcctgagattaattgtaaggataaacataatgtctttgaaagtgcttagaacagtctctcgcatatacaagatcttcagtgaatgttaagtctcctataaaaagagggggagggggaaagagagaaagagagaacaagagggagggaggaaagaaaaaggaaaaatggaatagtaggccaaaaagcgtggccttcttattaagaggaaacttcttgaagtgctttggcaactgatcttttgagagcactcccattttgttcctggatggatatttgaccacagttgtgccaaagtagctaatgtctaatggctctgaatcttccccactgacatgtttatagttctgctgtttcccatatgaaaaggcagaaaatctgtaactttgaaattatctcaaattcagaaaaatgacagtattataaaatatctttaacttcataccgattaaaactaatagaaaaattaaaatatggcatacattgtattagcagtgattgctgttatgttacagaggtaacatagttttaaaaaacaaataagggcaattaatttgattcagatttgagtttgctttgttttcatatgaacttgagcaagttacttcactcctcaaagtctggttcttagggtgtaaaagggaagttttgaaaaaaaaatctaaatatcagacatcagcaacatgggaaaatggaaaaataatggactatatgtcagaaccaaatttgaattctaattccactacttaatgtcttcttggccttagccaaataatttaatctctttgagccccagtcttatttgttaaatgcaaattataacgtatctcacgaaattgttgtgaggactagaaataatatccattaaatgcttagcggaaccctctcttttatttgaaactcattggtggttattattagtttgtttttaataaagaagtagtagtatttgctgtcctcaattcaagagctcttaatttaaattgagaagttaaataaattcataataaagaagtagggaactgagcatagccaacagaccatcttttgcactgggtagatctaaaaccatgtatgaagttaatggacactttatgtagaacaatgggtagatgaattcaacacacagtatttataagggctcataatgcaatgacagtatactgcttatgactacttatttagagaatgtaaagtgagcagcttctatgttatctgagaatcacctcctcaaatgccaactggaggttgctggtaaggagtacccaaatcttcataataggtctataagtttatacatctgtaaatggaaactcaatgagaggtgaataatagagggaaggctaaaaatctacacagtattccagctatcttctctggattgtgattattggttcctatggtagataattaggaataaagtcatttatttgaatttgtttctagcttggataccaccgattgttatcatggtgactgagatcacctcattgtaacagtgagaatattcattttgtcattgtctaggattagatagaagtacagaactcttttttttataattaaatgaagaagacattactttttctttcagaacacttttttttctagttttttaaactcatttaacaaaactctaacaaccagaactaaagagggctgcgattgacattccaggtaattcattaatcagatacctggtccttcaagtcactactctatataacagctcttaagtgagactcagtgagggttgggaatttgccttttttaagtaaaaagagtaatattcgctcattgtgaaaatttggaaaacaaaacagaaaaaagaataaaaatcacctgcaatctattactaagttatattttcctccattttcaatattgttttctaatagagactgctcatttctttaaaatttatattctacatttttaataacattatagcagaaacatgatcttttcaattaaaattctttgcaaatgtatattttaaatacttggattacactccatcgtatatatgaacaaggtttagctcactgttctcttattgttttacattttaacttttaaaataccacttaaaggaaaatctttgtgcacataactctgactacaggctgcatagtgtcctcagcatagatttctgcccatctctggcagagtgtgaaatttgaatgtaagtttgctgctttttatggcagaggcttgggccctagaaagtagtaggcctgagaggtcataacacttagaagattgaggaaaattcacctaaactagttactaattctcagggccagcattatgagcagatggctgcattcctttccgaactgaaaagcctattctaatcaaaacctacctgcaattgcccaaaagtccattatttttgtcactttgttttggagcaggaaacagaaaagagagccaagtctaggctgagatcctggagcactgattaatacagtttttatgccatgctttgcctgtatgatcattgctactactgctaccaccatcatcattatcaccttcataaatatcatcttcatcatatccagtggtagtcttcctgaacagtctgtgaattcctacaacgtagactcagggcctcattaatctttgaatttctcaaaattctctatacctaaatagtcctcagggaacattgttaggtgctttaaaacagaattcactcatttatgttttagtttaaataaatttctaatcattttttctccaaagagagtattgttaaaataaagtaagtagaaggctcttgggttcccaggaggtagtgaatgacaaatttcatttgcttagtttgtcctgtctcttaccagccccaaccctactgtgacacttggaggaaactcttaaccataggattttttctcactcatatgaaaaacatttcttttgcttctgctatatgccagaaattgaatttagccccagagacataaagatccttaagacaaatatcttttttcaagaagctaatggtctaaagcaggagctaaatgaaatgggccaggtgttacacgagtgttaaaatgatggtattttgaccaagcagaatacctgcctcatttctttgccttttaaaacatggcatcaaacaaaataaccaatacgaacacatctatggttttatgtggttcaggatccatgagttttacaccccagaactaaaagaagaactcttggaccctgacttttacttccattttaagggtagtttttaaaagatctttgtaacaaatgcaggcagagtccatatgccagtgaaaatgtaacgtttatgaacccctgcttttacatcagttattataagaaccatgtttattcaactgaacaaccatatattggtagaatctaataaaaggaagtaaattattaaatatgccagttcatcacttcttaaatcaattggatcattaaaagtcattggtaggcagacatcatgatagaaggaaaattgtggctgtagtgtcacacagaccttaattcaaacccctacatcagaagctgcatggcttctgattccttgcctgtgaaacagaaactgttaagtctatttcacatagtccttgtacagattagataggattgtgcatgtaacatacttaggacagagcgggggatagggtagatgtgtaaaaccagatagttatcattgttcacagtggcatatgtataactaagtcccacagttctttccaggacttattcacatttaaatgaagctcttaggctgaacatttcttgtgtagttcaccagggtattattttcagagcccagttctgtgcttaccattctatagattctcaatatatatgcattgcatgaatcaaaggacaccaaatggtctctaagagatggaataggaaggtgagaatttctggccaaaggagaaagatatttcaggggcaaaaggagcttacatctgcctgagtttagtcattcaaggtcttttcacttttcacagattattacaccttagaacattcaggtgttccaaaagtctcctcagttaatccagcaaaggagaaagaggaagagatggctttttttttaaggatgccatgtttgtaaacaatcattagcacatatcatctctttgccaaggactctgccaagcgctttacatgcatactacctcactcattttcacaacaatccaatgaaatagatattatccctatttgaggtgaagaaattgatacagaaatgtaggaacttgcctaaaatcagaaaatttgtggtctctaaaatccaaattggatcgatgctctttttactcacttcaccttgtttttatattcactatgtagcttttgtatgaggtactatctctgtttcaccaattcatttgttctttcaacaaatatttattggacatcatttgcctagcactaagtgaactaaaacaaccataatccctgccttcatggagattagagtctagctggaggaatggatattaaacaaataatcacaaaatggcaccacttacaattaattaagtgctatagacgaaaatagtaatgctgtaagaaagtgtaacaaggagacctatatttggggctgcttgaaataatagactccaggaaaatccactgaggtctggatttccagttttgcctcctgagattgctactaacactcgtttaccattgctgggcctgacaaaggaggcttattactgcatttctttttgaaaagaggattatgggtcttcctcccaggatttaccatctcccattttattcctcactcacaaggctccagtaacagaggacaatagagcttttgatgttggtaaatctccaagggaagcttaccctctgatgcaaagttccctgggacggtttccagataaagaaatttacaagcacctgtgtgttacgtgctcttcccaaacccgtggttgctttcctgtggtgtagatgtataggtcattagatacgcccaagtgctcctacaactctatgtgcttctacaagtccatgaaagaagcagagggtgctgcaggagcatttctggggcacacagaaccaaactttcctaggatgaggattggaggtgagatgaattttggagatgtcaagactaggaattagatagacaaagggcagagggagtaggaatgctcttattaagaggaagcagcaaccaaagtatataatgagagcaggagaatactttgaaatgcttatgtcctgacataaggttttaaagggttataaaatcttaatcaaatgagcatagtatcatggaaagaaatatggttttataatcaagccaacattccattccagctcagtcacaaaatattttgagccttataaatcattttatctgtgaaatgtagataatgatacctatgtgacagtattattgtggtaattaaattataaatgttgccacataggtgtcatttgatgcctggcctttaaagtagtagaaatctggtgggttttaatgataagatcaataatattgcatggagctaatttttactgacttcattacatgtgtttatctaatgattacaacttcatgctaagaattttcattatccccattataaagataattgagacttagaaacagtaagtgacatgcccacagtcacatagccaaaaagtggcacatctggtagtctgacctaagccccatttcttaactgctctccactgtctccctgtaatagtcaatacacagctattattattgttatcattgtcattattatgatcattatttaaaattcaaaggtcttgaggtcataaccagaattctgatatcaaacatctatgatatgcttttttttctggagcaagagtttgcagattatctttaaggtatttccacttttgttgttatacctcataatttacatggcagatcagagttaaattcagcttaaaatgatagatgatcccagataacaatggcttaaataagagagaaatttatttctcactcatataaagaaactcagaggtaggcaatccctgacagggtggtttcagggacccagaacctagacttctcagggacccagactccttcagcctttttgcttggctagccgtccttagcaggtggcttgcacctcatgatctagtgtggcggcagccacatatcggctttctaaccagtaggaaggagaaaagggagatgaaggtcaggtcatacccttccctgttaaggacacttccctaagtcacacctgaaaattggcatacatgccattggccagaatttagtcacatttaatataatccttgctaaaaattaggggttttattactaaagaagaagaggaaaatagtcttggagaaaactagaagcttctgccgtactagtaataaaattttaagatacaataaatatttaatgtagatgttcaatttgttctttaaaatgtgatatttaaaaaccagcaaaaaaaaaaacaacaacagctttttaaattcatgcctaaggttctaatcaactatgtcttttacaaaaaacattgtcaaagaggtcatacaaccttggtattcttggctgggcttcgcttctagcttttcatcttattcaaatcactttcttttgttgggctttagtttcatcatatgtaaaatgagtaggggtaaactagaatttatctaatatccttccagttctacctattattactgaatgacataggtaaatcacattcatttacttacaagaattttaaagtaatttaagtgttatagggcaaaaatctagcaatgagccagttttctcaggagtagatacagatttatctttgtatatttatatccttcctcatcatagaaaagaaaaagacttctatctatccctgaaaaacactataataaaaaatgaaataagcagaataaacatcagaaaaaataaacatcagaaaagagattaaactgacatcttttgctgattatatatattgaaaatccaaagattcaagtaacaacaaaaattagtaaaaactggataaggagactagctatcagataaattacaaaaaaagtagccttttcttttagcttatcaaaaaatattcagaaattaaaattagaaaaaatgttctatgttcagtagcaaccaaggtaatatttaggattaaaaaatgaaagaaagacaaagtgcttatatgtaactgtaaatcttattgaagaacagaaaatacagttaaaaattaaaagacaataggaaaacatcatatatatatacatatatatataataattataatgacacaagggtttttattttaggcatgcatttttaagttgttttacatggttttcaagtttgtctggaaggctgcattctcaagattagaggtatttaaaaaaagagtgagggtaagcttgcattaccaggtgccagaacacacaagcattataatcaaataatatggaataggcatatgaatagacaagtagaccaatggaacaaaatagagtattcacaaaggtatttcattgttataagattttatgaattatcaacaaaggtggcatttcaattcagcaggaagaatgtagcttatttaacagatggtactactggcacaactgattaaccatttagaaacaagtgaatctgaacccctatctcacattacataaaatgaatttcgggcatattaaagacttcaattttttaaagcctcagaagaaaatctaagcgacatttggataatctagatatagtgggaaataagcaatcaagaagctataaaataatagggatatttgactccatagaattgtaaactttcattatgtcaaaagatgtcattaacatagaaatttgccatatattttagtatgctttagaagatagatctctgtatcctctgtaccataatgcctggtccataactgagattcagattgcaacatatgaggtagaacagggtaagagctactacaaacaggatagactatgtactgagacattttagacatgggagaacaaatctgttttcaatagatttcttaagttgcttctttggtcctcaaaacttttttcagtaagagtatgacagttaatccaactcaacagttcaaacattaattgagtgcctattatgtgtcaagccctctactggaaaaaagatagaaacaaaaagagatagacttcttgatagagcttatggtagggaagggacaataaacagatgattaaaaattgatcagtctgaaaaatggggtgaagaatatgctcctgtggacatatataacaaagagaataacagcctatggaatctaggacagagacaaagtggcatttgtgttgacatcctaagtaggaataggagtcagccaggtgaagagaggcacagaaagagtgctccccacagaagccctagcatgtacaagggctggatttgatagtgaacctgttgaaaaactggagcttcttaaaaagggacttgggtgaatggcactagatactaggatgaggctgaagagttaggtagcaagctgccaggttccagattgtgatgaatcttccaagcagtattaagcaattttactccatcttaagagcagtaagaatctattggaagctttagaaaggaagtgatttgatcggacttgcattttcaaaagatacttttggagaatggattaagaagatgctagatggaagcagaccagtttggaggctattgcagttgcccagatgacagatgatgttccttttgatatggcacaaattcagagacttgtataaatctgagagaatttaggaggtagatcatcggggagcgtggctgtgtttgtaaggaaagaaaaagaggagagagagactgtttatgaatgattgggtaaatggtggtataattcttcagacagagaatccacaccaagtatctattcttttttttggtgactcttaacaatagccaagaagttaatccaaaaaatgacactccctttacattgttctaaaaaagaacttttcggaataaaaatgtgactcacatcaaactctcaccagccaacagggtctgcaatgcccccagactactgaattaccattcaattccactgaggtttcctcagggctacagtttttgtcaagtgttcccaatctttttcagcagcactgctttatacttctaagacttagtaatgccaacaactttttcaagctcccaaggttagtagttgatcgaaagaacacatagtgacaaatagctactataaatttagaaatgttaaaattaattcatattttattaatagtgatagaattgacatgaatttgaaaaataatgcaatatgtgaaagaaaccctattcagtttccaaagcttagtgttcatttgcattcacagactcttggcaataatttgttggattcccccaccttcagacttcaccccagcaatcgacagaccaaattttatttttcaagatgaacattttgtttgaaataagaaacaaagctaatattaacatgatctttttaagaatttcacattctttagaaaccaaagcaaaaagcatttggtccctaatgatggcattaagacagggcaatgagattatataagcatgtgttctttctgctcccctataagtatgcccttaggtttaaaaactagagtctatccataatgagggcatacattgcactaaggcagatgtacctacctctaaacgtcgtgattaaaagaggagttattttaaggataaacatcagaactagccctccagagccatcaggaaccagcagatctctagggatttattgtcttgtgagattcaagatgttcctctaactatagatagcatttcagcttttctctctgcagtttagctttgcgttcactattgatgaatgatctggtgccatctgtcttccattccaaatccatgaaggggcaaggctgattatttttacctctatttgcagagttcttccaactatccaaccctactagtcttatcacctggcctgtactgtgccactcttgggtcggtgactcaaccttgattgccatctctgcctaaaaacagcttaacactacctccttgaacttgaagtatgaatagagccatttctgctaacaacaacaacaaaaaaagggataggacatattaataaccaatatgctcaatatatttgacaagaaaccaccagaaaggtgagataaagggagaagggaaattacttcatcccaaaaataaatcaagcaccacttacatgtgttacataatgcattatcctcagagcaaaacccagcagggttataaaattatctccatttaacagaagaggatagtgaggctttgagagctcattaatgtgcttcattatccagcagattcaggcctgttggactccacagcatggcttgtttgcaaattcattgtagctgggggtgtttagctatgtgtggcatcagtcagtactgtatggagagaatacagaatatggaaaatattggtcagtcaccttgttcagtttatgtcagtcaagacagctcttcagatattaagtaaataggtaattgctgaatatttgagaattgcctgtctgctatctgaatgtgtaagtccttttgaaaaaaaaaatacagttttagctgggcgtggtggcacgcacctgtagtcccagctatttgggaggctgaggcaggataatcacttgaactcaggaggcggaggttgcagtgagccgagatcgcaccactgcactccagcctggcgacagagtgagactctgtctcaaaaaaaagaaaaatacagttttattataaagttaatattagataatgatcatgaatctagaaaaaaattaaagtagaaaaataaaaattatcatcctaatattcaaaggtaggtattgtgattatttggtgtttttctttctggtttcttatctatgttctttttttgttttgttttacatagtggtgacatagataaaatttaccttcttacttctaaatagtcttcttaaaaatcaattcctttaattacatgaaggttttttcagagtcacacctttctttgtctctttccttgtttcagaaaggatttcagttaggtttaggaaatgtgtcaagcatcgtaaaataaaataaaacagaaaaaatgaattagaaaggagaggtttcaaaaaggaaaacaaggctttcttttatttgttctggcctaaatttctttttttcacccccatttttttcacaagtgttgattggcccacacttctgatcattaagtagaagtttttctatgtggtctggcaaccactttgtgccttccttgagtctttccaatctaaaatgcattttcagagcctataagctgaaaggaactatgtctggatagatggccaaagattgtgtttcatttttgtaatgagatgcatatttatcattaaatgtacctttattacaccatctcattaggctgttcagagtggtttttaagaaattattccaatacttatgcttaggattctgtaaaaacaacaacagcagcaactacaaatgattatatcctcattgtgtgttcttagtacaatggcagaaaaccagatgactcaaagtgttactccccttccaactttgtttttttttctattttagaacctctaaagataagaatttctcaagttgctttacaaatttgtgttaaacggctgtgcctagtatctgaattcacagatgaaaatagaaactttataaaattattttttaaaacacttgctgaatgcccacatggtataattattgatgagcaagacagactcccaccttcaaagcagtcagggtctaatggagtcggacaagtaaacaaatagttgcaatgaacaaaaaactagcttgaaagtatcgcagatgcaattgtagtatcaacaaagtagtcgtaagattacggaaattaacctgaatttcaatttagttgaatttctataccaaatttgtatgtcatgaaaatgaaatcacttcagaattagcaatggagtatcagagaaatgtattttttcctaaacttaaaatggacatgctttaaattagcaaaatttttagagttatgggacaattttctttttagtattctaccatgtttcctttgagatgaacatgattactgtctatggtaagagctagaagaaaaaagattatctaaaatcatagatggccgtttgattaatcttcaacattgtaaagtacctaggacaatgttagtctggattagggagaagtctgaattacaaaatactttaaaagaaaatacttttttattgggagaaatttcaaacatacagaaaaattcggagaattatataataaatatccattgatctacccagaagttatgaatattaatgccttctcatattttgaaattattttcatttctattctcaatctcactcacctaccttcttcctcaaagcaatcattctatttaatttggtatgtattttcttcatgaacacttttatttttacttaatatgtagatctatacagtatcatttttgatatttaagtagctgacatcatacttaatgtatcattcaccaaattgcttctctcaaaagtacttttagatcatgtttattatgataatattatatgctattatcaatttacatgtgatagttagtgcctaatacaacaacagagaaagaaaaatatattcaataaaactgtgttaggataactgaatgtctacagggcaaaaataaaattagagttcatgtaatattattcatttattataactactatacagctgagatggtttggctgtgtccccacccaaatctcatcttgaattgtagttcccataattcccacgtcatgggagggaccaggtggacttaattgaatcagcagttcctgcatgctgttctagtgatagtgagtcagttctcatgagatctgctggttttataagggtcttccttgcttcaatgggcactgattcttctctctcccgccaccatgtgaagaaggatgtgtttgcttccccttctgctgtgattgtaagtttcctgaggcctccccagccatgctgaactgtgagtcaaataaacctcttttttttaataaattatccagtccctagtatgtttttattagcagcgtgagaacagacttatacagcagtatttcatcatgcaactatatcttgttatttattccctttttgatgaacatttagttatcttttctttttttgctattacaaagttagagtgtacatctttttcacatggcttcttgtatatatatgtgagatatatagtgaaatggaattgccagatcatgctctatatgcatcttctgctgtattaaatactgccaaattgttctctacagaaaatataccaatttatattcccaccagcagtatattagaagaattcatattgctctacatctttgcagtcatttggtatcataatattaaatttttaaatcaaactgattatataaaatggtccttcataatttttcattttcttaatctttagtggccatttaggttttcttctctgtaaattacttattcacaggccttgcctattttttaataggattgtttgtctttttcttatccatcatttggaattccttataaattctgaatgcaaactatttgttatatacattgcagatattatctctttgtctgtcacttatttaactttgtttatggttgcttttgtcttaaaaacaaaattttaaattttgagatagttggatttatcaacctcttaccatgatttaaaatactgtgttaagtttgggttttaatctaactgaaacgtatttttgagattggtgtgaggttgaaatctaattttatttttgccctgtagacattcagttatcctaacacagttttattgaatatatttttctttctctgttgttgtattaggcacccactatcacatgtaaagtcccaaatgtttagctctctgttctattgccattttgtatttttccattattttatcagtaccaaactgtattaaatagtgtggctttataataagcttagatatttaatggagtagaacactatccgtggtcttcctcaaagttgtcttaaatattactgaccttttgctttttcatttggttaaacttcataaaaaatatacttgggatttttattagaattgaattgagtgtttatactaatgataacagaactgatgcattataagatgatttggtttccaggtatatttaaaatttattcaaatttttaaaaataaagttctatagttttctccataaaattttgccacagttttatgaggtgtattcctaggcatcttacatgattttggtcttgatgtaaagagagtctcatagagtctcacttttttttttttttttttttttttagaaggagtctgcctctgtcgcccaggctggagtgcggtggcgcgatctcggccccctgcaagctccgcctcccgagttcactccattctcctgcctcagcctccggagtagctgggactacaggcggccgccactacgccaggctaattttttttgtatttttagtagagacggggtttcactgtgttagccaggatggtctcgctctcctgacctcgtgatccgcctgcctcggcctcccaaagtgctgggattacaggcgtgagccaccatgaccggcccaagtctcacttttttaacgtcactttgctataggttttttggtatgaacctttatcaggttaaggatattcgttctagtcttaatttattgagagttttctttttctttttaaaataatcattaatgtgtgctgattttattgaatgcttttctaataaaaagcttttttacttctttactaataaggtcaatacctgtaatagattttctaatatgtatcattttgcattccaggaataacccctgcttgatagtgatattttaaatacattgctggattctatttgataatttgtaggtattttacctctcttttcaaaagttaaattagtctattctttttttagatgattccttacaaatggcatatagctggattttactgagatgacgaatgtatttagaattccatctatcttcttatattatatttttaatatatgctaggcttattttttggcctctcccctcattttctgttttctattgaattaagttttatttattttccttcctttcttctatttacctagaagttataattaccactgttttgatacctattttgttacctttttaatatgtatacttaacaattcggctttgtttgtttgtttgtttgttttgacagggtcttactttgttgcccaggctggagtgcagtggtgcaatcttggctcactgcaacctcaaccttccagcctctggtgattttcccacctcagcctccccagtagctaggactataggtacatgccactatgccagacaagtatatacatatttttttagtagagacggggttttgctatgttgcctaggctacttaacaaattttaaggtcagtcagtatctttagttgtctttaaacaagtgaaggaccttgcatgttttaactccaaaacacaacccccatcattcatgtcattgcatcctagtatgtttgttgcaccttagtttttaatcccaaaacatcccttgttgttgtttaccaacttttttcatctatttctttactcatcgttgcttcttacaactacttcattctggtttcagtgtccttcgtcctgaagtacatcctttaataatagggtccataattagtattttctctaatttttatccagttgaaaatgtctttatctcactctcattttgaataaactttaactgggtatataattattagttgattttttttcctttagcattttgaaactattctgttgatttctggcattaaatgtggctgatgagaaggctgactttagactaatggctcttcctgtaagttaaccaaaattttctttctgatagattttaagataattttcttcaacttttatgttcttaaatttcattgtcgccaggtatggtggctcactcctgtaatcacagcactttgggaggccgaaatgggcagatcactgaggtcaggagtttgagacctgtctggccaacatggcgaaaccctgtctctactaaaaatacaaaaattagctgggcatggtggcaggcacctgtaatcccagctactcgggtggctgaggcaggaggattgcttgaactcaggaggctgaggttgcagggagtggagatcatacaactgtactccagcctgggcaacagagcgagaccctgtctcaaaaaaaaaataaaaataaaaataaataaattaaataaaataaattaaaaattaaaaaaaatattgtcatgtgcccacatgtggacttgttttatttctcctactctgaaatttgtaaaatgttttattctgaatttttcaaatctgaaaaactccatggtttaatttctctcctactctctgtcttatctcgctttggagctattaatagcttctcattattagaagctattaattggagcttctcattctagcttcattatctcttaatgtctcttccatatttttcatccgttacctcactgtgctccattccagataatttcattagaactaacttccaatttactctttcctcttcatctgtgtctcaactattatttaaactctatttaaaaatgtattaagtttatatttttagaatttctattccattatccctcataattaattattctgatcttcaagtctctatttttaattctttaacaagaaattactgaaaacaggtaatgaaaacatccctttaagaccattttagaatttgtaattgccagagctccataatagttccgtgatgtttcttggcttagggttcttactttggggaaatagtacaaactcagactataactaggtaagcattccaattcaggattccaatttcttgttttaaagtttttattttggaatattcgatgaaggatcttttccgctcagtctatatacctggcataatgtaaaggagacattttgaaatcttgcaaatctccaaattgagtgtctgactggtagttttcttcatgaaatacagtgaagagattgacctcttctcttttcacttccattatcagcaggaggagatgtgttttttaagggggacattgttcacaaaataaacaaagctttttagtttttgctgtgtttttaaatcatttatgagactccctacatgcgtagggtagaataaagattaacaaaactgtacttaaatgcagatgcttgggagaatcacttattagggctacacaccagccctataccaatcatgttttgaacgtgtgctccaagaaacttataaaccacttgacttaatgagctatttaggcccattatgaaatacctgaaaatttaaatattaaatctattaacaccaaaggtttatagtatttggcatcaggatttttctgagtgtgagtatctatggattggtattatttgaaaacttatttccaaatgcaaatggaatacacagattaatacaatctgagaaaataaaccataaaagtagatactatttattaagcatctcctatatcagccactgcattaggtttattacctacattatttctaattttacaaatgccctttcagtcaggtggtagtatcataattttatagatgaggaaactgagccttagaaaggctaattgattgtcaaaaatggcaagattaggctaggtgcagtggctcacacctgtaatcccagcactttgggaggccgaggtgggtggatcatgaggtcaggagttcgaggccaacctggccatgatggtgaaaccccaattctactaaaaataccaggtgcggtggtggcgcctgtaatcctggctatgtgggaggctggagtcgcttgaacccaggaggcgaagattgcagtaagccgagattgcgccactgcactgtagcctggggaacagagcaagactccatctcaaaaaaaaaataggcaaaactaatttacccaaaataaactggtaatatttccctttttcaaacttggttgattaaaaacctccaaagcactttaaaataggagggaaagaaatagacttatgatctaaaaatatgcaaaataccaagagcttatgttttagctatggtttgggtcaggcaacctccctaggtgttttgtaaccctcaaccacactttcctttaggtactaggatgctatctagccggaacctaacacaactaataataattttttaaacaacattgtagcctttaatctgatttaaggttgttttttcagttcttccttgaggttgctaataattaagaaccctacctagtgatgcataaccctactgagctcatgagcaggcaaggtagctataggaatttaaagttgacgtttctttcaaccaagttgacagagacaacctctttgtattaatatatgaaatgaacacatttatatattaataccaaaagtcatcactatcaagatagcctatttttaaaaatgatcaaaaattaagatattcatagaacaaatatttattaagcacctactcagcaccagggacaattctaggtacaaagagtgctaacaagacagaccaggttcctgccctcttggagcttacattctagtgaaagtagacagtcaataaatactcatgtaaattaacaaatacactagataagttcagatcattttaagagctacaaagaatataaagcaaggtaattatatagtcactaggagtgtgtcatgggagagactagttgaaataggccagaaagacctgacaggtcacatttgagcagtgatctgactggcaagaagccagccataaagaatcttaggaaaagagaattctaaggagagagagaaaagttcacataaaggctgtaatatgagaaggaactcaatatgttagagaagaccacaaagtgagtatgactgaagcacagtaaataacagagagggtaataagagataaagctggagaggtagaaagaacgtgcaccctgattttcttaaggtagtcctgaacaatgcctgttgtcctggtgtaaataatagcacctcctttcactctcaaagtatgctttttggacaataaattatacaatctttctgtggagagatatggaggagccaaattatttggatatagatagcagatgaataaaaactttagaaactagatagcaagtggatttcttcttcttccattggtccttcctattttcatctgagttggaggcacttgtttttattttacatttgtctggcgcatgcagtaggataaatgagatacagatatgtaaataagacccggttttccacagagaacatccagggcagaggttttggggtttagatctgtgtaagactaggggtctctagtcttacactgtgactggagcagcccaggatacttatgccaaaacaagtaattaacactaaaaaagaagaggaggaagaaaaagaagaaggaggcaaagggagacagcctcttgtttcatgccatacaataaccattattcatttctattactccatgtttaatcttcatgtaagagaggttctatagcttgattggagtcatacaggtagtgagaattaaggctgggatttaaatctaactctgtctcaccctttccctcaggttatcctgcccacctcaggctttccagtggtattctcttactacttaatctctgaacataacatgctctttcacatctctttgtatctatcattcctgcctggcagtccctattcatccactgcaaaggttgcttctcatgtgaagcttctctcaattcccacaaatgtgtttgattgtcttctctgtccttccataatagccacatgaatctctgctgcaatgttttattcattcatcatccattcattcatctattcaactgttaaatactggacatataaaagcctacaggacagacatagtactcatcctcagaggagattatgactagagaggattaattagcaaagtaaccaatatctttaagaaatttctttattaaatctcttttgactcatttgttcattcatttggccattcgacaagtgcgtactatgctgacagaggcctgataaactattgacacattttggaaaatgcaaatttactcatgttttaagtctgggagcatgaagtgggagaagtaagagatgaaactgaagagaaaggcataaacaagatcatggtgacccctatgggtcttacaaaagaactgggactttctcttcaggcatcagtaaggcattgaatgcctgaaatggtcagatatttattctagtaaaattactatggaggcaatgtcaagactaaatttgaagggtacaggctacaaacaggaagactacttagtttttgcaaaaaaaaaaaaagtttctgaagtgaggtggaataaatgaaatggagaacagaagaggaattcatggttagaaattagaatttctgattaattagaactaggggaagaaatggagcaacataggctgactcataaatttcagactgtggatttcaaactcatgacgctttgctgaattactgagacagagatgaggtcctgcccattgtatcctccattgccttatgcttctctgcaagatgagtaagctcatttcttctgacacctacttggtgtttttgttgattgactttgggtaaaagtggcaactgaagagaatattggatttggaatcaggagatgaggctttggaacaagatctgccacagatattttctacacacttagagaaagcttgtgtcttccctagacctgtttctcatctggaaaaggaaagagtttatctaagctaggatattttggttccctctcagttcagtgattctaggattctgcttggcagcagttgctttgtggttgaatgcagttctcaaaagccaaacatgcgttttgtacaagcaacctaactttagcagcaaggaagccatttactgggatttgacttcacattttctttgtacttctcatgcatctggtaatttccattgacttcaagtttcgaagcttgtcctgacacccattctattctcctgcaagtcataactgacccgtaggttctgggtaaatcctatcctatgtctttctttgatccccccccaccctgatctttatatttctatcaaaaagtcagcagagttcagttaacagataactttttctctacccctgagaatgattatatatgggccaaaatacagcacttttagccctatcatcacatgaaacactccttcctgacccactgtgttctttcacaaaagctaagctcctttctgcaccatggtttcagaagtgtctgccccctaatattttaaactgtgctttctcagatgagtcaccaatttaactcttgccttcatctttcttattcagattttagctaatattccagctgaaaattctttgagcgtattcaagttagtcctttcaaaaaagcaatcaaatacagtccatagaattttacaagtagtttaataaaggtgtccatacaccctgggatccttgccagtcactggctccagctgaatactcagggattttcctttgtttgtttctcttctgcccattcattttccatgctgtaatctttgggttggatgtggaaaagagccttgccacttatggaagacttcgttatttcatgaaaactaagctatcaaactttgttttttgagatagggtctcactctgtcccccagcctggagtgtagtgctgtgatcacggctcactgcagcctccacctcctgggctcaagcaatcctccttcctcagcctcccaagtagctggaactacaggcacacaccaccatgcccagctaatctttccttcttgctttcttacccttctttccttccttcctctcttttcttttctcttcttttctatgtattttttgtagagacagggtttcaccatgttacccaggctggtctcaagcttctggactcaagcaatccacctgccctgcctcccaaagtgctgggattacaggcatgagccaccatgcccagcctattaaactttttgtaggagatggccaagagctgaacctcttccttctggattgcaggtactgggaaggtagaaatgcaggctggttgctggtcacctcccaacccgggagggaagcagaggaggaattcagattcctaaagtcaggagaaaataagaataaaagggcatccatcattagcttaaaatacaagggactacctacctctgaataatttgaaggttaaatcattgaagacagtccataaaataattgaaataacacaatagtgggagttaggaaacctggttgtttttctaagtgtagttcgacctttgtcactctagactacttactctctttggacctcaaccttctcaaccttatatagggaaaattaagtagatttcacaaatatctttttttttattttttttatttttttttgagatggagtctcacactgtcgcccaggctggagtgcagtggcatgatttctgctcactgcaacctccgcctcccaggttcaagcgattctcctgcctcagactcccgagtagctggaattagaggcatgcgccaccatgcccggctaattttttgtatttttagtagagacggggtttcaccatgttggccaggctggtctcgaactcctgaccttgtgatctgcctgcctcggcctcccaaagtgctgggattataggcatgagccactgcgcccggcccgatttcacaaatatctttacaagttctcatatgttaatatataagttaatatgataacctataagagatctctatttaacattcacttgttaccatagaaacttgtaaattataggaatatgcttatcattccattattataacttaaaaataaatttttttgcatattatttgtccctctcattgggtcattggtttgtataggaaataagccatttctttttcatctccatatcctgatacttaacatggtttctgcatatagtccacactttttattcatttgtaagcagcaagagaggaaaacaattgtcttcattttttgcagtaactagttgtaattatagagtgtgtttaattttgcatctctgctttctccacttagcgtatcataagtaatttgccatgtttcaacattgcattcacaattttatgttccactcagttaatgtgccatgatttactatccatttccctagtgggaaatggttatagtgctagagtttctactattattaaaatgaaaatgcaataaatatgtgtctgtatgtaactttttcctcttgggttatttctttaagataccttcccctggaatcaaaagtttatatttaattatttatttctagtgttttctggtgggttatattaacatgcagttttgctgtatttgattatttgtaggtgtaaacttggccattgatatttaatattttgttcatattctattgatgttcattgctcagcctgccagcataatcctcttcccatttatttttaagcaatgttaatacttaaaagacacgtatgttgaatatatagtcccatgttgttatttttactttttctgtttttttagattccctaaactgtgaatctttatgtagttatatctatcagtcttatcttttatagtttctgtctttgcttttatttagagagtccatcttgaccttaataatcaggttaaacatacttctatcagtttactatttgtgtttactcttttctattcatactctttaatcatttctgtcttctgtctctgatggtttccttaataactggtatttgctttagatacaaatacagtcatgcatcacttaatgacagaaacatgttctgagaaatgtatcattgtgcaaacatcatagagagtccttacacatacctagacggcatagcctactacacacctgcctataggctacaagcctgtacagcaggttactgtactgagtactgtaggcaattgtaacacaatagtatttgtatatttaaatatatctaaacatggaaaatgtacagtaaaaatatattatacttttatgggaccaccatcatatatatagtccattgttgagtgaaccgtcactctgaggcacatgacattatatacacatacatagctattaaccttttgtctatattttcagtttctgatagttttctttgatagtttttgtattgaacttttgattccaaatgttaatgattttttaaaagatggcatatggtatggttcttactttttttattgaactgctatcaagaggtgattatgtcacttataaattatatttcctctatttcccccttgttctgaaaagcttccttgatcatatattaagtgagtctgtatagctggatctatttctagactctccattctgttatgctgatctatatgtctatttttgtgcccataaattctgcatgtatttgaggagacctcaaatgtcctctcttgagtctttgtttctccaggctaaacattccctgttctttcaatggctacccttctatttagcatccaagtcctctcccatctgccctggggaccaggggcaggcaactgtgagataactgaccaagcctcaggggaccccagagttccctcacttggggaaaaaaatgttacataaaggcagcacccaggtgaaaaagggagactgatgagctcttatgtggaaataacggtttttgtcacagaaaagtacttttttgtttctcatctctaatctgacagaatagtttacaatggctaagggtctgtcagggttcaaatcccaactctaccattttcttgttgtgtaaccttctcggtaagcctcattcacctcaactgtaatatgactatataatggtatctacttcataaaacggttgtaaagaagaagtgaggtaatccatgaacacatagtgagcacttgatcatataagctgttgttattactgctaaaatatcggtcatatagatttattattttatttaacattttgaggtagttattaatatacacaatttaatgttgaatgaacaggataagaaaaactcagtaaatttcccttcccagctagtagatgtgcttcagcaagtatctcaccttgtttgtctaatgagaaggcccgggtctttgctgtagacaacacaactccactgtgtgatggaaggcactgataactggctctttggattctgccatggttactaggtgaagctctaaattcttagacaaaggtaaatgtgaggttcaaacataggattgttttgaggttttcttttggtttcaacatggagggacattaggttaatggggagactcaatatggtttcatccttatttgcagattagctgatgtggaaacatgtcccttcaaactgagtatcacttcacataactactccaagtgaaagtgacacaggcccagaagcatttgtcatccccacagggtgccagaggaagcggcacttcctctccttcagcacatgctacctgtgctctcagaaggcccacggctgggagggaggcaggtggaggaggccatacaacttgccaagtcaaacacaccggaaggtctaattttagtccccctagccttggcattgtctctttcagcaaagatatttttcatgcactacaataaagtgctttgttccagccttgctggatacttcacaaaggcccagcaaggacagcataagcctaaatcagagctggaaacacatcaaacacagggacctcacagaagagggtcagcattcctctcgtaacctttggtaaatacgttctttccatccagcttccaaaaccctaagaaggaacacttggttgtgcttctccttctacgcaactcctcttcctccagcttcttttttgtgaatcttctgttggctcctcatcaacaagtgtgttttctccttcatgccagggatttgaaaacctactccctctttttgtccctgcctaacaaagcccccttctttctttctttctttttttttatttttttttttgagacggagtctcgctctgtcgcccaagctggagtgcagtggtgcaatcttggctcactgcaagctccgcctcccgggttcatgccattctcctgcctcagcctcctgagtagctgggactacaggtgcccgccaccacgcccggctaattttttgtgtttttagtagggacggggtttcactgtgttatccaggatagtgtcgatctcctgacctcgtgatccgcccgcctcggcctcccaaagtgctgggattacaggcgtgagccaccgcgcctggccacaaagcccacttctttctatatagtctaggtcttgttttcttttctgacattgcctggaaagtgcactagattaagagtgagaaacaattttacaatttgcaaactggctccagggtttgttcttacaatgacctggcaaattcgttgaggcagaaactttcacagaacttgtatagatgagaaaactgaagtgcaaagaggacacagacttttgcaaaggtcacacaggaaaacactggcaaagctgaaactgaaacctagctctggtgctttaggaaaggtgtggtccaatgaacttatcaaagcaccgaaaacccacacaggcatttgggagggccctgggatgaaagaatcctggaaaaggacctcctgtggtgctttcagttagagccactccctttacaaacaatgaattaacagcagtcttttaggattcacaggtagatcaaagacctttagttcttaggctcattctatttagctctgggtgatgaatatggaggagaagctcaggagaaccctgaggtgacatctcagcaccttggagaagttgtgatcgggagacacagtgctgggagtcagagtccctgaccatcagaatctgctatgtcaccaaacctctctgaggctcagttttgtcttctgtaagattgatgctaacaatgccaaggtttatgtaagatgtgagataggagagagctttgtaaatgctaaagcactatccactgttcattacaatgactcatattcaaattcaaaaaatagaaaattcagagcttccatagatcaccacttctgggtgcctatggttgggtctagagttgtccagtgaagtccagaaaggaatctacccaaaggacaaagtaaagatccgagaagccttggggaacattaacatctctggtcaaccttatctgctgcgtttccaggaaataaggaaatgatttctctgaaggtaaaacccaccattctgggacctcaacctgaaactgttgaccacaaaaccagctaatatcctcaggaagttttccaagcctcccaaaggcctgtgtgagttttctgtgctttgacaggttcatgggaccacacctttccctaaagcatcagagctaggtttcagtccaaactctgccagtgttttcccgtgtgacttttgcaaaagtctgtgtcctctttgaacttcagttttctcatctatacaagttctatgaaagtttctgcctcacctaattcaccagttcattgtaagaacaaaccctggaggcagtttgcaaattgtaaaagtgtttctcactattaatctagtgcattttccaggccgtgtcaggaaagaaaacgaaactcagactttatagaaagaagtgagctttgttaggattttattagtttggtgaatgaaatacattttgtgcatttatttgtttgctgaaataaaaacatttgcacattgttctgcttataaatgttatatgctcattataaagagttcagaaagatattaaggagagagtgaaatgccaccattataccaccagcagttataatcactgttaagattttgatataaattatgaactgaccaaacttcctgtgcacacaagctcaagcaagtgtgtgtataaagcaaaagtaagtggtgctacacttactgttttgtgacctgcatttttgacttaacaatttattacaatattatctctccttttttctttcatttttattcctaaagtgctgcttatgttaatcgtattcctcagatcatggttcaatatcaacattttttatataaagcccttcttgtgttttctcatatagttttaatttccctttatttgctatgctcccattcccttcctccattatattgtatttaatatatgtcctcaggtaagggtttatccttgaaaatatacagagtttatttgtacatttgtgtgttttcacttaaataaatgacattgagtcaatacccacccatatccatcaatgtagatatacattatcacttttaatggcttcataatttccattcattgctctaaagaaatttatttagccagtttcctgtgatggacctttaggtagtttttaaaagaggtttttaaaaatgattttaaacaatgctgaagtaaacaccctttgtatatatgtcttaacaggcttgtgtcattatttccttgagataatttcgagagaccactttataaaatattccttacccaatctctcaaagaagctttgttgctggtttcctagaaagaagcgtgttctctctctcttcctcatgacactgcttttctctccctaacagcacttagtacagtcatctttaagcttcgtttcatacgttctctcttatcgctcaactgataagctcttgctgttaatgggagggattacatagtaattaattaattcaacaacatttcctgggtatctgttcagcagtgggctctgaactagtgctgaggtgaagtggacaatcacccacccttgaggaacccccatctgtgagatgggagacatggattacagatactactgtggcaggtgatgcagcaacagcagttgtgtaatttgcaaaagaagaagtagccgtacagtgaagtcactgaaaatgaggtacctcctctacatcttgaaatatcagtgggagttcactagagaaccaacgtgtagctaatgagaactgccctcagagcaaaaggagcagcaaaaggaaacacagagaggtttggcatgatattaggaagttgtagcataggtgagaacatggggagagaggaaactaaagaggtgccaggaggggtgaggggaaggaggaaggtgggaggctggagggaaagtgtaggcccaagtgagcaggtctgggaagccatgctcacagttggaattcagagtgaggataatgagagaccactgaagggtttaagcagggcagtgacatgattgggttttgtgttttagaaaggtcattccagctatgatagtatggaagatggaattcaggagggtaagactttagatggagaagcaagttaggaagctattgtactactcaaagtgataggataatggcttgaaccaaagtagtggcaacagagaaaagtagatggaatcaagagttagaaagtagaatctaccaacttcttaacttgttgataggtttacatacagaaacacgaaatagagaagttcagaatgatgcccagactctgcatggaaccttgtgaagatggcgggccacttactcggagaggaacaaagaataaaaggatgttttaggggaaaaaggaggacaaattcatgtttgcatagtatgttgagtttgatgtggtggtagaatacaatggtggaaatgtctagcaggcagatgaatacattatctagtattcccaaatttttctttaggacctcccctaaagacctggaaagacctgtcctaaagaaaaatttgggaatcatatgataatactgagtaaaagtttgctgaataaatgaatgaattgactcattttcagcatcatgtttccttcaactagaacattttacttctataaagccaccttcatacgagaatttcaaagttgtttttaagactaaccaacatgaattaaagtatctttttagaattactgtagagataacaacttaggaacatggtgagtgcaaatggctctcagagaggaaagagtaccagcctaagagtcagaagatgagtgagttggaacttgtctactattggtggacactggtacatgccactcaccccctccaccaaatattcaagttctctgaatgcaaagacaggggttgcattcctgatgatcaatgcctaaccctgtgacagggaatgtgcaggtgaagcgggacactccaggtctgctcttctctctcggcagctccctgctgttctcagataagggccacagtccctccccactgggacttggcagcacaacctagaacacaatctgttggacagaaggctgtgattattaatgaaagcatttcctctgttacctcacagaactaagtgaggttctaacactgccaaagatggcccatttcctttcatagaaaccaattctcagaaacacataggatggtcagagacagtacacatagggaagtaaaaataaggtgcagaaaagtgggtggctgcttgaaacactcccagatgaaaggttaccagctattaatcagctcacacttctgttcagtgggtgagcaagaaattggatggaaacttcactcaatggttgatgcttagttggggctgtgaggtcctcagatgactttcctcagtcaggtcggatatgatgcacttttatgtaaaggaaggagagtcaacaaggccacagcaaaattccctatgtttcacaatttgtgtacgtctgtttacatgtgccaggctcggtgccatgtattgaggttaggatgactcctgctgtctaggcctgaatcttgaacagtccccctctccatcatttggagcagcccagttggctgggtcctgtgatgaggataataatagttactgttttttggacacctgcctcatggaaggcactgttggaaaaaagtcagcattatctcatttatcctcacaacaaccctttgagcaaataacattattttatttgaaaaatggggagattggggttccagtgggctaagtaacttatcaaaattcacgcaccttgtattaagcaggagcatcatttgaccctaagactgactccagcacacactttttttccctactacgctaagtccagatgaaaataaaagagacatcagaacctgacaaaaagaaggaaacccacaaaaagggatacaagggaaactgagtctgagtagaaacttttccaaagtcatagaatagcacctgggtatcaagtatggcttgggtctaagtcatgtttcccaggcactcaggaaatgttctttgtgccttggaaaggaggcagatggcagttgcatctgacccccaagggtcagatgccatttgattatgccattttgaccctttgcagatcagagcccctggacatctggcccccaagtttctaagtgggttttagcttgagaccacctagtgaaagccaaagaccaatgtccgctgccagcacccagcccagagtcagggatataccatttggccaaggctccagagccacttcaggctctcagcacctgccctgtaaaaagacagctcaggtggaaacttcactgggagcagctggggcaggcctaaggagggagtccactcgtcacaccctactcacatgagaagacatgattctgaagggcttaggaccttcagcctgtctcagtacccaaggatcacaggcctgggcactgcagcaggcatcagtcttatcgttgagacttggtagctagggcatggctaggccctaacatactaactcgctatgttttctggcataagtcccctagcctccttgggcctcctctagaaaacaaaggggttggatcagatgattgatccctggggcccacttctgctttcaccttcaggtgtttactatactttggcaaacagaactcttgttactcgccctaacattgccactgccactgctgtcaaaatattttccctcacttattatagattaaaaaaatatgtttgccttatcttgagtccccagggattcagtctgtgccccctcctgtttcatgcttatggggtgaaacctcaactataattccaggagattcaggttttgaggtaatgtcatcagaggatgctgtaagaagggatttctgttctttccagaagctgcttttgtccccagacacatcatgaaatgccagcttgtggtccacaccctccctgcccgctgggaaatgctgctgggggcttgtgagtacttggcttctggaggacaaagaagaggggaacagaaagaggcatagtgtcagatatttgccttcattataaaaaaaaaaaaaacatacaatatgctgggcaattttaaggcatggttttcaaggctgtttttaacagtctctggaaaccagcaatccggtgtcagttgtttataggatccaagggggtggtgctgggggttgtttcaacatccttgcacagagagaaacatgggtagtggcttacaagctttgagtgttagacacagggacagcatgctgtgggggtggggagtgggggacacccatccaggtggggggatgggcttctcatcccagctctgccatcagctgcccatgtgatctgggaaaattcatcaccttcctgagcctcaaactctccaacctaaaaccaaagggcttaaagcagaggagcctacaggcaaatcttttcaagctttggtcttcccttgtgtgatcttggaattctttttttcttttttttttttttgaggcagagtttcactcttgtcacccaggctggagtacaatggtgcgatcttggctcactgcaaccttctccacctccctggttcaagcaattctcctgtctcagcctcccgagtagctgggattacaggtgcccaccaccacacctggctaatttttatattttcagtagagacagggtttcaccatgttggccaggctggtctcaaactcctgacctcaggtgatctgcccacctcagcctcccaaagcgctgggattacaggcataagccactgcacccggccaattttggaattcttaatgctagtccccagtacaaggatcttgaaagcacatcaggaatgccagatggggttagtgaggaatcagggagaccttgggttatgtctgtgctggtttggggtgtgcttcttagatcatgtacttcgatttttatttatgctttccagcagcatttcccaagttgactcatgatcatattcccctgagttgctttttaaatgtacagatttccctgcaagggatcaacccactaagctgtatttttaaggaagaaccaagggtgattcttgtattcagacaagtttaggaaagactgcttaagaggtttcacctggggaccggtgacaggtgaaggtgcctgatttggtcagtatttgtctgtttgtctatcctctgtgttatgtagctctctactatgagtattcatttcatcatgcttcatattccaagacttgtaaatgtctcctgcatccaggtctgagccctttaagattggtaccatgctttctgtttatatcccaccttacctagcacagagcttttctcctggaagattcttacaaacatctgccaaacttagttgtgcagagagttttctgcctgattccgtcaagttaattatgccatgggtcattattaaccacaatatcaaatacaaggaaaagagaggagtagtaacagttggcagagaagtatcatggagaaaacaggattggaatggagtcttgcagcaggagtaaggtttagatagatggaggaaaaaagcacaaggggcattccaggcagaagtctaagcatgagaaggccagtctctacaaaggcaattgtttcaggatatgagtgaagagcctagggctcaaagaaaagatttattcaagactgacctaagtaatctgtcactgaccagcccattgcagcctctttccatacttgcattacatgcaggtctccaacctgagcccctaaagccctttcttcctttgctctcagccctatttccaaggttgttttcccactgctgtgtttatcctgctatgtatttgcacatgtggtgggactgctccatttcagccactcagtttttatttaaatgaatcttgctaagattcagctaggctgattgctagattacctgggaggagctggatatgcagttctgtgtgcctcttcatactcagcagaccctggtatgttctggaagactggatttagatacagtaggtaagagacaggctgagggcaacacacacacacacacacacacacacacacacacacacacacacacatatattttgtttcaatcctctttaatacccaaagggcttatggaaaaaagatgctcatgggtgcttcttggctcccttgtaggccctttccacatccacgaagttctcctggtcctcttctaggagcattcttaaatcctctgcctcttctgctctggaacctgctatcaagacagggtaggaaatggatgagagatgagcgaaactcaagacaggaagaccagttgggaggtagttgcagtatctttgagatgatcctgcaggtgagagaagatgatggcctctattaggaaagcagtggggtgcgagagaactgcatgcattctttactaagcccttactagctggtttagctagggtaaattacttaatctctctggccttcaaagttctcatcagtaaaaaggaaacaatcataatctcttttttacagtttttaaaaatactgtttttaatgctgtaaaaaaggggtcaatagtttatatgggtcaatgttgttgcacaaaagccttttgtaaattagtgtacaaaagtgccatcttctctggacatcatttgccattaagtgaaactgtgctttcctccacaagggctctatcatttgaagttctcttgtccatcaaagcccttccaccagtcctgttttgtgcctagcactgaacttctctgtatgacaacacaagcagtgagaaattcttttggtttggggatgggctggctttaatattatagcttgaaatcccagcttaaaagtaatacactccggtttctgtcccctcccttcttcggtaataaacacttaaatgctgatgggttctcaggtcaagaatccacagagcctgcatgtgttgagacaagccaataggaggtctgactcatattttcatatttacaaaacctatgtgggaaatcagtgaatggtagagttggaaaggccttaaagatcatctggtccaactcctcattttttaaatggggaaatggagtaactaggaaggaaaggatcttggccaagatcacagagtaagttagagacagagccagcctgcttccccctcatatggtgtagcggaatctctttattgggaatgtgataaaatgtactgtttgtactctttctgttatgctggtcccataatgaaagatactgcttggcccatatcactgcagcccagagcaaaaggactataggtggagagtattaatctaactacactttcattcatttatcacacattactaaacaccacctttatgtcagttactgaagatactgagataaaagacatgggtcccacctgcaaggtattcaattttaatgatgaagacaatctccaggagggctgaatattttccatgcagttaaatgaaatatttctcccatctgccaactgcattttatatttatacttgtgaatgcattgactctccttatatatagattatgagacattttctcagaaaaaaaataccaaatatctcagaccccttatttattcatgtcctcaagaaatattatttgagcacctaataggagttaccaagaggcaaaaataaataaataatagtcctctctctcaagaaaccataataacaatccagtagagaaatacataatgatcatggaagcttttacaaggaaagggagatacctaagagaatgggtgcctaagtttgccatggagagtccacgaaggtttcatggaggaggtggtgtgtaaattgagactatttaaagaaggggaagaagtctgttgagcagaaaatggggggaagtcattctaggagaagagaacagcatatgcagagccatggaagtgtggaagcatgcaatcctggaatctataatagtttataatcactgacacatgagaaaagacagattggcagaaaacgaggatataagtaggcaggacctgagccacgctaaggagatgaggttgcatcatggagactaaggagaagtacagaggcttttagagagtagatcaatgaggtttgtattctggaaattcactcaggcagctgtgcagaaggagagtggttggagtcaggtagcccagtggggaggccaatctttaatcaaggcaagatctgatgaggcctatgagggcagtggcaatgccattctgagccaggccagaacctgactttctgtgtgattcaaccattgcccaacacacctgagtgatggtgcagacccatacaagaagcatgaagttatgcacttgagtctccaaactgtgattcacagtcctgacaatatttcctgtgtgtgtaagagaccaccctctccaaagtcaactggaacagtttaagacatcacaagtgacccatggagaagccaagcttccttgcctaacaaagaagctgatacgttgttgaacttctaaaggcacttgggggaggtggtttttaatacaaagtcacttctgagcttgtggtttggtaaatttaagtcttttccaaacaaggcagccaggctggcaaagtgatcctttttcatcccctctaggcactgattcagttctctgaagcctccctgctttcgctcttcctgttccttctcctgaaatgtctttcatccaccagtctatgattggacattggagtcctatagatccaggttcaaattctagctccgccatgcattaattgtatgctcttatacaagttaccataagcgttctgagccccagggagctcccctaatcctgattgctcggtgattgctgagcaggagatgaaatttgtgaggtgttccattaagtgccttctccatcgccagcactcaatattaaatagctatttttcttaggtgagattctagtttaagaatgaaggtttgtaattctctaccaaaaaaccaaagtaaagtactgaaaggtttcacaataatacatcttttgattttcaggataaccatgaattagagttttcttactcacattaattaaacctgacacctgagtacccacttgatttccacacccagctgtggaattccacagtaacttataattaatagacagttgcttataagagatttggaacttgaattcagagcaaaaataagtagagaagccccatgacaaagggaagagttgctgatactgggcccttttctcatgctgacgagtttggagggtaaatggccatcttaatggtatcatctgactgcattttgtgctgccgagattgtgctgagtggaaatttccctggaagtagcaagagtggcttagtttcattacagtgaaagaattggccaatgttggggcaggttactgacaatgggtgtggaatctgttttaggagaagttaaaaaatcatgacaataaagtatgtgatgagattaccccttccaggctattgcaagtgtagacatgcctgcagcttgaaagagagtttgtctcaagcacagtgaaggactaggttcacttggttaattcttcaaccctaactcagtatcttttaactgaatttgaaagatcatctggcactttccagattctggaaattttccaattttcaagtttaacttgactttttaaatcaatctggggttaatttatgtgttaattcttttattattattattagcaatagtcttattattatttattataaagcaactttaaagggaaaattttaaaattatctttaattttcctgcagttattttaattttggaattttttttggcctttgtttacctacttacttgttaatcagccatcacaatgaatctgaaagagcttcattattatgtctgctttattaatgaataagttgaagataatgcagttaattaacgttgccctaagtaacacatgtagtaattggccaaatcaggaagaaaaatcaggaattatctcaagcctgctctgtctccctactccctgctgtgatgttggccacacaacctggtgcttaatggatataggtaacattatcttatgcactattactttaactcaaaatcagaaataatagcagtctggaataatatcaacaaaaactccccaaccaatccctagaagaaaaccattaagattttgtcaactctgaagacaatgttgtacgaactttctaattatgagaggagaaatagagaattagtgtgactaatagaaatagctgtttttattggggaaaaaagctccaacttgaaccagaccaactgagactccttaatattgctgattggatattccaagccacttactgatcatttagttataaagtcttctcattgttcttgtcagtaatcccactgagtatcccattaaactaaatgtagagttaaacacctgggaggcaagtgttaataaagtgtaatttgtagaaggaaaagaaaaacaacttctatatgcttactatgaatagcataaaaagggatggttgccttccatttgggagtcaacaccatatgaaagatgacacaatgaggtaaagagtgaatgctacagcccttggaactgtcagaagagtctatttcactcatatatttttctagaataccaagtagaaggaggcagacttgggaagatatgcatcagccacactggagggagttccgaccatgggactgctcagaactctagcttggctcctaaccaagtttgaaatgatcacagccacagcgctaattgaattaatttgcttttcttcaggcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaaggtaagttgtttttcaaccttgtttttattccttaggccagaaactatggccttcatgaaattgtaccctcacatggaattataactctaagtagctagtttgtttcaactctggctgttttccatccagaaagaaaaattaacatttaaaaatgcaaatgtatatatgttgttcccaaaataagcaatttctgaacaaaaagagtaattgttaaatcaaagcactgaatagagctcaaggaatgacagcatctggtgaaagaaccataaaaagctcagagaagagtgtttgctgataattattgacagtttgctaattacagcattatttggcctgttaaaggtatatgtacttctcccagttaaagaaaaagtacacaagagggctttttctctctctctctctttttttttttttttttttttttttttttttttttttttaccagaaaagatactcctgtatccagataagaacccagattcccacaacagaacatttagaaaaggggtgggggagtgtagcgtatctctggtcagcaatgtctacaacatagacaataactcaacactgtacactactcagaagctaaactttccctgaacattacacagaacagtcccataaaaggtacaatttctactgcagtggtattgttttggcttgtctgagtctacaagttgtattggttctagattgggctgatctaagacattccacttcgtgtatacttatgtaatgttacacaagtgaaagaaatacatttttaaaactttttctgattaaaataccaaatagaaaaatattgctttatatcatttaattagcaaatgttgatttgagcaatattgaatcacccagatgtatatatgtgtatgtgaaatgattgaataaaatattaagcattatcattatgtgctgaagctgaacattttctataacctatgatccagcaattccattcttgtactgtacaagaaggggcatgtgtaagaatactcatagctgcactattcacaatggtaaaactgggaaacaacccaagtgcccatcaaagggaaagtggaaaataaacagtggtatatttgaacaatataacattatatagcagtcaaaatacttgaactgtaacaacactaagatattaaaaaagcaagtctcaaaagattctaaaggaaatagaaatttttaaaaatgtgttttataggattaccaataaatgcaataaaatcatataaaaagaaaagcagggaagtgatgaacccaagattcaaacgaaaagttacttcaagtggggaagaccaagggatgaaattgggggtatggccatgtggttagatatatattgtgttcaaagtcataactgttgcaagtgtttattgcatcattaaaagctcactaatcaacagaataagtagtgtgcattttatacgatcactgtgacatttctaagaagatctgggtaatcaattattagcatgccaagatcttttctatagaagtgctgagaaagtgcatctattactcaattgatgtctattgcttttgcagagaagtgggatagtatgtatttcctagataaccatactactctccctagttttcaatgtcatgtcttctattttatcacctaggggctagtccatgccttggaactctctctattctcaaccacaaagaaagtacagacaaacaaggtttttcaaagtcactttcatatcactaaaggccatgcaagctgtcaccctatgattaagagagcaccgtgtgccacgttcctcactatttgtttaaaatgagaggggtattgcctttgaagaaatagttgaaatgcaggaaatgaggtattttatttacacactggaagtatgtagcactgaaaaagcaccagcctcaaggtgaggggtcatgtaaacattaagcatgccttggcgttttatggtacaactgatatatatgcaccaaaatcatctcccacctccccatctcactcctagagtgggttttttattccaggaggggaatatatgactttctgaacttaggtctatatttttggcaaactcttattccaactctgcctgtactcttatatcaaatagaaagcaggcagtctttttctccttctagagttgtccaaggacagaaaaaaaccgcagcagaaatatgccacgtacacagaaaaaagaaaggcggatctgataagctggaaaggagaagcctggaaaaagatgtggattatgtaataggcccagaagatgggctgatgagaaaaagcttcttttaatgtttctggaaaaaaatgcaaatattcagcaagacacggtcattatcctggtgaatgggcacattcagtgattccttctatctttggtgcagagattgaggcatcttgggatgcaactgagggagcaaagctgactgcagcctctgccctcctgtgtgtgcagtcaacctggcacatcccctcttgctaccagacccgtttccctttccaggaggaagtcaactcggttgctaaaaaacaagttctgatgagtgtttaaggaggagcaggataatgggagtggctccgctgcaaggccaggggccacagtctcccaactttaaaagcccttgcattccaaatgtgaaggaactccttcagcagatatatttttaaaagcatttaaaactgaggtttagagaaatgaggcaatttgcccagcaacacaaactgaatgtggaacagacttcaaagacaggaatgctgactcccactgcagcacatagctctgcctctcagccaaactcccagggcagctcctcattaacaccctccagcccatccaccatacagctgctggagtgagatttgtaaaacacagatctgaacatggtccctcccagctagatgcaggcttcactctttagtcatgaagacacagtcacctcatttcaatcaatgttaagacccagcggctagcacagggcctgccacggagcaagtgtgggtaagcatttcttgcctgaatgtaataagtgctggctgtacatctccttcttaggcagccttgtgatggaggcatataaaagtgactatgggacagtcctgcctgccctcccgaatttcacaggcaagttgggaagatgtgattcaccacaatgtaatgtgtaatgacagaaatgtttggtggtagggcaagagtagaaagcagagaggttgatttcaaaatggaatattaaaacaagaagttaattaatgcagtgatgagaggaagacttttctattaaccttttagaaaacaaaattgtcccctagcagatagctctttcccttttcaagcttgctgcctgttatcagctgaataatattcccccaaattcatatgttgaagtcctaacacccagtacctcagaatgggactgtatttgcagacagatcctttacagaggtaataaagttaaatgaggtcatgagagtgggccctaatccagtgtgacgtgtctttaggagaggaaatttggacacagagacatacataggaaaggccacgggaaggcacagggagaagatggctgtcatctaccagccagggagagaagctacatttattggtaatcctataaagtgcattctttaaaatttgtatttactttagaatcttttgagacttgcttttttaatgtcttattgttgctacagttcaagtattttgactgctgtataacgttatattgttcaaatataccactgtttattttccactttccctttgatgggcactacttgggttgtcaacacattctcttggacttccagcttccagaactgtgagaaaataaatatcttgatttaagccccccagtctgtggtgctttgttatggcagcctgagcaaatgaatataattcttattccttctctgttgtcacatgcgttctctgtgccctctacatctgatagaaagatgccttctgtcccagatgtctggaactccctggacacgtagggatttctgtgtgtctggccacagaagtcatagcagatgtttcatcatccccaccacagcactgctgctgataggttgggaagaaagcgtttgaattttgtcaccaagaaccaagtacctgatcaccccccaagggaatttcctattttcaacaatcattttgattgccaatccatcacaaattaagatgggcagtttgcaattttaactgtattttcacagaattggccacggtttaatgagaaaatcaacccaggggaagagcaagcaagtgtgtagggaagaagtgtctccatcccagggtcctctaccttggagagttggtgccattgctattttgcttagccactgtgacatcaaagccaaagaaatcaagaaacaaacctagaggaatcctgcaaagagccctaagtggattttaatttatgtttagagtttgactttcaagattattttcatcaggaaacatttgggttggtttaggttcagttgaaaaggcagtcacagagttgtttaaaaaaaatgggatttggaatctgacagatgtgagagtcattcctagctgtgttacatttaccaaatctctgccagtttgaatttgtttccctgtctataaggtggaaataataagacccgttttatcacctcacatagcggagtcttaaaggaaagaagggaaatgaaaactatttatgacatatcaaaagttgtgtttgctgtcctgattgacgatcctctcatttacacttacacagccaggatgaaaataagtttcatttcacaggccacgtacgatggcagcaccaaatggtgcacagaggagggtgagagactctatgaaatttcaacaggaaaatgtgccctagtcaaatagtgatgtctaccgtgtattcttgtgggtttgggggcagtggtcatggcaggacatactatgaggcagtgtcatccctattcccatcctggattcttagacaccgaactctgtgtcccctaagcacaaacccttccccagctcccgctgccagataggatgaagatggcacttaaggccttctttaccatttcctaccaatctctcaatgtcctgaccctcatgcccctcctccagaaaggagacttccttcctcaattctactgcttattattttgcagatgaggggagaggtcctcagaggccactgagtacccaagggttgttctattgggctctggcccacctctcctgagcctcagcttgtgccattgctccaaattttcttcttagaaaagtcttaggccactgacaggtgcacctgagacaggtgagagagccctagagtccaatttgatcatcattgatttaacagtttgaattttaataaaatatatttgcatataacaagagttcctaccaagtcattccctgtccctctaggtggtcatttcctgaggagtttctgtattttgctcattagaaaacatgcttccagcttttctagctaagagcaggcttatccattggttcattcattcacttgagacccattttctctgtgctttctgtgggacagacagtttattgggcattgccttcaattgccctgagcaagctcagagcctggaggaattggtgtatcatcttatttttgagtaatgcttttcacttcaccaaaccatctttatttttacaacaaaatatactggtggaattcccttcaatgagaaattttccaggcctaaggcattgaaaatacaaatttactcaccaaaattttgttgatacaactacccaggaatatgtactaaaacaaaataagaataaatgttattataggaccagcacctaaatatttgatggtaaaaatcttttaatagaataagaaatatttttctagttaatagatattatgaaaacattctgtaattctctgtgtggttttagaattctacttctaaattgtgcccctgggcttaaaaacctactacgtggaataaaaggcattcttcctaaagttgtacacaaacatataataattataggattttaggtgcataacctctgtcttatagaatatgaaataaaatatataatcaaggtctgcactgtttgctgtgggatttgaacaagtgcctttgtttttctggttctaagttcagcatctgtgcaaatgaaaacattggtctatgtaggtggctttcaaactgtaacgcatctcagaatcacttgggttgactgctcagttggcagattgctaggccccttcctcaggttgctagttcactggaattagagacccaatatctgtattcttagtaagacctgccaggtggttctaaaggacaaaatctataagtgacattttgaaaaacactaatctaggtcttaacctggaagtatgtttaaataggcttcaggagttctgcccacactgaagtcgcaagtaaaattttatatataaactctcttggggtagctttaatcagattcattgaggattctgtagtcccaagaaaggataagagtcactaaaagtgtttctaaccattggcagacgtaacattctaggttccataacagtggttattgagtcttaattggcactaagacaaatgcagcaaaatccccttctaagttatactttcaaacaaacttcactggcataagaatacaaataaaagcttccaggctttgttttgttaaattggtttttactatgtagatgatgtttgactgattcatttatggcccaccaatcaagctttattttgtctatagctccacgctaatgcagagggagtctccagtgggataaaacgcagcccctgctttgcagtcctcctgagcacttctatgtgccaggggctgtgtaggccctgggtctgcagaggaaaacaccacaaatccctgcctaggtgactatggtctggtgccatccagaaacctatagtgaagatagggtaaaaaaatacatatatgaacagctatcacactgggttgattgtgatcaggaacaggaaagacaaggaagggcctggagggtcagagagggctggttaggaaggtgacattcaagctaatccacaaaagaaggtgaatttgaacatgaggacccatcagtctgtctagaaactaaaaaatctcattgactaagacaataaaaatttgaatttaaaaatgattattgtgtttttgagcccctgttcctattgtgttggctggaggcccactgggtcaagtatgttaggttgaaacaaaaattcaaaaatcaaaaataatcaaaaacgtcttggcagccttgctgagatcaacaacctgaaaacaatctgtggaagaaaaagcttgaatacttctggggcttctgccataggtctctcccttgtttctcactccctcttttctctcttgttctctctctcttgtcttctttattcccttcctttccaattattctaacccctgtcagtctgaccagtggcttacttgatttcaccaaggcctatgaaatcgatcttagagatagcatttccttcactttaagccatagaggttgggaagtcaggagacttggctgaggttacaaagtggtgagtggagacaaacacctgagtcactcagcccagccttcttgccaccttttcatgcttcctgtgtcctgggagtcacattcaggagcaggcatctgggaggttctccagtttatcttgtggtagagcagaatgcacatcatgttgctccatcctagccatctttccaggatcagttcaaaagcttctccctgggaaatcatttcttgacctctccaattcccaaagccaaaagagtctcttccctctgtgttcccaagactttggtgtgcatctgtcccaacttttagcaaggacattctgttctgcaacctgaatacaggtaaatgcagtgtgattttaattagaagcctggatgtgcacctggttctgccatacactagcagtgtgaatatgggaaagtcctttatgcttaaggtttgttaaataaatccacagaccactctgcccctcagttttctcacctgtcaaatgagaataacactctgggccttgcttatttcgtgggctcttgttgagataggagggtggtgagagcaaaagtgcttcataagcattgaatcatcttgcacaggtgaggcttatcagtgacttggtgttaggtacctcagcatgggaggatatccagatgccaaatagtccagtttattgggctgtggcatcaagaattttctctcatcagatattttatcaaaagaaaatgtgacagagatgactactgcctcttctcaacatctgattcaaataattttgaatataaaacatttcaaaaaagatttggggatgaccagtttttagggattcagattctgtttgttactaagatgtggttaggagcagactttattaaaaattcattgggcagagctgtatatagaagggttttaattccttaaggaatagacattacatgaaatacataatgtcatccagacagggctagtgaggatgttgcaatttttagcatgtatttccacttggaatgtttgccaatatgattgaggctgcattcaacttgaattaatggggaagacaagagctggggtctgaaatctcaaggaaaagacaataataatctagagttctgagaaaacaaggtcccatgtgaggctccaacagtattttattatggtgatattgtctcagggaatagctagctaccagcattagagacagcaattaccccacaggggtcaaaatgataaccttcccctgtctccaagggtgtgaagttattttggatggcttccacaccttgggattttgctttcccatggtagggcaggtgtcatttagagagatatcagtggttattgtgactgtggcatcctgaaggaattgctcttagatggcacctcaacctctctgccctcaggataaggttggaaagagccctttagaagtctctcagtccactccctcccccattttacaaataaggacattgaagcccttgaatgagggtttaaagctagaaggatgtgctgtcccgttagtaattctctgcagcagattgctcaaggacactccatttctaattgcaatagaagaaatgtcaaagcagccaggcatggtggctcacacctgtaatcccagcactttgggaggcctaggtgggtggatcacctgaagtcaggagtttgagaccagcctggccaacatggtgaaactctgtctctattaaaaacacaaaaatcagccaggtatcatggtgcatgtctgtaatcccaactactggggaggctgaggcagaagaattgcttaaacctaggaggcagcagttgcagtgagccaagatcacgccattgcactccagcctgtacgacagagtgagactccatctcaaaaaaataaataaataggccaggcatggtggctcatgcctgtaatcccagcactttgggaggccgagatgggcgaatcacatgaggtctggagttcgagaccagcctggccaacatggagaaaccccgtctctactagaaatacaaaaattagctgggtgtggtggcatgcacctgtagtcccagctactcgggaggctgagggcacaagaattgcttgaacccgggaggcagaggttgcagtgagccgagattgtgccaccgcactccagcctgaatgacagagcgagactccacctaaaaaaagtaaaagaaaaaaaagaggaagaattagcacatttctattacagaattggacttgaacatgcaaaatcatgtctggatttctcagtgaaaagctgttttacgttagtggactcttctaacattttgaaatggtgatctggatttgggatctggctatcactgacccaccttgggtctgtgaatgaccaactcacctaggtgggagtcagttacccctgccctccagtggcccatggagcacctgcgggaagaaggctttctgtcttactgattcttccatctttggtgtccaattggaaggattcctgggccattgactgtttctctctgagggttgttatgaagcttgtggctccattctcatgactactgtgatatttctgtgaatctgaccctgccctgaactccaggtcagcttctcccctcacaggtgaaatccagtcctattataactgggggagtgatagacagattttgggctattttacgaccaactttccctgtctaaaatgtcaaagcagccgggtgtggtggctcacgcctgtaatcccagcactttgggatgccgaggcgggtggatcacctgaggccaggagtttgagaccagcctggccaacacggcgaaactctgtctctactaaagatataaaaattagccaggtatggtgcatgcctgtaatcccagctactggggaggctgaggcaggagaattgcttaaacctaggaggcggcagttgcattgagccaagatcacgccattgcaccccaagctggaagacagagtaagactccatctcaaaaacataaatataaaataaaataaaataaaaaaataaaataaaataaaataaaatgtcaaagggaggaatccctttgtagtaatagagaagctattagttgtcgtccaccttcaacaaacaactatagaatggcgtctaaaaggagtctgtagccaagagctatggagtgtgtggaatttgagtcagactcttaccctactctaagggcctcacagcctaggagaaactcttaacaatctgtgtaaatagctagaagagatacaaagtaacgtttgccccaacataggtgcagattttctagcctaagaagtttctgtataaataacttcactgaagatttcaagacaccttgaaatttaggtagatttgtagctgcaaggatgtcattcctaacagagagacaacctaagaaagggcacaagggcagagtctcagttcatttgagctgctgtaacaaaacaccataaaccaagtagtgataaacaacagaaatacacttctcacagttcttgatgctggcaagtccaagaccagggcagattcagtgtctgctgagggccccctctctggttcataaatgactctttcttgctgtgtcctcacatggtgaaagaggccagtgagctctccgaggcctcttttataagggcactaatcccattcatgagggttgcacctagtcccctcccaaagaacctatctcctaagaacatcaccttggggattaggtttcaacatgtgaatgttgcaggggacacaaacattcagactctatcaggcaggaagacagggggatgatgtgggaaatagcaaggagttctgttggctgaaatgtcaggtaaccaaagaagtatcagggggaaagtgagatgaagatatgggtagagccaggtcacagagggcatcaaatgtcacaaaagtcctaaggtcctgaatgtggtatacaaggcgatcagatggttttctgcatagacaactaatccacaaactgccaaacgtgttagaggacaatggaaattctggtggcctggggttgtattcttaaaacaacatgatggacaataccaagaaggaaaagttaattttcatttttcctcataaatgtcccagtgactcaagggatgaagatacaggagcttgcattgtgccttcaggagaatgacttagagcccaagatgactcaagttactcatgaagaatttattgtctgtaccttgtgtgtacagtactagactcaacaccaggggggtcagcaggtaggacatccatggatatcccaggccatctgggaagataaagccttcaaaactggcaactgcagcaacagcccaagagctaagtgtgggtgtaggtgagctgcggccttgggagctcaaagaacaggaagggagagagcaggttgagggcgtccagcagggcagagggtgtggtgcaggagctgaagctgacatccagaaaggacttagacaaacagggagggtaaaaacactccttgcactgagcaggtgatgagcaggggagcagaggagcaggcggtgggcagggccttgatcctggaatgccaggcccctccctgctcaggggcatgttgggatttccctcatgtggtctgtctgcttagtcagcctttatcggcagaggccgaccccagcccaccagcctagtcttgtggtgtcatcccagccagagctggcagtacagatcccagccagagctgcctgccctgagccctccacttgcttagggaggaggcccttccttggcctttgtttctgccactttccgcagagagaagctggtgatgacttgctgagtaaaaagtggattgaccaactttccgggtaaaaacagtaacacggtgttcccgtgagaaccagctgggcctggctgctacaggtggcccctggggtcagatccccaatattgtaggtgaaataccttcagtctgaaataaagaagcatactcaaaacattttggtctgaaagcaaagacaaatgggttgttttatcagtgtggctcacagtgtttttagggaccagtgcaagatggttgttgtcctatgtttgttcatttgggtggtttctttttttctcctgtatattttttattactaaatggcacaaagatgtgtggtgaagctatacatactatcattttgggcttggttctctctatccgaggcagagacaacagcttggaatacgtgttaagtaatagctgaaaaggcagctgctctgtggagagagtagccctggagtaagacacagggttcttacagggtttgaatccaggttctgccccttgggagctgtgagttttagggcaatggccttcacttccctcattttagattctgcagctgcccaatggctcttcatatctactttacaagtgtctgctattcaactgctcaataaatggtaaaggtcactctaattatgactggggatagagtatggggttgaggaagctggcactgctgtctgattatgcagcaaagatccttctctgcacagcatcaagttaggatctgctccaggggactatgcccccttggtggtatggaaactgtcttggcctccaatccatgtgaaccagccttcccagccttccccagaacccctacaaggctgacccagtcaccactgcttctatgtgaaaaaaagtttaaggaggaagtgaaaaggctgtccctggtgcaggcaccagggaatcctcccagcgactcggcgggtaagccagcagaggaggaaaccttctgctccttgagcccctccgcagcagctggtaacagccttgaaggtattacactgatgcaagagaaaggctctcggagaatacaattttccctcaacaaaacaacccaggcagagtgttaggggcatgtgcagagccccctctcagggctgacccagagggacaggatcacatttgacaccaagcatcctgaaacttggaaatattggagtgtaggtggcaggaaaggtgtctgttatccccgtgcagccatcaaatttactgttggctccaggcaggctgccataccctgggaatgcaggcagggagtctggttggctttaccacataaaacaccatagaaaaccagatactttacgtcctttctaaagtaaatcaaaggatgactagatgcatagatgaataatagacagagaatactagccaacattcgttgaatgctcagtgtgcgtcaggcattgttccaagcactctgcatatattaactcatttcatcctcataagggtatttgaggttggtgctattattatttgccccattttacaaatgaggaaactaaggcacaaagtagttaagtaactatcccaaggtcacacagcattgaaacccagcagttggactccattgccaatgctctttacctggtagagagagccttgatggagatctcaggtgatcctcatccccactaataagagtggtttgtgtgctttcctttcctatagtcttcagatttaaaacattgacataaacgtctgatatggttccaagtggctcctaggatgaaatgcagagaagtgaagagtcgggggctggagtcagacagaaatgagtccaagtcctggctctgcactgtccagctgtttggctgtaggcaagtccttcatcctccaagtccgagttttctcatcaaacaaatgggatgatgacctgcttcacctgcttcccagagcagtggtgagggccaggaggctgagggtctgacagtgcctacacttctagcttaggttccttgttgacagcactggagttgagtcagaagaaaaccaaggtgggctatgactgtgaggttggagaagcccaccatgaggaattacaacttccctctctagcagacttcatgaccataaactgggatcataggtcctcatgcctggcactgaggagccagagagagggggcttgattaaatgagacaccagacactgttggttacctaccagatggtccctatcccttcctctctagtagtggcctacctctcaaaatagaggctaaaaatccagttacatgctttactggtctactttgcatgaaagacatatgtaagttacccaatcctggtcaaaagggatctgagaaaaggtcttctggggtgggaaggattctggaaaaggtttttctttcatccagacaagcctgctggattttatcgtgtctgtgtgatgcctggagttgccacagctaactttcaatggtgaggggagataaggcctccaagctgaacatggcagagtagaaagggactgggaacatccctgagctgcagaattagtcctgaaacaggacctgggccacatgctgtgtgggataattaaccctttgtgtcaaggcctgtcttagtggggtcttatgttccttgcaagagaaagcatcctacttaatatgaaggagaatggggctgagccaggaggccctgaacttggtgaggactgttgctagcgagttgatctgggccagttacaaacctgtctgggttatagagtctcaatttattaaagagggctagtaatccctgctctaccaccttcaaagagtatttgtgaggcgaaatgaaacattttttttgtctccacctcctactttgatctggagatacaaaaatgaataaaatgtggtacaaaggcagagatgggagtgaacaccctgttcaagggacagaatgaagttcaatatgagtgagaagagtggtcagtgagtaggagaggcaggtgtgacctcaatgtcttcctttgtaaagagagggagttgaaccatgtcacttcttaagttcccttccaacagcaagattctagaaatcacgtgcagctgtcactcaatctctgctaggcatgcctgtccctatagcacaggtcccttgacattgtggctatttttttgtccagctacccacaaggtcagggactgtgtcttagtcatctctgtatccccagcaatcaataacaaaaattagttggatgaaataataaattaacaaatgaataaaggactctgtttcatagcttaactgaaactcagttgaaagaataagtgaaagaaatgaaacatttaaagagtgttatccagaataatgagctacagagattctcaatgaaccttttcaatacagaatgtttaaataagtaatatgcaacataacataacagaataacataacatcccccattctgagagtcaagtagctagctaattttcttatgactacgggaggtacttaccagcaaaagagagttgtcaatgaacttccttaaatactattttcccaaagaggaaatgaaaagataaactgtaaaacttgacatgcccagtatgaaaaggctatctgatgacttgaaattaggctgcttatgttggagtttgtaacgagatattcagagaaaaatgtgaacactgaaatgattttcttttagaagaaatgcaaggaagaccataaaagacaaagttggtctctgaaaatagatagctgtgtctgctttctaagtaaatctcactgcatagtcaaggtagtacttatttttatccatgttcttttaaaaaatgtgacatgtctaccaggagcacgataaatgatgacatcgtgttaaagctaatatgtcgtggcttcacagctcagccccagtcaaatctcttgcagacttcaaagctggtgcccggagacatctttcaagatgacacagctgggttgccagggtaacccactggatgaagctctagctggctttgggaaagattacataagaccagaccaaccaggaagagtcaaggggtatcctgggggtgaacagagttgtggctgttgtctgttcagctttcaggataagggaatggtggtgacatttggaagtgggtagcattagacacctggagcacctatctcaatacaaaagtcttcatggcgagactgatgatgaaaacattgggaaaatggggattctggttgacagagaataataataatacatatcaggcaggaatgaccatttccccaagaatcaatctcaccatttagttttacgatttccaagctgtcatagatgtcccattattttgtgttagggatgtatgttaatatgtgtttatcatttgaagggatgaatgactcccttaaaggactaaaattctattaaattcataacttgcaatggaggagatataaagaacctgctgactgtgtgtgtgtgcgtgtgtgtctgattttctacatacatacatacacacatgcacatatatatattcagttcattgatgtgggtgccttagttaggatctaagtttaactgtgacagagactcacatggtgtcgacatgactgaagattaattttctcatggggaaagtccaagccggtttggtagctgtgctctgtgagtcctcaaggcctcggtctctttctcttttcgtgctccttcctagggtgttgctgtgattcatgaccttacctggctcaccacagtgtcacataagctggtaggaaggagaagacagaggagtaggggagcatgtccttcccctcagggtcaagacccagaaagagtgtacatcacttcagcctatgtccaagacctaatctcagggcaatagctagccgcagagaacactggaaaagtagccttcattttggttggccacatgttcagttaaaagtcagttactatggaagaaaagaagactagataatggggatagctagcagtctctgctcagtgggtacatttttggagggcttctttctgtcatcagcctctcttctgaaggtcaagtgcaagatgtgcagctatgtcagctttcttccttgcagatgggatttgaggccctaacaagcaggaatggactcactctgtatgcttctgcattatcaagagtggttagtgctaaaataccctgttctgctgcctgggctggacctgacagcttccccagggctttgctctgtctgaggcactgaggactgagagaaacttcatccaaatagagagaattatactgtgaccataaaggtcccaccaattgatcacttcatatgctgtaggtgatggggttcattttgaaaacaagagaaactgttatccataagttgatagcttacacaaccccccactgccatcatctctacccttttcctgcacccactccccagcctttatccccacatggagcccggcaggctgtgccactggactggttgactgtaactactacttttgtttcttgctgtgtgtcagtctggcaacagaggtctttatttaatcgcattacttgaatatcacataatgagcaggccagcaggggcatcaggcagtgccacatagggtaagggacaaacacctagcgtgagagatgctgaaacacaggggcttgggcctgcagtcacactcatagtcagatttactgatacagaatgactgtttgatctttgtacttcatccatccatgtatttgttgaacattattgagcatctactctataaaagcctcaaattaggattctggaatgaaccaacagccatgactcctgccctcaaagagctcaatcaatgagggagtccaccaagtggactggcaataataatacagtgagacaaatgtggcccaagaggctgtgaaaaatgggtggtgctggaagaggctccaggaaggcctctcagaagaaataacactcaagccatatctgaatatagtgaaccaggtggtgatgaaaagaaggaactcccagcagcaggaagcacttgcaatcttttttttttcttgctaagatttatttcttcccagtcctagtccgcaaaatcatcttgcaaggcaagatcctagatatttctcagccactctaaaaatacatccataatctaatggaaacaagcacactggcaagacattccccttcctgcccattagtcagccttttatcagaacagccctgttgaggacagagaacatgatgcggattgcgatgtgtcagtgacatgggactggaagcatccagatgacaggggcttggctctccatctccagggaaccttcctctgaactctagccaggcaagggccacagttcaaggccctgaactctgcatgctttgatccagtagtgccagggttggctccttttcccaaggaagaagaaaatctttgcttgatagatcaagcagttgtggcattttctgatcctgctggtagttttcagaaaaataaaggaaagggaaaaagaagggagctaatgtttattgagaccctactatgtgttaaatagatgctatgagagaaacagagaaggagataggatcccttggaaacagtattgaacaaaaacaagagcaataattacagcaaatgcttatgtagcattcgctgtgtacctgggtactatgctatacatgttctctgtgttatctgtttaattcatacaacagccttctgccctagataccattattatccccattttacagatgaggcaatcgaggcacaaggagaggaagtaacatgtctaaggacacacaactagtgaatgactaagctgcgcataggttctaacttcacatttcccagctctgactcttgctgtgtgacaaatgacataaaccatttgagcctcagttacttcatctgaatgatggagacagcaatgccttacacccagctctgtggtgagggtgtcagtgattatgctgaaagacaaagcttgaatagagataagatgaaggatgatcatgccacatcactaaatgtggggtagtgcactcacatatgactgctgtggggataggctccatccaggaagggggccttgaacttggtcaaagagtagactaagaggaggtttggaggattttcccaaactccccagactgggccaactccagaactctctgaagaggacagtggtggctcaaggtgcgaaaggagccagctccgtctccagcacccccacttccactgctccatgccttgctctctgctctgtaatccccaccccatgccccactgctatactcttgtcctgccctcacccaaacctgctcccccaaatgtctctcatcaatttattaatattaacatgtcagtgactgattatatttaatgcgtacatcctgctaagggatttatagtttatcaggaaaaccaaagtaatagtgatgaggttttagggcctgttcaggggactttctttatgttctcagattaatatcagaatatatgatacacacagaggtgggcaatgcaaggcaagactttgtcatttgtcagggagaggactttgacaaaccatgttcttcatgcactctgtgtgtgtgtgctctcactcacacacatgcacgtgcctatgcataccgtgagaatgaggagagggatagatgtgttttgaagttctggctgtccttgattttgacccccttcaggaaaataatctctttgccgcatggtcctttttggaggctgaagcctctcaaccccaagaagggaagcagaggtggccccagaggctgcctgatagccatgtgatttctgtggcttgtctcggggactggccagcaaagctgctgagcagggagcccccctccctaagtgctccacagtgtaaaggccccttccgcctccatgtacatccatcagttctccatcagaggctgaggttggggctgactgtgggatgctgggtaatggttcttatggttaggaaaatacacatagacattcagttccatcaaaccttactaaatggatgatcccagctatgacaaagagatgaacctgcagtcaatgcaaggtcatctacagaagaggccagggaaggaggaagactgtgacagaatggtccccaaccacaggagtatgcatttttgattcacctgatggggcccatccctccctcttctgattcagtgtaaaggaggtgagaccaacatctatactttgaaaaagctccaagatgactctgaaatgcatcccaggttgcctctgggctttaacatgttgctggaaggggacaggcagctctgagtaacagcaattccttcgtttcccagacggtggatgtgcccattctacagtacattcactccctcaaggaagagtttccaaagcccttgtctgagtcaggcccagggctcagtccccagttctagggatacagagatgaataagatacccaaccttgggtgaaggtgcttccagtgcagtgcagtgcagtgcagtgaggcaactttcctctcctcagctcctcctcaccccatctcctcttcattcccttaactccctaggccatcctcatccttctttgtcctcactcccaaatccaccccatcactgttcccatcttcccctctcttttttttggagctcagacttcatactgcagcatcttgccccacaattcatcaccatccaccaatagccaggaaggccaatttcagtggaacaagaaggtctatggctgtgtgaaggtaccattggcaggagtgatttctcaaatcttcagcaagggattatttagcaagtgcatggaaaatactaattgagataggaaacaggaattgttgaaagcaattttttaagttacttggaaaaagtacagtgaaattcctggaaaaatatttgatgaattatacatgtacctacacccctgagaccgtcatggccaaattcaaattatggccacaggacagcaaacagaagttagccctgggctggacctcagttctagccccaccactggcccctgtgatgcatcctcataacagatgtttcccttctctgggcctgtttcctcatcacaaaagatgtaagagctaaataatctctaaggactcttgttgggacagtcagtccagtgtcttctttgtgctgagccctcttcactcatcattacgcccagatttcttcctggagtggggagtggagccatacacaggggaatgctcagctgttccctgtgctgcacagacccactggtccagacctcattcacccatctttccacgtttcatcctgttgtccataagcaaatgacacagttgttcatctattcatcccatagaaatgtaaatagcttcttccatttaaatggttgcatgtagggagatcaataatgagaaagcaatcagacagatcttgctccagaagagcccccaagtcaagaggagagagatagacagttcgctgtattaggcaaattgtgctcagctccctttgaaagggaagtccaggaaggttggggaaatgagctgagggctggaaacacgcatggggaggtggctggtcggaaaaggctttctggaagaaatcagatttgagtggggctctgaactgggatagaattccaggagatgggccctagtggggagggcatcacaccaggaagtccttcagtgtgggcaaggccctctgaggtatagctgagggcactgtaagactcgggggcccctcttaccactgttgcttgcatggcaacgtagacctggcagctcttaggagggggcactgaaggcacacttgcctgtcatccccagttgggggaaacattggcttaacaatgttcagcaaattacacattcataatgaatcctgttggcagaacttccaagcccttagcaccaggcagtgcatctgacagcatcattacccctcagtatgagttttgccagttgtcattttcccaagcactttggagccgactccgcctttgcttagcagtcacagggaagccagcccattgggctccacatggcacttcctttggttttcttgtcctgtccccattttcctccaaacccattccagtttgtccctgcctcactcactcagctgtggccaaccccaaggagggcatttatcccctcagggtcagatccagggcattttgtcttcttagcagggcccaccaggaagagactctctaagcaatcactctgcattatgcctttcctaaggcaattcaaatatttgcatttagcagtaggaaaccatgggcagttatggtggctgccctgtggaaaaatgcaaaaccactcatggatgaaatagagagaccagaagctttgggtcagatagagctgggttccaagtttcagtgagcctctgtttcctcatttgtaagatgagaataatctcacagaggagtctgaattaaattaaaatgcctagcatatgcctgcacttaggaagttaccaatacttctgtttccctccgcttctttccagagagagcggaagttttatgtaatacagttttgggccagtttctagactactgaataaatatcttcacctttcttaactacagctcccatgatatcctacctttcctcaaaaacctcctgtatccatgacatgtcattaaataagaaaagccaattgcaaaaccctatatattaatagaaagatgtgcagaataatctgatttttgtaaaatatacacacatagctccctgccccctctctcttcatagcgtttacttccaggaagtgggattggtgagagtgagggtgcccctcatgccttatttttttatttttttgtcacttaaagttttcacaacatgtatggagtatcattttttaaaaatattttgctgacacatggtaattgtattcatgaggtgtaatttgatgttttgagctgtatatgcatatgttgtagagtgatcaaatcagggcagctcccatcactattcatgtaaaactaaattctaaagaataacaaaagaaacctcctctaactccctttgcctctggaaaaggtaaaaattccatttccttgcactgggcctgtctcagatatttggctacaattaactgaatccagcaaacagtggtttaaatagacaggagtttatttttgtcacatacaaagaagtttggagctggacatttgtttagcattggatcatgacttctgaacatctctgagattctcttggtctctccctcgtgaatacaagatgattgctgcagttccaggcttcacattaccattcaagtctgccagagatagggaaaaggttccagctgcatcagtcctttttaatcaggaaatcaaaagatttccaaaaagtgccttctacccacccaccttcagaagactgactcatctgtctctttggcctaaactataccacttggacaggaaataataatgaaaagcaagaaacaagatcatcatgattcattttagtccaattatcatctatttcctggaaaaggcaagggaatggatcctcccctgcagggcttgggacttgaacaaaagcacagttgttacagaaaggaaaaactgggaaggtggagtagaaaggtgactaagactgtctgccaaagggcccactaactttccttcctcactgctgtggtctgtgcactagctcacatgggtggctcacagtccccagacattctgcaacattgcacctccagccttgtactcaagctgttcccttggcctgtgacattctcccttgggaggctgtggtgacaggaacaaggcactcacatactgtgaacatcatcacaagagtgaagcccagcaggttccatgtggcttcttgactctgcgtggccccacagccagctctgtggctcctgtcgggctctcatatctaattgatgagctccaatcggtgactttctttatcatgaagggttatgaaatggcatagtgtagccttgatccagtgacacttctctgcagcactgtgacgagtcctacaaagaagaggtagaatagagtgtacttctccaaacactgatggatggcacaatggtaggtggtgtgagctgatggagggaaatgaatttgcttcctaaacagccaagcttggccacccacagtgagctcagtgtcaccctggattgcagttacttgtgtgtatgtctccacttcctgtaggtcaggggctagctgagtattcttgaaaagttaactggtgaataaggttggtttgaggatttcccttggctttatgccatctggaccccagagtccctcctgcccagtggcagaatttcagagctatacagccccagaagaatggtaaaggaagaaaggccctcaaagctcaacagcagtgagtcctgatgaacaggcctcagggggtgagctggtcatccattctccctttactcatttcagaatggacactattctgagaaagatggggagtgtaacacagagaatggcctcctttgacacccactcgtcccttggggggttggccgtacagtgaaaaatctggttgtcactgagaaacagccatcaacctgaccatttttgagctcccccctgttccttagtctaaatttatgatctctccatgaacttaatctcatagctgtgagagaggctcttacaggtcattctggccaacttcctgtccatcagacagaagaggaacctggagctcagcggagggaaagaccttcagcaggagagcttgagaggtcccaggcgaggtggctcatacctgtaattgagcactttgagagcccaaggtgggcagatcccctgaggtcaggagttcaagatcagcctggccaacttggaaaaaccctgtctttactaaaaaatacaaaaattagccaggcatggtggcatgtgtctgtagtcccagctactttggaggctaaggcaggagaatcccttgaacctgggaagcagaggttgtagtgagccatgatcatgccactgcactttagccttggcaacagagcaagactctgtcttaaaaaaaaaaaagaggtcttgagactagtactctgtccactgtaccttaagcctctcatccttgttcccaaacctatttcctggcttgtagagttcattcagttaagttaaaaagaggtgaaacagcagaagtgccccagccagggtgggaccctgccagggtgtggtgctgccgagagctgggtggtgaccgcatcacacagtgaggagcaacactaaggaggcagcaagtggaagtaagggatgctgtctccatggcaactgccgttcatcctcagcttgtcaggctgggcatgctggaattgaacagggctgaattgttgcccccatcatgtggcacttttccaattttgagatgccttcacctgcatacatgcacatgcacatgcacgcgcacacacacacacacacacaccccaccttacactttttcctctacctttctccagggaagaataggtgtggtttccagtggcacagttcaagcatggcagcacctttcttaccccagaaagcagcagtacccggggaaagaatatggggagggggataagggaagtgtgagaggaccagctcttgtcctggtacctgctaagcagaggaggagtttggtggtcaatgttgctgtctgtgctcaaggatgtagtcacctggtgtatcagtttcctactgctgctgtaacaagttactacaaactgatggcttaaaacaacacaaatgtattatcttacacttttgggggccagaaatctgaaacagatttcattaggcttgggtttcttttggaggttctaggagagaatccattcccttacctttctcacctcctcaaggctgttctcatttggaggcttgagacccctcctccatctttaaattctgctgcttagcatcttcaaatctctgcctgctttgcttacactgtcacgtccccttctctgactcttgtaaggactctgtgattacactgggttcatctggataatccagaaataatttccacatttgcaggtcattaacttaatcacatctgcaaagtcccttttgccatgtaaggtaacatattcacagacttcaggggttcgaatgtagacatctctgaggggagagcatcattctgcctcctctgcccaggttctgtgaatatgggccctcaataaccattattgtaagagtaataataatatttccgacagactgagcacctaacatgtgataagcactctgctagatttttacacatattaactgatttaatcctcactaaagctctacaaggatgccttaattatccacatttacacatgaagaaattagacatgaggagttcagtgaattgggccagtgggcttaggtaaggaaggcagaggagggaatggctccaggcatatgttttttccatatgtcaccagaaaattcccccagcactttggtcctactgctgcttgtaatcattctctcatgatccagtgaatcagtggtggggtcggggttgggaagagaagcttccaaagagaatctgacagtcaggggcgaaggaagagagccaatactgaataaccactgtgtgccacacggcaggggctctcccaggatgcttcacaagctcctcacaaggtccaagaggctgccatctccccagttttacagaggataccaccagtgcccaaagaggttatgcagcttatttgaagtaatacagctaataagtaacacaactgaaattggatctggtcttctctgaatccagaatcagcattcttccttcttttatctgtctttaaccaagttacccacatggtggaggcctgggtataggtagagagcgggcaatcttggtccatcttctcagcaggctaatttttcttggagattgaggggtggttttttaagttaactaactgatgggttttgcaaacacatttcagtttttaaaaggagacattttagggcacataacacatattttacatgaatattaactcaaatgcgaaacttcagactcagcagcccccgagccttctgaggtctcaggtattttctactcttaagggtgctttggtggaaagtttgggcactggacctcaacttgttcaattttcccttatttgcctttttagaaaaggcagcttctaggcaggaaagtagagaaaccaggtcacaaacagtattagaactcatggtcctgactccccatccagggctccctccttgtgctccatcatttgcctccctccttatgcatttcctcacctgaggaatgagggtaacgtattcattcactgaataaagatttattgggcatatactatgatcaggaatggtactagacaccggggattcaaataatttgtttgttacagtcttaaaaaaaaaaaaatgcaatccccccccaaaaggcccccagcaatgttacagggccattctaagtgattacaataatgtgtggtggagtcatgcccagggtcttgagagggcataggggaagggcacttgccctagcttggagttcaatctttctatatgaactgagtgctagagcatctgtaagaaaatgccaggagatagaaagcatttgagagggaggccttcctgcaatggggaaagcatggaggtaagaaattacaggtcatatcctggaaggcacattgggaaacacagaagttcattttgctcatgcctaatgtgtccgtcaggcagagagggtaccactgtatgaacgggcaaaaccctggagacgtgagccaggcccttctcatggggatccaactccagaaagtgatgaaaaaccagtgaagggttttaagtagcatgggtaggatggcttcatggaattttctaagtggttcattctggaagcagtctggacaagggattggcaaagcgagaagggcaggctagaggcagaaataccagcaggaacctggagggtatccagatgggaggtgcaggggccccgcctcctcattctcagggaagatctgctgtgctttcagtgcgcctcccacgtggaaggcttctggatgggggactcgagctgcctccagcccaggattcctcacccacagacgaagcctctaattaaaacaaaggggccacagtagaatgcagtcatcactcttcccctgagaaagtgggtgggaaggtgagcattatgctattcatgatattatcttttgagaaaaagaattccacacccactattgtcttttatcgagtgacgctacaaattgattctaagcctcagaaataaaagagggtataatatagtacaaaaaaaaattgcaaagatcatacaaccttcatctgctagtgtaaaacagtacagactaaccccgataaattcagaaaaaaagtagaatgaaacctctcaatttaaactcactggggagggctaatttgaattttacattgtttcaaaggaatgctacttcttcctctcacatccaagcataataaaaccttaagagaatatttgtgtaatcaaatgctgatgagtagaataaagcaagttaataggaaaactataatagacttatggttacataatggtgagtcatgagcagtatggtcatttttatatacaagaatgaacttgatgaaggaaagctactttaaaaacaatacctagcatatcacttaacagggaatctcaccaggcagccctataaaaatcagcagtttctttctctaaaaatcaacagtttcttccttccttcctttctctctctctttctttctttccttctttttctttctttcttttctttctttcttcctctttctttttttctctctctctttttctttctttctccttttcttttctcttttcttttctttctgagacacagtctcactctgtcacccagactagagtgcaatgacacaatctcatctcactgcaacctctacctcccgggttcaagcaattctcccacctcagcctcccgagtagctgggtctacaggcgcacaacaccacacccagataatttttgtatttattggtataaacagtgtttcaccatgttggccaggctggtctcgaactcctgacctcaagttatctgcccgcctcagcttcctaaagtgctgggattataggcatgagccaccgtgcctctactcttttgttttattttttaatagagaggagatgtcattttgtcacccaggctggagtgcaatggcacaatcatagctcagtacagcctcgaacccctgggctcaagcaaccctcttgtctctgccttctgggtagctgggattataggcacttgccaccacacttggctaatttttttgttgttgtttcaaatatttgtagagacagggtcttgctatgttgaccaagctggtatggtactctgatcctccagcctcagcctcccaaagcaatgagattataggaatgagccaccgcacccagccaaaactaacagttccaggggagcgtcctgatttttagactggattcttctgggctgctgggaagatcctggtgagtcataatgagagaggctgggctgatagtgaagtttgcctcatgtcctcattctcctcaatttttctgagtccctctccttgccttccttttccactcatctatcacagacatcaaatccagaggtattccaaagcaggcagccttctactagctcatcctacaaattttacctctgaacatgaacataaaaatcttcagactctatctcaaaaaaaaaaaaaaaatcaggctgggcatggtgcctcacgcgtgtaatcccagcactttgggagcccttgaggtcaggagctcgagaccagcctggccaacatggtgaaaccctgtctgtactaaaaatacaaaaattagccaggcatggtggcgggtgcctgtaatcccagctacttgggaggctgaggcaggagaatcacttaaacccaggaggcggaggtcgcagtgagccaagatcgcgccactacactccagcctgggcaacagagccaggctacatctcaaaaaaaaaaaagaaagaaagaaaagaaagaaagaaaagaaagaaagaaagaaagaaagaaagaaagaaagaaagaaagaaagaaagaaagaaagaaagaaagaaaagaaagaaagatcttcaatgaatcctagtaatgttgcagcactttctccttagctcagctaaaaccaggctcttgtcatatgaccaggaaagattaggctcatggacacatagaagtgtgaggaaaatggaattcactgggtgaaaaggaaaaagacataaaaactcagcaaagcaacagggggccttgccaacaacttcctgcctcacagatcaaatcccaggtccccacacaggaacaggagaggccaggctcctccctgctgcaaacggcgtgaacttccagctggtcctcccagtgcacaggagggctccaatccactgtggccatgtccaaaccaccctgggcaggttccctcatctacacaaaagcatctggtataaacacttgtggggtgggttagagattctccagggatccttttttatctgtctcagtaatccatagctagtgcatattaaagcaatcatccaccacaatgagataagcttgttagttggccaggagtttaaggacagtttaacattacaaatgctataaatacttcataattatatcaatatcttaaaaaaaattgaatagatgtaattaaatatgaatttaaaatcattctaaagtccacttcgaagagtaaagagctgagagagaccagctgacttgtaagtaagtaggatacttgttctgtcataaatgaaaacatgctttacaacttcagtaattaaaacagtacggtattgatgccacaacagaaaaatggcaagaacagttaaatcagagcaaccccggctgggcacggtggctcacgtctgtaatcccagcactttgggagaccaatgtgggcagatcacaaggtcaggagatcgagaccatcctggctaacacggcgaaaccccgtctctactaaaaatacaaaaaaattagcagggagtggtggcaggtgcctgtagtcccagctactcgggaggctgaggcaggagaatggcgtgaacctgggaggcggagcttgcagtgagccaagatcatgccactgcactgcagcctgggcgacagagtgagactccatctcaaaaaaaaaaaaaaaaaaaaaaatcagagcaacccctagcatatataagaatggaaaatatgctcaaatgctatcatagactaaaggctgctgggatatccagttgaatttttgtggagagtggaacataaattcagatcctctccttccaccagacaccaaataaattccagataaattaaagaattaatagcttacattaaataataaggaaacagaagtgactgttaattgattccctggtgaggatggcttctaagagtaaacgtgatgggaaatatctgttagattcatagtgtcgctagctacaacttaaggtagtgtaggtccaaacgtgccacaggccaaattcaagtccaagaaccaactggaattctgtgatagaaacacattatggtgaattatcatgaggactaaaggagcagatcaggaactctaatttctgcaaggaaacttcaaggaagacacagagcacagtctcctacacttgtttctgtgttaaaagccagggttgattttggctgatcaatttcagcagtgcttttagggaacaatgcctgtgtggacagctggggccagtgtgtgattatctccaggtctgaggctcactcgctgggaaaccatggattcgtcacctcatctctctgtgccttttgtctcatgcataaaatgtgaaaaggaacaaatgtaataggcagaaaaatgtgtccccccttcaccccaaggtatacatgtcctaacccctagaatttgtgaaaatattatgttacatggcaaaggtcatttatggtagtagatagaactaaggttactaatcagctaacctgaatatagggagagcattctgtattatccaggtgggctcaatgtaatcacaagcgtccttaaagtgaaagagggaggcagaagggaaggttggagtgactcaatgtgaggattccgtctgccaccactgcttttgaagaaggaggaaggggccacaagtgaaggaatgcaggcagcctcttagagccagagaaggagagggggtggaatccactcccctgaagcctccagaagggaatgtagctctgccaacactttgatggtaacccagagaagacccatgtcagacttccaactcccagaactataagataatgaatgtattgctttaaaccaaaatggtcgaggtaatgtgttacagcagcaacaggtaatattcaaataattaagataattaaatgagaaaacgcctgtgtgaaatgtctactatggggctcgatatggtttggctctgtgtccccacccaaatcacatcttgaattatactcccataattcccacgtgttttgggggacctggtgggagataactgaatcatgggggcagtctcccccatactgttcttgtggtggtgaataagtctcacgagctctgatggttttatcaggggtttccgcttttgcatcttcctcattctctctttgcctgctgccatccatgtaagacaggacttgttcctccttgccttccaccataattgtgaggcttccccagccacgtggaactctaactccaattaaacctcttttgtaaattgcccagtctcgagtatgtctttatcagcagtgtgaaaacagactaatacagggctcagttcaaagtaccctggttaccatgccagtagcagctggcgtgggcttgatattggaaaccaggtttcctgaaatctctactcctgaacatacaaatgtgaaattattttttccttataattccatatagcaattgtgctatgatgaactattatctcctttgtaatagttgctttgacagcatcttggcaagattccctaaattagcgacactctctgttattggttatcagaacagactcatttcaggtatttaagacagtcttactcattttaaaaaattccacctccagctcagttcagtgctctccttccctccccagcacaggctgccttgtctgtggctgcagttaggaggcaggggctgggggcgggacaatgtgtcaaggatcagcacttggcacccaccccttcctctactactaagcagctcctccactccttcatgtattgaggcagggaagatatagagaaaagggaatttcagtaagttccttacggaactaggccaggttacagcatctccttagctgatttttttttttttttttttttttgagatctcagcgcactacaacctccgccttcccggttcaagtgattctcctgcctcagcctcctaagcaagtcgttgggattaggattacaggcaggcatgcaccaccatgcctggctaatttttttgtatttttagtagagatggggtttcgccttgttggccaggctggtctcgaactcctgatctcaagtgatccgcccgcctcagcttcgcaaaagactgggattacaggcatgagccaccaggcccagccccttggctgatcttctaatctcctcactatctctgggctccttgagggctagccatgaccccaatatgccccacctgcaaaaactggtgcccttgcagcactatcatgtctctgcagcacccctaagtattggcagactgttgggagttctggccgtagctagcgaatcacaggccacgttcccctgaggacttgtgtagtaccccttggggcctgagccaactacaggccagtgagcacatgtggaagtcttaggaactgggaactggaaaaggtgacaggagtagggagcatctggcctcagtgcccagagcctcggtgcacaggggccactaagcgaagtcctaagcgacagccagtcagggagcaaaatgcccatttcctgccattctcatagatgaactcttttggaaccaccaggggaagcactccccaacccttcccacccaccctgcccctgtgtctgcagaggagcaaagagaacattgtctctaagctggcctgggagatgatggttggatgcaagagtgattcttaaaggtacacctttattagaccctatcaacttatggctgaccccaactgccagcagctctctgaagttagaatgaagtgcttactaccttttattttcagtttggagcattgtccacaattctaggacaaaggaaaaatctgtcactgggtagaagcctcactaagatactcagaagaggctctgggaatattcaatgatgaagaactgcggctctcagatgccagccccactccagcctggcctgaccatggccatagcctgctgggtgcagcttgtctgctgcacagactctgggtggggttgccccaagaaggctttttaacagcaatcaaagcaataaaggactattttgtctaaaatctgttcctggactatcccagcagtttcaccctcatttcaacaccacatccaaacagcttcaggacctaaatgcaaatccacgccaaggagacaccacatacccccatctcaccacatcacagcccgtggctgcctcagggccctggaggaggtaagataagcaaccctcaaacaatcctagttcatttgcatgcatagcaatctgtcattgcttctagggcttactcatttattcatcctttcaatgaagcacctatcttgtgccccctctgtgttttcaggtacacaaagatagataaaagatgaccttttcaccttggtagtttgcccaatctgtaaccgcccaaggggttcaccttgcccactgcctagacagaggcgatttatcaagacacgggaattgcaatagcaaaagtgtaatacacacagaggtgtctatgcaggagatgagttttattattactcaaatcagtctctctgaaaacctggggatcagagtttttaaggataatttggtgggtaggggtccagtgaatcgggaatgttgattggttagctcagggatgaagtcacagggagttgaagccgttgtcttgtgctgagtcagttcctgtgttggggccacagaactggttggcaggtccaggtggggccatctgttgttagaaatgcaaaaatctgaaaagacatctcaaaaagcagatcttaggttcacaatagtgatgttaccttcaagagtgattgaggaagttgcaaattttatgacctccaaaataatgattggtaatatttcaaattccagcccctctcatcttgatttggtggctggtgacctttcatttgctttacaagaatagctttttgggaagggctattatataactatacactaaattcctttccaaagctagttcggcctatgcccaggaatgaacaaggacagtatagaggttagaagcaagatggggtcagttaggtctgatatctttcactgttataattttctcagttacgatttttgcaaaggcagcttcacatctagcaaggtagacacagacacatggccagaaaaaataacacaatagtgtaagtatcttaatagaagtacaaataaaaggttaagaagctcaaatccaggctggagattgtagccagcaggagcaaaggcataatagagtgtgagttattgaggacagcagtccatcttggctctttctggattcacctgggtctggcacatattggatatctaacagttgttaaattgacctagcattggaggcagaggagtgtgaagaatttgaataaaaacaaataattttttctgtctgatatatagtgtagggaggagggagtgcatgataaaagctcaggacctaattttgaaggtccttgaatgcccagctgaggagtctacactgtttccactaggtaccgaggggcaggaaacagagaagagtgacattgtggtttttttaaggccttattaggccactggattgtggtttaagtccagagttgtgggtgagttattttgtaccagggagaaagatttgtgaggactgcagtaatctgagcattcagatgtggtttccaagttgttagaatacctccctctaaatggtgttagagaaattcaaagtcccacagcaccttaggcaggctgcccacatctgagatataagggaggtcttactctgtacatgtaagtccttgagtttaaaagggccacagggaggctgggtcctggcctgagctcagccacctgcctgttctgtagcccctgctgggatcttcagggaggcagggctccaaggaggctctgctctctgcatttagttgctgaagagcacagctcttctctgaggtgatctcattctctcctctgccccacctgctttgattcctgcctcccacatagttaccaagccttaggtctctctgtgcttcaaaactcctcactctagtggcacaaagagaatgcctgccttcaacacagggctcagagccaaggcaaagcttcagaagcccagccacagctaaatcgcctgtctctgcatcttccttgggtgtctgtcccacctggcccttctgggcacccagcctggggctctggagctgtctccacccacacccagactgagttttcagggctgttataaggtcccttaaggctcagggttgtttagttgaagggctcaaaggcagacacatctgagatccaatcccagagcattagctccaagaccttgaggcaggtgaccaaaccatatgccccttccgtgttacgtagggcaacactagccacttcacagggttggtgagaaaatgcaatgagaagcttctatgaagcaactatcctaggaggtgcccccatatcagcagtccttcacttaactcatgaaaggtctttcctgccacccctactgagatctaagctatagcaatttctccagagaaagacagttttgttcctggggcaggattgttctaaatcccctctctgtgtaagcccttctgagttcagtggacttgacttacttggcaatggtttccaactgccactggtgatgcagaatttttctcagccactttgccaaccagggaactccatggccagcaataccccctgccatgcctgggccttgcttggccccaggcctgctggaggcacctcgtccactcggcctgctgtgttatagattgtacccgcattcaacaattcctgagctcttgtccctcatccaagaagaataaggttacactgacaattagaagggtaaggatgggcagagaagaattttattgagcaatgaaacagctctcagctgagaggggacacggtggggtggtcccccacccccacagtcaggtgatttctctctcagtgtggctgggtcccaggctttttatggactcggaatggcgagtgcatgcagattggtttgtgagtatgcaaaaacaggttaaagtgaagacaacacccaaaggtgggcacgatagtgtagaaaaacaattaggaaaggataggtaaatgtaaaataggtgaagggtggggcttaatcacaagcaagcaagccaaacgagaaaatagattctcaatctcgtccgtgtattttacttgtagcttggatttcgggctttcaactgtctttgccttgtcttctagtaattaagtatgtaccttggaggtagggtttcaccatggacccacctcatctgcctaggcatttggctgcctcctgccactgtcactggaattttagcccagagtgccctcttgagtcattccctcaggctcaatgcccttactccaaagctgcagggcttgcagctctgtgagaaagggaggtggcagttcacactgcagaagcctcatcagttgagagacataaataagcaagtggatgttccttgttcttgaataggaagactcagtgctgcaaagatgccagctctccctaatgaatgtagcagctcaaagctatctcaatcaaaatctcatcacagtttgctttgtttcattgttttgccacttgatctaattattttaaagttcctctggaagagtatattttcaataataaaagaagaagagagaagatgataacttccacatattaaaatattttataagcttgcaataattaagatactatgccgttaacagaggaataaattgacaaccaaataaagaaataataactagttcaaacatatcaaacatacacccgcatatatggggcaaaacggcattttatttttttttaatttatttttttcaagacagagccttgctctgttgcccaggctggagtgcagtggcacgatcttggctcactgcaacctccgcctcctgggttcaagcaattctcctgcctcagcctcctgagtagctgggattataggcacacaacaccacgcctggctaatttttgtattcttagtagaaacggagtttcaccatgttggccaggctgatctcgaactcttgacctcgtgatctgcccgacttggcctcccaaagtgctgggattacaggcgtgagccactgtgcgcagcccaaaatggcattttaaatcagaaaggaaaaaatggacttttcattaaatcttataacaattgtctagccattatattcacaaattaaatgtgaatattcaaaggtaaatgagagagagaggaaagtattagaagaaaacatagggaaatattctgaatctcggtgtggggatggactttcaaaatgacaccaaaaccaaacaccatttaggaaaattctgatgccttgatcatataaaaatctaaacttttgcacaggaaaaaaaaagcaacttgtatatgatttttccaaaggatataaaaaagatagtgaacctcactagaaatcagagaaatgcaaaaatggttggataatattgtatcattgttctggtatcagaggcaatgtaaagggtgcatcacacattagcactctggttaactattggatggtggtttgacaatatgggtcacaagtaagatttgtgtattccttcacccatagtccatgtttaggagataaccagatcaattttataaataaaacactttaaggtattaataacagtgaagacgttttaaaccattgtcagagtctctagatttgattaaataaattatagaacattcatataatggaatattaatcagccactaaaaagggggtcatatatttaaagccagtgacctaaaaggttttcatgacgtagcaccaaatgaataaatctagagttataaatatacatgcgtgtatgtgtaaacatgaagaatgcagaaccatacacaggtacatacttaatgactagaatgaaggtaaggtttgttgttgttgttgttgttgttttccgagatgtagtctcgctctgtcactgaggctggagtgcagtggcatgatctcagctctctacagcctccgcctcccgggttcaagtaattctccttcctcagcctcccacgtagctgggactacaggcccatgccaccatgcctggctaatttttgtatttttagtagagacggtttttcaccatgttggccaggctggtctcgaactcctcaccttaactgttccacccacagggattacaggcgtgagccaccacacctggccaggtaaggttttttgtatgattcactgctgtatccccagtgtgagaaactttgtcagtgttcaataaatacacattgaatcaatgaactcctagaacaatggtcattgtttttttttgtttttgtttttgattttgtttgtttgtttgctttgagatggagtcttgctgtcgcccaggctggagtgcagtggcgcaatctcagctcagtgcaacctctgcctcccgggttcaagtgattctcctgactcagcctcccaagtagctgggattacaggcatgcatcaccacacccagctaatttttgtatttttagtagagatggagtttcaccatgttggttaggctggtttcgaacttctgacctcgtgatctgcccaccttggcctccaaaagtgctgggattacaggcatgagccactgtgcctggccaaacaatgatcactcttaataataactctgagtggtaggttttcggctaattattcctttatttgtgttttaaattttttcttcgtaaatgtgtactatctatagagtaagaaaaaagcattgctattttcattaaagtgccttaaaaaatagacacagcatatttccttcagttatacattgaataaatcaccctttggagaagaactatgaaatgcagaaataagcattaaaaatacttcttggatgatttggtattaaaagtaagaaaagcaccgggtgcagtgactcatgcctataattctagccctttgggaagccaaggcaggcagatcacttgaagctgggagttcaagaccactctgaccaatatggtgaaaccctgtttcttagtctgttctcatgatgttaataaagacatacctgaggctgggtaatttacaaatgaaagaggtttaattgactcacagtgccacatggctaaggaggtctcacaatcgtggctgaaggcgaatgaggagcaaagtcatgtcttacatggcatcaggtgagagagcttgtacaggggaactcccctttataaaaccatcagatctcgtgaggcttattcactatcatgagaacagtgtgggaatgaccctcccactgggtccctcccaggacacataggaattatgggagctacaattcaagatgagatctgggtggagacacagccaaaccatatcaccccatctttactaaaaatacaaaaaaaaaaaaaaaaaaaaaaaagctgggcatggtggtgagtgcctgtaatcctagctactctggaggctgaggcacaagaattgcttgaacctgagaggcagaggttgcagggagccgagattacaccactgcactccagcctgggtgacagagtgagactctgtctcagaaagaaaaaaaaaaaattaaaagtaagagccgaatgtgatggatctagcagaggccaccttcacctatcgagttagtcaggaaatacttattgaatatccattgtgttccaggcactaagaatacagacatgagtcaggagtgacccttccctggaggatgtcagagcagagttgggggcaggcataaaacagctcgtgacaagacaaggcccaagtgaccctgtgcatcgatacagggtattgtcattgctcagaggggaagcccttaactcagcttaggcaggggagagagttggaatatggggtggaaaggaaagagcaggctgagaagacaaggggctcagagaagtgccccttgagctgagtgataaaggactaacaggagctagcaagaagtgaaggggcaagagaaaagcatgggcaaagcatgcaaaagcactctggaaagatttcccatggatcggcaccagcttggagtgtctgaggaggtgagggtggtggagaaatgaagctggagaggtttgcaggacccaagtcgaaaagggccttgtgggactggactaagcagagtggctttcatcctggagtgtgggggagaaggtggaggagggcatcaaagagcgtgcagtagagaggttaaggcctagacttgcagatgcgctcactcattgtaacagcagtgtgcaggcgagaatcagggctggcaggtgcccagggccctgtgctcagaaggaccccacacttggcttactgctctgctgctgccatcttgattcttaataatttttaaagaggaagccctacattttccttttgcactgagccctgcaaattatgtaagaggtcctggcaagacttgaggcaaagtttgttatgcagttgaccaggagagaaggcaataggaacttctgtccctttccatctcagcctttgcatttagcggtcttctcaacacgtgtccagggaagaagcaagaaataaaaaggcaatgtgtgacatttcccaaggtgcagacaatgccctgcgatgtgtttgttgtacaaatgaggctgaggcaaagcttagctgtgccccttcccgtcccctgacaccctcatctctcctctgagatcagcaaagtaagaatgagcctctcaggtcgtagtagggtgaggaggaaaacaggtatttttgtatgttcgttttttgttttgctgagatcacaactgccaaagaagagaaaatggttagctcattcccatagtcacacagttccatcccacccacttcgtgctctggtgctgcttccactttctcctggaacccctcaaaccccagccagagcctccttgtcccatgggtcccgctgcagggagttactgctcctgcttggttctgactcacggtcaggctctaactggcagctcgacccctagctcgtttgaacacacatacacacgtacacacacatacatgtgcacatacatacatacacacttggctcagggcacatgagggtttgtttttgtcaccatgaggttttccttccacacatctcagggtgcaccagctgcttagcaacaagctgttgggcagaagtgggaattaaatatctccctggttgctgcaaacacaggtgccaaaaaggaggaggagaagggtccgccagagggactgggctgaaggacaggggtgtgtgtctcctagacgaatgctcggagatggaacactcagggctctggtcctgtgccaggaatctcagaggcctgctgggaatggtgctccagaaaatagaatcctgacagcaagctgtgggcggtggggaatctgcagggatggctgatgacaggtggaaggcaaaatgtaagaattcctaaatctctgctgaggggacttgccttagcaagatctgggttcaggtcatcatcgtggccaccctaaaatcttccatcctggcttgtggttcttgcttttggagtttaagctcaaaagctccttctcctaggagttctacctctcatgtagcgtcgaggcaaagaatattagcaccaggattctgcagttggattttctaggttcacaatttagctcctgccgttgactttgtgatcttgagaaagttattttgaaggtctgtgccacagttttctcatctatgagccccacctcagaggactgttgtgagaattacattaaaacaggtaaaaggactttttgtaatgtcatctccaaaacagacatccacaatgctgaggacagaaggaagcaaagtaagctacctttttaaaagtgtctcccatgtgcctgacactgtacaaaatgccatttactcatgggatttatcttttcacacccatggaaactgaggcttacaagcaaagtgccctactcaaggccatgcttcagcaatgggccagagtttgacatggtcactgtggctctgtagccctcactcattcctcaagccaaactgcctccactattgcttttcagagaaaggggaaaaattactaatttatctggcatggggtgggggcgggtgtcaggatttggtggaaagagctcttccccagagtaacattttagaattatgatatgaagccagtataattaccatagcactccctggcatatggtacctgagatggggaaatagtaagccagggtcttgggaaaatgaaagatgtcatcaaggtacaaaggcaatagacacctagatttggagtgaaaacatggattccaccaagctccaagcaagcagaaggcctcatctctctggccacactcactggcctagaagactggggagtccaagggcaggaaaaggctgcagcctgtgctcagaggcttatggttttccaggataacacacaaacccctgcttccttgaccagtggatgctcacaccatgacatgcacatattcccgaagatcttttatggcaacagctcatacacgccctttcacactgtctgcactgctgagagctgcagggttcagtatggtagccacgggctgcatgtggttttgagcacttagaatatggctagcaggaattgagatgtgctgtgagtaatgacacatgtacctgcttcaaagacttagtccaaaaagtcaaatatctcactgataactttaatagtgattacatgttgaatgaatgatgtaatttcgatgtgttttgaatataatgggttcaatggaatctattattaaaaactattttttttttttacctttgtaatatggctattagaaaaattccaattccttatgtgattggcatttgtggctcatgatatctttttattggacagggctgctctcaaaggtactcacagtaggctttgtgtttggagagtgctttagcagtcacaaaacattggcctctctttatgacagaatcacagaaagccagacctggaacaagtacccttaagctgttttgttcaatctcctgatttacaggcagagaaactgaggcattgagaggagaaatgattccagtgttccaggtgccatccataggctgtcgcccacccggatctagtccttgctgcctccaccctctagagctggctgtccggttccttccggcccctcttgcccagctcttcccctcccttccccttcccacagggaaggctgggagaactctcccagtggaggcatctttattcatgaacctggcccaggggagcccggagagcctgtctgaaggctgctctgtgctttccctgcagactcagagagataaatatggaaatgtgcgagaagagcttccccatcaagactaagggctgctatgacatctaatacatacaccaggaggggtggaggaggcagctccagggctgcagccggcagagtctcctcagccccagctgggcccttgctcccccttaggcaggcttggctgacccctggacatctgcccaggctgggctttgtttctgtttcccacagcacctcctgtacgctgcccccacaacaccacaaaactgcacaggtgctggcccatctccagctaccatccagcccccaaccccaccccaggatgcctcccctgacttctccaacctgcctgggcttcctccttcaaatcccaagtgcctggaggctacactcttgctttctgaggacccattagcagcttctgcatcagagagtgtgcgctatgcaaaccccagcctcaacccaaacctgctgaagcagaatttgcattttcatgagatccccaggagatctgctctggcccacaccagtgagagcagggcactgtgtctggtttatactgtgcccactgcagtgccttgcacagcactgggctcctggtaaatattccaaccacagacagaatgacctttgctgagtccttgaggttgacgcagcactttcccggacgtggtctcacataactcccccacggccctggataatgctgagcggtcaagtcaagactctctaagcaacttggactatgggggttttggaagaggtgctggccccacgtgctcagtttctttgctgcctctgtctcactagaatgcatgcagatgtgatactagtagtagaattgagatgttgccctcttgggggtctgtgttcctgtattaggtagatgagaggtatgtagagtctatacagccccaaggccaaattgcctgagttcaaattctgccactaactaagtatgtgaccctgggcaggttacataatatccatatgcctctgtgtactcatccatgtaatagggacagcagtggaacctacttcataggattgttggcggattacacaattcaatatgggtaatgtgcttacatagtgcctgacacatagtaagtgttacaaagtttaattaaaccagtgtcttttttcaagtgtaatgttgaagactttgcagatttagaaccacaggagttggtagaactcctagggctcagagggagccaactccctcgttgcacacaagaggaaacaggcccagatggttgaatccctctcccagcatctcacagccagtaagtggcatgattggaacctggactcatgcacactgagcctgctcctccttcccacgccctacaggacacgattagaaagtagagcgagttccagacctggcgctggagtccaagctgcccacacaggtgtgagcgcctgctcttcattctcagtaggatgggaggaacctactagcaaactctccagagatttcccctctgccctgagatctagtctctaagttggtccttcttgaccgctgaggcaagaatcaggtcacattagctgcagttactccttagggaaaggaataatcaaggagttggggtttgggaggagagagcagcataggagggccccttcccaggggagtattttgccagctccccgttatccctcaaatgctctgcagtgaggataaggaagtgagaggtctctgatgccctggtgtggccatccttttgtgtgggttttatgttcttgctctttgtgcccatgagttctgactcttgttgcatcttgtggcaattccaaataagccctcccagattcccgcagggatctagtctttctattcttttgctaaggggctggtggggtgaagggatctattgccccagttgcccttcaggggagagggaggcctttaactcctcataacatctcatgttgcaaaatgcattgcttcgatggaaatattggttttgagcaaatttggactccagatgaccaaggttctgtttgggtttgacggtaataaaaggaagatacaggtataccaggatgcatcctacacatcctgcaaggtgaaatccaccttcctctcactggttgtctcagccgccttggctgggtttgcactgctcattaacattgggtgtgcctctctctgcctccctaaccacatgcagatcctggcctcagtgtctgcctttctgcatctctctgagcaccttgcctagtatctgccacatatggtgcacatagtggatgatgattgactgatcactcaatatattgttttctataaaagaatgaaagaagatcatttcctcttctggtcatttcctttaaagaatatatgtactctttaaatgttccttagttttcgtattattggctcatacacagaacacagccttgctgaaactaaaataataacaacaataataatagcatctttcatcggctgaatacctattatgagcccaacactgtgtgcacatcatgtgtgtgctttacacacatcatcctaatcctcacagctttgctaccagggtcatccaaagaagggaagcccaatgcccctaggcacactactgttcaatagtggaagaactggaacccaataccgggcattctgactctgttccaatgtcctccccattaaatcccaaaggtcccagcccagcagccaattctcctctatcctgtcccattttttgtatgaagaaactaaggctgggtgtgttggcttgcacctgtaatcccagcacttttgggaggccaaggcgggaagatcacttgaggtcaggagtttgagaccagcctggtaaacacggtgaaacccggtctctactaaaaatacaaaaattagctgggcgcagtggcacatgcctgtaatcccagctactcaggaggctgagggaggagaatcgcttgaacctgggaggcagaggaagttacagtgagccaagatcgtgccattgcactctggcctgggcaacagagcgagactctgtttcaaaaaaaaaaaaaaaaagaaagaaaagaaaagaaactaaagctttgaaaagattaaaaatcctttgcccgagaccaggtcccacatgtagtgaactgcagaactgatattcaatcccagacccatccaaccccaaagctcacactctccaccacagcatagcatccttacttctctacatgatgcatttcctttgtttgtttcttagtctgcaaccagatcttatcctataactgtggtggcagagatgggatcatgtggggctcatataatttggggagaagttaaagatattgcagtaacgcaggacaggaatacatttaggagaacatgttagagttggtaggaagcttcctctcctccagaaaacagaagccccaccttcttaggcaatgatcctgaacttgttcatttctgacaaatgtgttccacttctttttttttcttttatttttattgacacataacaattgtacgtatttgtgggatacagatgatattttgatacctgtaaataatgtgtaatgatcaaatcagggtaattagcatattcatttcctcatttatccctgtgttgggaacattcaaaatcctctcttttagctatttgaaatatacaataaattatggttaacaatactcaccctccagtgccatagaacactagaacttattcctcctatctagctgtaattttgtatcaaatgtgttcaacttctgcagatagaacatgcctggctctggctgccattgctgtcaccagctgtgctataatagctctctccccacgattccagacctggtggccaatggcattccagtagggttctaattgagatgcagccaggctcagtgttctcatcattgtcaccatgacgctgtgaaatgagttgggtgcagggtgaaatgagaatcgatcttggatagaccactttattctggaggaggtagggagatcaaataagttttagaaccagttgtgaaatctgctgttctacccacttcagttggagcgagtgaagacagtacgaagggagtggtctcattctagctttccccacagcaaccaagctactaccaagcaccttcaaagatcctcaccacttgcctagtttcaaattcagtgccatttaaaattaataaaaacaatctttccagtctagcagactggctctaaatggaaactcaccacaatttccaaagtgtaatttgttattgacatcctagtttcataacaaagagtaataggttggtggttcaatatttaccaggaagagaagtactagaataatcccctacccaaaatcaaaatgccattgacccgatttatagtgcaaatggtgtattagacagaaataaaaagagacttcatttgattttaaagtctgagtaatcagtaagtacccttcagggtctgtgacatttccaatggagatagaaatagggatagagagaccagagatagatacttaaacttacttataggtacagagatggaaatagagaaacagatatgatctagatgtagttgtatagacatagacttatgcatagacatagggatagagatagaaatatgagaaagggagaaagagaagagagagattcacccttcgaagtttgatcctgtaattaggacattagatacaaagggaatggtaggtgctttggtcaatgacaaatccaaagtcatgaaagtaacatcccttcttttttaaaaattttacttccagaatcagaaaaactaaataaaatattatagctaaatgaaatgttgaagcttatctgatttatccgtcattttatatccagggaaacgaaagtcccaagagacaagatgacgtgaccttagtcacacccagatactctgtcactcaaccagcatcttttcctctgcagtaaattgcttcctttacccatccgaatatagtagcacttataaagcacctacagcataccagagccttattcgagagcagtaaggatacaatgaagaacaaaatataatttcatccttaacatagagatgattctggcttttcccatggtgagcattcctttttttttttttttttgagacagagtctagctctgttgcccaggctggagtgcagtggcgctatcttggctcactgcaagctccgcctcccagcttcacaccatcctcctgcctcagcctccagagtagctgggactacaggtacccgccaccatgcccagctaattttttgtatatttagtagagacagggtttcaccgtgttagccaggatggtctcgatctcttgaccttgtgatctgcccgcctcagcctcccaaagtgctgggattacaggcatgagccactgcgcccagccggtgagcattctaatgtgaaggagatctggaaggtaaggaggttggatttctactgcctcattctcattttttataaaaaagcagaacttctctgggagttcatgacctttctggggcagtctgtgtaaacagagagatctggcctaagacataagtgaaaattgcttatcttgtcccgggaggcgaaagccccttctctagaaatttagttcaagagtaattttattctcaaatagatgtaattatacgagaatcacaggctaataatggctaccttttgtaataaagactgtaatgttgaagaagcagtgatgatagaaaatggaagttgtcacccagaggacaagggatggggcagctctgagaagcaaccttaggatctgtgagaaccctttgagggtgggggtgggcgagggtgtccttaacctccttctggagagcctacatgtggaaggagctcatgtgtcaggctgcacctacctttggcttatcacatctgcttgagggcagagaccagaccttctatcttcttatgcgtggttgcctctcctcactctccctcctgccctcacaaagctcagcatggagcccagcaccagttgggcttctgtgagtatctgttgaatgaaaactttggcagaaaacagtttttggactcaccatttctaattaagggaaaatgtctctcgtcttcccatccatgtgactaaagtgcaagtgctgctctgggctgattcatctcctcatgagtcatctgcttaagtagtaatgcgaatgggcttgcaggccaagtggtgagccttctgcagcacagccggcttcaggcagcttccagagcacatttcaacccttctactggtcagtgggtagatttgccctgtctctcaaggcctcgaaacgatctgtttgctgagtcacttgttcatttagcagacatttactgagcacctactgtgtgcctggccctgtaccaggcaccagagattacagcaatggcaaaaccaggtcattctcggccccgtttagcttacagtctactagggaaaaagggcacgaatccacaatcctgtgaacatttcttcacaattgtaacaaatgttccctacagtgacatgcatgtgtgtaacaggggtctgacccagaccaaatcaaggtttaaagaaggaacaggggttcactgggccaaggtcagcaaaggaactttcagaccacagcagcagcacggcaatggtcccatgactgtggcaggggagggagagccagcaaggccccagggagtgaaagcggccccgggacaagggagccgggggaccagaagctggacacagaggtggggaccagacacagaaaggtctctgaggcctggaaacagtctcgttccttcttctgagaacaattagatgctattgtcgggtgtgggaaggaaacttgaccaaacatgggtgtgcaaatttcccctggagctgtggtgacgatggatggaagggcctcagtgtagggaaagttaggaagcaatgaatgtaccactacaatggggtcctattcctgggggaggcctcatggatgtgaagagctgaaagccaaaaccaaatatcaaatgacctctcaaaggcatatggtcagcatctaagggcacatgagaccccaacactaaccttctgcccatcggcaggaggtctgctggaaaggcccgaccaccccacgtgaaggcctcagcccccaggacaaggagttagaggtgagctcatctgaacagctcctgtccttggtggttcccacagaaggtagacaagcccagtaggcctaaagcaaagagcagcctgacagtgcacgaggggccccttagggagcctctgagatacagtgtagccaaggaaggtcaagaccccggaagagacaggccgagggtctgtctgcagggctggtgtgggaggagaaggagactgcagttggtgctgggaagagccaaggctttgactcagatggcactgagtttgatcctcctgcaccccttagtgatgtgacctcatgccagttacttaccccagaaaaatgaccctcctgcaagtcctacccttgctgaaagaatcagctggggtggcctgtgagaaggacctgcttagagccttgttccacgagacacactcatgaaacaataactactgtctcagtagcagggcctgaagaggtaggtacaagaccaggtcatccagaacaggctagaagccactagctaattccagcagggtaaggggagataaccttggaggttgagcaactgtatttcagggtgattgtatttgtatattcataggccaggcaaaataggcctttgaaatttgagaacaaaagaaacaaaactgacccaagtgagggtgttttaaaagcaactatgtcttctgcgggattggatggcagacctctccaagactgtgagcagcggagcagtccaagaatactcttctggttttttgaagccctatttcctatcaagagctctatttccagcagactaatgggcagaaatctattctgaggtctgagggctgcccagtgttagccaggagctgggccttgggcagagccctggagagaggcatcctccgaagtagccttgctgccacccctcctgacacagcacatcagctgttgcatgggcaggggtgagtcctggccaaggccttgcttgtgcccaccccacccccacccaaaggttgggctggagaacttcttggggagctgcctcctccatcacattgaggcagtgaaccagggatctttggaggggagagattcatgtgggaaatgctgcaatattttctctggaaggataagctatccaggcagcaatggtgctggggagggctgggataggggtgcagaggaaatgtgtcactggagagaggcacagtgtttgtagatcatcactcagcctttctgtgcccacgctgggtggggccctggaggcccagaggctaatgtgtctggttctcatgcaccacctcttagaggaaacaaacattttgatattcacaactagatagattactgaaaagaaagaaatgcagagtggggcccactgtctgtagaaaaagctcctgccctggccaggaggaagctggttaaaccatgcaaagactcctgttgtctgcctggggaaagaaaagacctcaagtgtttcctggggttttcttctgcaggttgttcggttcagggacagggtatggagtacaaccgggagcagtcaaggtctgtgtaatcccaagaagtctcagactctgaaactctaggctatgatgaagaacaatgaattgtcagcagcctgtatattaggatggggggaaaggaccacatgcgaatattttaaagcttcaaactgacaatatcatgtccattacttttgtttgcagctccatacacttgtaatttatcacagtaaaattttatacttctttatatggtggtttgattaatgcctattttcccccactccttaatgctctatgtctttcttctattttattgccagcacctaacactgtccttgacacatagcagctgctctcaatgttgagttaaagaatgagtcagaaaataactcagttagaatctcagtaatttccttgcagtacatatgtgctgccagaaggtggcgaaaatactcagagcagagaatttcaagcttcagaggcaatggatgctaagaattacataatgcaacacatttggttgcttcatcaaatgtggagttaagtttatttcctcggctaacacttgattaagataaatctcaaggtgtggcagaaacggtcagacagatttgcattcaaatccagcctctgctgcagacagccaggaatcttaggcaaatgcctttgacctttctaggcttccacttcctcatccacaaaatggaaagtacaatgtcagattttgttatgaaaattaagtgagagaacactaatacacatacacacacacatatacatatacatatgagtgtgtatatacatttttaatttttcaacctcaaagttctttgtatctgtcatattatttatagattattactgccatcgaatattacttccatgtcaaaatttaatacaagaattgaaacaaaatacattgagttaaaaagaaattgaacaagagtacgcaaaaaaagaaaaatactgtgcttttcaggccctgttgtcctccaggagaagtaaatctgagttcaagaccctgaattcttcctaagaaattgaagggaatgcagcttcatttctctgtgatgatccatctagagttgaattattttgtcaaaataaggagcatgtccctagttagaaaaactcaaagcactcagaacatgataggataaatttcctaaaggaaacaacccctccagaaatttgaaggctcttgagcacacactcagttctaaagtaaacatgttggttgtaaaagtcagtatatagaccttctgcaagacacatgtaacttttatagctcaaaatttacaattgatttttctctcaaggttttttagacctaaattaatttttaatatactgacccaaggtgcccagttatttttagataaaactgtcaactatcccttaacctaaaagtaggctgtgagacataagatagttaaagcattacagtgccagaaacctacacgaatggaggtttcgtgcccactggtctcatgccaactgcacatagaaatgctggcgggtaaacagcactaaggggacttgggaacctgtccaggggctcgctctgctccactccaagtcagttcacaggtgccagccccacccaggcccctaatcacaaggcagatgaacacatcagccaaagtaccctctagaaagggaccaggaccactcatgcataaggcacaggaggagcaaacttgcctatttagaagttttcagattcaacattgtttagttcaaaactcagcgcctggcagcctgtcctcaggtaccaagcacctaagtagcattggggggtgaggggctggggtcatgctgagctgttcaaagaagaaggaaagtccttccctctacaactccctccttgaaactaacagctcatttactgagctttagtaatactttgccctctcctctgttctagttcttatcaagtaacatgaccaagtcaattttgagtaaagtccccccattaactgtgcagtctcggaacacagagacctcgaggtattgctctctgagtccatagcacccaagacgaggcccgacatgaataagaacgcagtgaattctgacgaataatgaaaaatgaaggataagagaagtgaaagatatgtttagggaatgagggaacataagagaacattgtcctttgtaaccaggaaaagatatgtttgatgaaaaaaagaaatgggtctcaaatgtttatttcgtgagataataaaatgattgttgtcattttaagccactagcttttggggtgatttgttatataggaatagtctctggaacagatcattgtgcctagcaatgggtactaccaaaatataagtaatgggtactttccttctcctggaatgcttggctgttccctgggccccatgtatagaatccttctgtgttaaagcatatcttatgtctggagggaaattttctaccttccaatgtgcttctaggtgcaggaggagtgggcagcagagctctgcaggacccaggtcaggatgcacagtgagaaagacggaccgagggctcctcgaggtagatagcccagagtgggcaaagaggccatctgtatgaaggctgctcacctggtccacttagcaggtgcaaaacttacgaaggaaaagggatatcaatgagcaacctcagtaatcttctatagaccttgtagtgcttgcctatagagcccagaacccagatttattcatccagaaatacatacgtaacttctctgctttaaaatagcacatggtttgtttttggttgtatttggggctttgcagttcttccttgttaattatcagaactacctgctgtttgtgactggcctaggcttatgtccaaggggactgaggccaccacctactgattccccatggccttccctccttgtggtctatgcttccctttcctccttgtgtccattctctgcctcccacacacccctggtgacagttggctctgtgaagaaacctctttatgtctctcaaaaataagcccagtcatgttctatttttaatgagttttaaatgtctgttctgcaaaagaaaagtccctgcaaaaagaagttagaaactggaacctcacccagggaggggataagtgtgggcccaggacgagggctggtggcaggagaaaccaggtctgggcaccctccctctggccctactgggcagcgatgaagccagattctcatatctagaggaacattgaagttcgtgtagcaccacctgtgtggggagagaaactgctgtctgcctcagtcctgttcctggggggagtgagctgagatgctgcaacactagcatcaggtggtgcttgttgaccgattccaagccccatcaactgaaagccacatgtcaccagcctcacccacaggaaacaatgagatgcctgtacctgagcacctgctgtgagaaagcctcccctaatgcctgcccttgcccttgacagtcaggccaaactgctctccaatgggtgaggctccgacaacgcccaggagcacctgtgatgccgtcattaggaacctacctcgtcgccccgattccatcccctcccgacacctgactgcgcgtgttctcctttgcagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggtgaggcccggggtgtggttggcgggtggtgggcacagaaggagaccccacggcagcctcctaggtgcaggccttagtggcttcttctctctctgctcgagccctgccagctgcacaccacgcctggacttctcctgcttctgtccccgctgcagcacagtgctggggaggtcccagaaccaagccatggggcccgtactgtcgtgacggtggcattgtcatctgccattcactcactactggatctcccacgaacctgtcttactgtgcacacaggatgtcatgggctgtttctctggcacttggtgtatctctgctctgcctcactccagctgcgcctagtggggacccgaggctgtcaggggctcccgggacatccttccaggttctggtcattccacagcaagcaggctttgcccattgtgtttgtgagtaacccaggattcctctgccacgccacccactgcgtactgcattcccaatgtgaaggtcttcttggttttcttctaatgcccggttccacttcagggccttccacttcctctctctctgcccagcatgccctcccctggcctctgggggctcctccctcactttgctcccatctctggtcttatcccatctcccagagaggtcttccttcctgcataccttcccaaatatgcccactccaccctcacaccaaagcaatctaacccttaccaagaggggttttgtcccaacatctgtccctgccccagattaacttgttgagtggaatatatggcagaatgcaagctctctgaggaggctctgccctcacggctgcatgcccagaacccagacccagcctggagcctggcaggcatgcaatagcagatgcatggttcggtagctttcctttgattgactgtcttagcatgggttcccacccctgcaccagccactctgaccaaggagagaaaggtatcacttgctgaaggtagagccaggtgctccatcctggagctggggggatgccccatccagacaccaagagctgagatcaggcagggtggatccccacaagaaaatgggatgattgcaagaaacagaagccaaagccccaagttcccctcaggactctcactctcctcccagcctcagagagaagtcacccatcaactccctgcctgggaagctggcctcgttcacttgcacaccctctcattccacatcttcagtctcttcttctccgttggcttctccccttctatcttcaatgcccactccctttcaaatatacccagcaaactaacatcttagttctttacttgtgttcccttcattcaattgaatatatattttttccagcaggttatcagaaaagatacagcacaataattctgaacatgtggcttgattttctcatctttctcactctttaatcttttgtccatcttccacacttaacttggctccctccaaggtctctctataagctccctacagagtaggtttttccaagttttttctcctctttgacttcttgtcatttcccctcattggccaccaaaacccttcctctccaaaacttttctctctaatccttgtcaatgcccttcagccaaagtccccaaggacatacccacacttacacaagttgactttattactgcttgcagtgagggaatcttggggcaattcagcaggagggtgttagaaaggacttctaggatctggactttgggagggtgatttggggagggttcggagaagcagaggtttactgtggattggttactgtcagggagtggggacacttctatgattagatacctaggaggagggcacacagaccaatgcaatgctcttaacgggtgaagaagcagtggtcactcaccatagcaggaagcagggatgcttggtgttttgtgtctgtgttcagacttaatgacagagtggtcttgtttttgccttgctccatcatggtcactggcattttgtgacattggttatgtttggtgtgagacctgactgtgagggctgggccagctcccggcagcaccaaggcccggtgggcagtccgggccatttcctggctgtcagcggctgcttttctttctcttagttcttccacgtttctccccatcacttctagctcttcctttcttctattcagagcttttatggattgatttctcacctgattatgggtcacattttcctgcttcgtgacacgtgtaataatttttattggttcctggacattatgaatgttgcattagagtgtctgtattttgttgtcttcatttatagagtgctgagattagttttgacaggcaggtaagttatatgtaaattagcgtgatcttttcgaggcagttttataattttaagcttttagagcagatggagagtaggttttctgtagtaagttagcccagtgcccaatttgtgaccattttggggttcttactgattttctcatacatttagtgaggtttctctactctggctggtgggaaccagccccatgtgttgtgatacttattcaggtatttaagtgaaagaggacatatcagagtataactagacagagaatataaatagaaaagaggtttccagaggactgaggtcctggggcaacctgatgtttagaggtgaggaacatgaggcacaatcagtaaaggagatggagaaagaattgccagaaaggtcaaagtaaaaaaggaaaagtgagaagtcctggaagggaaacacactgttttgtggggaaggaatggaatgtgcaatcatgtcaaatgctattgataaaagaagtaaaaggagaaaagtaatcactgacaattggaattggaaacctggaggccataggtgaaccagctgagaatagtttcagaggagttggtggcaaaatcctaaatagagcagcccaggagaatgggagaggaagaagtaaagacagtgactgcagaaaactcttgccagaagctttgctttaaaaagaagaagaatggacaacaggcttcctgaatgccaaggtatttagcaagctctttgcattaagaactagaatgctctgcaagcctgtgtgagcaccaagagttgttcagcttattgttcagaaacttctttgtgaacttttatcctctgtgtgcagcctagtttccagataaacattgaggagtcctcctaggcagatttctgaggctttctttctgcctggctccctctctggtcctctgccccgaaatttctggctatcttcaccttcctcctccaattgttgtctcctccagttggtgagtcagccctgcttgggacccttctccttgtgctgcggtccaggaaggactctgggctgagatcatagggttcatctactttgtttcccacctcttaggaattacagtcttgcactgtcagttgtaaagtctgaaaacagctatttcttttatttttatccagttttctagtttacagtgaaaggcaagtcagtacaggtccatcagggctggggaccacaggggcagtttcacacggagttccgagtctggcatgcccggcctttgtgatatgtaaaagtctgcatctgaaacggcccttcttggttgtcgtgttcacagtcccaattgtagggctgtgtcatggatacgattaatgagatcctgccattttcagagttgcttcctgaggtccaggagggacttcttgtgtttacatttcttattaccctgactttattaatagtgcacttgttttgctgccttcatacccactgcctcatgtaagggcttttgatttcgccttttaaaggccagggtgagagtggcagcttacatgtgtacgggccatttgtctctttttaaattccagacagtacacattccgtgcttttcctttgtgcaccactctggctactagactaatcaggaccttgtctaccaattatccacaaaatgaaatttcggaaagtctgcctcttttagagacaactttcttaaagtgttccatgatacatcaataccatctagctacaaaagtaaatacgcacaaaatattttatctcagtggacattttaacttgttaaataaagcactttctagttagtggtttgctctgattggcatttctaaaaacaactttatgagttataacttacagaccataaattcacccatgttaagtgtacaaattaaatgatttttactaagtgtacagagatatgcaaccatcaccataatgtaaatttaaaacatttttattcccccagttagatccctcatgcccaaaggcccgctcccaccccaggctcaggcaaccaacacatcactgtgtctccatggatttggctccctttctgggcatttgacacaaatggaatcacataacatgtggccttacatgtctggcttctttatatttttgagatttatccatgctgtagcatattcattctcttttgttgctaaaatagtatatatttttttaccgtatagctgtatcctatttgtttacagttgatgagcacttgtgtcatttccacattttggctattaataatactgctatgaatgttctcatgcaagtctttgtatagatgggcatttatttttaaagcacttttctaagaaaggaaataatttatactttggaaatttcatatcaagaattaattgtatacagttagttggtctggataattgaaatcttctcactctattctttaacttataaacagagtccctgctccacaactctccctaaactaacttcttgcagagttcaattttaatggtacaactggcttggttgtcttactagattctaagtttctaatcagttggccccacaattcttcttttcctaaatccccaaggctagtgctttttgactgtttcctgcacctagatgcagaatgtttaaaactgagcccatcatgttcctccctgaacctattcctaatccattatttctaatctcaccattgagccaccctttctaaccacttcctccagccaaaaacctggaagccaccccaaattcttctatatccagttggtcacaaggctcacccatatttgattatgtcatctcttattcaatagcatttaaggacttatttgaaataaagttaaattctttatcttatcctaggaaaactcggtgatctgcttctcatttccctctctccagcttcatctttcaacacttcacctggccctccctcctactgccccttgccccacatcccacgctccagcagctaaagctttttcatttgatcagtatttattgagacctgtgatgtgccaggcatcataccaagccctggacttacaggagcacgtgcttcctagctccatagaacatactctttagtggggaagacaaagcagttattttaataaaggtgagatgtattctgttgggggaaatggtatgggttgtcacagaaacttgcagcacaaggagtgaaactcctctggggaaagggaagctgaggcttggaggatgggtgggatcccgtcaggtgaaagggaggcaagaagagctctctgtcctcctgggtttctggtaatatcacctacaatgcttttttccccaaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgactttggtgctaacaacgtatgttcagtgcaactacgtggagctgtgcacacacagcaggtaggctgcaggtgtcccccaacataagtcagtaggaaagaagacatctgtcttcccaaatctaaagtaggcaaaaaataacagaagtagctatttttaataacagaacagaactctgactcttttgatcttgaaggaggcagaagagattccatcaaaacctctaaaagcaggtttgcattttcagaacatgcccccctagagagttgagttttttacacagcactacccggtagtactttctctgatgatgggaaggtctacatctgcacagcacgctagctataactgcacatatggctactgagcacttcaagtatggctagcgtgactaaggaactgaattttatactgtaattaagtgtaatttgccacatatagctagtggctttagtaacagacagtttagtgctatattatttattcaagtactttttatcaaattcgttttttaccgaattcgttttttaccattctttatttgtcttaggatcattacataacactaaactagggtctaa

SEQ ID NO: 183 - DNA, 890049 bp, Homo sapiens
gattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctttgggcaaaggaaacggaaaaaaaatgctgatcagtgtggttccatcactccaaccatcccaaaagttagtagagctcaaatgagccaaccgtgctggatttcctcccttcttccgttatcgcaaagttcaagggataaggaaaggtttctcttcccttaacctcctgctagctccgcgttccatgcctgcctgatctcagccagtgctttttccggagaagggcccctggttcagacagaatgcactgggagctgagcttcctgggatggagatgctcccagccaccgtgctcggtgacagtggctcatctctgaatgcagtgcctcggatttgcagtataccaagcaccccacgatacgtggctctgcgttctgccctaggcagaaggctccagttggggtatcttgcaaccaatgggcaccggtttaacaggattgggagttttggcctaagagtcatggaccaatgttgttaaccacaagatcaatggctgcccctattacaggaggaagagctttgatgcataccccaccccaaaaatctttgtgcctgtgaacactaatgagtatgcactaagtgtacactctgtcgtccaagctctaacctcggcaagtgtaggacatttaatttaataggcaagaagcctgggctcccggggatccaccaactgcactatatatttaaagaatccagtccgtcaaacttgaataaatctctggagctatgagaggttcaggctcaattcctcagctgcctctctaggcagagaaagggaagtttttccagctctgggacttcctaaatgagaaagaatgcaattaagccatctgtgttgtttccaaagatggtttatcaaggtccctcaagtttctgggcttgctcccatatcccttatccctgtcatgaagctcagaaatattacccatattggaacagttttactttttagtttttgtaatttgcactatcatggttggttagagaacagtaggaagattacttaccacatagggacctttctacctcactctccacccagttaggtcctagaggaccctgtgcatttatccccggagttatgtctcaagggaagacaattggacaaatgtggtgtatagaaaaatgttcacaactgagccagtgtttctgtctgtggtcggaagttttggagggccagcatctatagttagtcataatgccttataccgattgtattaaagtttgtgttctacaggaaggctaaagggatcatcctctctaagggagtatccaaagggccctggtttagaaattatttcagagaatatgtaggagccgttggaatctgagtttttttcttttacttcttcatctcattctcttccacctccttctttttcttcttctgtggaattgttcccgtggtgctttagaaaaagatctaagtggttagtaagaggaggtaaggcacagcgctgggctatttttctccaccttctagaacactagaggtcagtattgtcctaatgatacaaaggcgtggcagcaagctagctgtgttttcccttcagcacagctgcctatctgagaagagtgaatactttgaaaagccacaaaggtgggggtgagagataaggataaaaaagacagaacatactccacacgcatatggctgtggactttctaatgcaacaccttttcttaagagccaataaaacaaatattttagaatagcattttttgtaaattaattgaattatggttaatgtgttttaaaaatgctcataaaacctaaatgacatggatttaagactcatgcttatcattaccgatgtagtaataaagctaattctgaacatttaaaatgaaactttgtgataatgagctttagtattttatcagtgacagtttaatttccctatttccaatcaacattttaattgaatgctcactgcttgctaaatattttgaagtcagcgttcttaaggaataattattaatgatcattatgctgtacaaaatctattaattgaataatagaacagcagaaaaaaattagctctgaacttgatatattttggtgtcttcataacctatgatgcagaagctctaagaaatatgcattaaaattccacaattcctttagatttctactgaccacactctttattcattaaatataggacttgggtttatttttatctataatcaattaatatttgtatacatatactgaacattagcaatttattttcaaatagtcactttataaaagtttatttggaaatttttttacaagattattcttcctatattttgaagtaatatgtcgtgacatttgtgacagtagccttgaaaatggatttactaacccaatattttccatagtatatagttgcactgtggactttgttcaggtatacataacttctaattgtttttattattcttataataatatgttgttggtggttgttactatggtgtggtgtgtatgtgtgtgttttgtgtgtgtgtgtgcacatgcatttacatttctcataatctgaccgaaacctgggcttttaacttcaaaggaaagatgaatgcttgcccaattatagattttataagtttctaattaaacaaaattaaaataaagtcaggttagaagggccagcttcagtacagatattatgaatctgtgcagagaacataattacttaccagtaataaaaactgcagaaattccctcatttcagattttcaggatattaaatagctacaattcctcctctgggtttatcctgagggaattagttaacatcaaatgtagatatagtaggccaatgtttaatgaaaaatcattttacatataatattaactcttttgacataagaagaagtgatatgacttgatagttggttaaagtgaaactgggagttagaagagctgaggagttctagccctagttatgccacagctaagcgttcaaatacctattatgttattcaaccttatagtgctcacaggcttgagtataaaacagcaattgaggtatgcgtctactccaaaacagaacagcaggtaaatatgttactgagaaaattatttaaatattaagtatggtaagagatgattgcactgataaaatgtgcattcagaagatagcaggaatacatggagcacatatggggtcactattaactatttttaacaataagtataagttgtgcgattataaagagctttaattttgagcaatacatcactttgaatgatttccatgtgcagtatctaagtttgttgctacatattagggtcacacaaatacagcattgagagagggatcaaaaactcttcattctagctcattcatcatatgtagaatttcaactaagatatatgaggacttcaatcagattcataaagctcttcaaataaggagatgaactatactttgagttatccgaagcttatgcacaaactcaatcaatagataatattaaaaataaacaatcacgctggttttttcagcagcaactttttgtggcatttacagtcaccacaagtaaaggaagcactccaatgctcatttggaagagtcctaaagattttccttttgttgaattggcttatctttgacagtacctatgagctctttttcctttctcttcccatagtcccccatctcaaaactaaattgatatttctgcaattgggaaatgtataccaaaccctggactagcgatttccacacaagttcaaaattatgaaaaaattagttttattacgaaaaccttactctctccttgctttatttttgttctaatgaatgactatcctctaaattgcagttttctttctttttcctttgttcctctgcccaatttcattgctttctttactggatctcggtttccctttactgaatcactttatttcttaatgcccatttgttaaaaaaacaaagtaatgcgatatcatttgaaatgcccctgaaaccttcagttggtgattcagagtcttcgagttgataagccagaacttcactcaaatatttcctgtgtatacaatgataattatcccccttagatgagaaggtggagaaaagatctagttacctaaaatcccagaggacaattggaattcactcaataggactttattgaaaggttgcagtgtacatatttggagccaataatgacatttttaattcataagggaaggtttcttcattcatcaaaactctgccactttctggatggtgaccttgtagaggttacttagttaccccaatgatcttgctgtatgcaacgaagaaaatggattagatcattattattaacatcctatttacttttaatgtaatttgtctttaaatgctgatattgcctactggtcattttatttggatatttctgggatgattatattctaacattgtaaagcaattataattagaataacaatatagtagggttttaattcttaccaacttctatacacttatctctcacctcatattgtgtccacataaattaccaaggcagtacagctaggtatacttacagatccagtttacagatgagcatattcaaggttagtagaagttaatgatttcctcaagatcacagatctaaacaataaaaaatcaacatctggacctatatttatctattatcaaacaccaaactctttgcaagatatgaaacttactccaaaacattcactttgacactgtgtatatacatatctgtggaaacttgacatgggttctttatggttaatttctgtagctctacccatggcaaagggcatgagagtagcagttagcaccacagccaactccagagtcacatctaaaagaaaaaaaaaatggagatctagatttgatgcaaaatgctaaacatcacaatgaccaaagataagagcctcatctggatgagcacttgatgctttattttttatgagctttgatttaaaaagttgatagggaaaggacatagccttgatgaggacttgtgaatccctttcctacacatacagaaacacacagtaccatgaaaggcacatgttgacatgacgggttgtaagtctacagatgtcagaccaacaagtattaattaactagtagttatgaattccttgtcctagcacaggactggccctgatctggctctgctaaacctcatcttcaccactcctccaacacaaagttatgaaactccttcacattccacaaacaagctatgttgtttcaaatcttgcatttattttcatagactgcctgcttggtctagaataccctttttctttgttatcttctctcactctctccccgctatacatacacacacacacacacacatgcccagaaatatttttctcaggcatatcaagtgtccctatatattacatttccatagtattaacaatccttgtctcctcaactaggatgcaaagttctctgatggtcatattttatttgaaagtctatattcaatgcgtaaaacattgggcaagtgaaaggatgagagaataaatgattggtttcctgctaagaatgcttatttctaaactaaaattctctcttggctctattgctagagtattacttttaaaatttgttttatgtttatttttgaaacaagtacaactcattactgttttggaaataccaagaagcggttagctattaaaggaaagaacagaagttcagatcacctgattggatgcgggagctgaaaaatgagcccctgcagctatagaagctttcatatttccatgacttcattgctatgatggtcttatttatgtatcacatggccatttgttcctaacagaggaagcctctccatccactgacttcagtatcaagttggagccaattttattaacttgctttatggaattttaatgagtgttgcttatagaatctaaaaaaaatacataatcacattgctataaaaactattttatagcccaaggatcagtataaaaaggagaagtttgggttatactcaatggggctttattaataaattattgaaaagatctctctttttttattgcaagcctacaccattaccctgataacatgattccatgaatcctatgtcatctttttaagctgtggtcaagagcagatttaaatgttaatagtttttttgtgtgttatgcatttgaaaacattattttagaactacagtttctctttgctaaactcaagtttgtctatgaatctggagaaataataatgaataagaaaatatagtccataacctcaagaaactttgaacacttggtagttagaaaaataaacctttagtcatgtcagagtgataaatgctatgataaaggtaaacacggcatgcactttaaggcacaaaatgagcatctcatactggctggggcatcaaagtatgctctttgaggaaaaacaaattcatctaagatttcaactgtcagattttgctagctggagaaatgggaggggggcagttattacttggtagaaggatagaagaaaaaattagagttgtaggtaagcatgagagtcttttatttttaaagctatggagattcattgaatgtttttatacaggtaatgattatagtcagatttttttgctttaaaaaaattactctgtgaaggatagactggaatagaccaagactggtggcaagaaaaccagttaagagatgattacaataactcaagtgacaattagtaagaccttaaataaagaaggatagatatatctgaatctacaaaagttacacagcattggaaaaaaaaataatggccaagtaaatttaagacctaggcatatatgagctagtaaactcacagaaggtacagatttgtattctgcataatgtatagaatacattttacatttgtaaaatgtattctatagctgtttcgattgtttttgacaaatgagagggatagatgctagaaaaggtactcagttctctgaaatgaagttcttctctgggaataccaaacgaccatattctcagtgcagtatatttcatatttgcatgacattgtatagcacatgctgtctctatccatcatcctgatgcatcttctagtctgtaaattatgctggtttttgtcagcagagtgagaactagtcattaaggaatgtgtaattaaacctcaacatcccagttctcattccccctctgacagggggataaaccagggatcattactgctatcaggggctgctcagtggaaagagaaacaaggggaagttgggtgtgctacgctgatgtgctatcattggtaattgatttgctggcgtaaattccatgtctctacatttctaattgcttttgtgcatattcttgggggttgattaatgccatctgttcacaggatcagctgaattgatagagttttaaaggatgacaacagtaatgttgaagatagaaagaaagtgaagggaaatgccaaaacactgcttgtgagttatattatttttaactatccacctttagaagcagaaatatccttctaaaggcaatccaaagcaaatagcagtctaaagaaatgtgccaaacagactgatgttatgtaggtattagtctaggccactatttactgaataggtgggttcagttgtatctctgttttcccctccctcccttcttctcacactttcttcttctcttccccattccttttcttctatcttgtgaccatgtggtttgtgtattaccattgacttttccctgaggagatgattctctttcagatgtacgataaaagggtaagaagtctttgagattccagtgctgccttgctaaacaacatgggcatagtcatcaaaagtgaaacttccagacaagacctgttactgatgcaggccagacatgggcctggtgccacagggaacctgggaaggccccttgattgcaatgctccatccaactctgtccccaaacaacccttctgctaactccattaatctcctgaatctgtaaatatgggtagagttgtgtggggaagggagccttccaattcatatagataagctttaagacacagaaccccactgagtataggaaagcaaatctatactgtacttgacagagaaacagaccttttccagaaaaaaaaaaaagtgtgtgaaagagatagtactgggtatctggaaaagggaggataatgttttgaatctggaaggagaaagaacagggatgttctaggtgtgcaaaacaagtgttgctgctttcctatttttgcccaggctgaaaccctccctcatattacatggccaaaagtacagtagatggccaatggggagatgaaaaaggacagtgagaagggcatatgtcacacagtttgggattgatttaattctcattctgtgaatatgttctgtgtatactaacatgcaccttgcaaagtctgtaagtatgagtggctctgcataaaatacatataatgtggacatccaatcattatacctgttataattattaatgaaactcagcatggattttctcataataactaataatacagtgtagggcaaggacagctacatttccattttcaaacaaagtctggcccacttccccttcatctgggtaatcggatgggtgagtcactgctaagacaaatacaaatttgttctcattttatctcccatgtaaacagacaatgagtagagtctaccttcacctggcagagaaatatcaccgttctggatccctcacttagttcctgggttgggtcatagcataatcactgcttctaggccttggccagtgaaactgctagctgagaaactcacaaaaggagccccataagagtgggggaaacaagcttcatctagagaagtgaggagcacagcccctccaaaaaactgaagagggcaatggagaagatgtcagcattatggcagaaagatccttaaacagaccttaggtaaacccatgatcctgggaaggagtgtgtgtgacaatgttctcagctccctaagaccaccatttgcaggagattcaggcagatggacctagaattggaaagttgagagagccacattaccctcctgtgtactactgaagtctgtttctggtgaataaatggcattaagtattcctattttcctgttgattttgggttaaaaatcaggtactgcatcatgatgagttattaagacatgttatccacaagtcctccctcccctcccctcccctcccctccctcccttccttccttccttcttcagatatttatgaaatgcctagtgcccatccatttatctgtacacttctgaaatatttttgttcatgacaaaacacttgataagaagaaagattagaattgccatccacatagctccagagaaaaccaaaacaaaaggtaactgtaccatctcaaaggaaggtcatagcactgtgactcacccttccatcattcctttactcttgctccatgtatgaagtatctcttattttttaagtcttttccccctgctcctttattttcaatattcttccccaagttgctgatctgctttctttctaatcctcttttcttccttctctttcctctcgtctctcttccccatgttcttctactcctttcctttctatcttcttcctctccatctcttccttctacctcccttccctcactcttcctgttgcaattaacttttactaaatgtcttgtttttatgttttatggcataagttaatgcttttcaaactttccactgaagtgctgctcaccgggaaatagagtgcacgggaacccaggggattctatgagctcagcttcaaatggccactgaagcatgtaatttcttaaattttatcttcaacactcaggcaaatttgcattcagctccatattatatccatgtttatactataataaaatattttccccaaatccccaattaaaattgatgacccaagtttattagcttaacccatagcagagggctgcataatcccaggggcaaaggcttcagttttttggctctttctccacatttatgttttccagtattcctgtgtcacagagtcctacttcgtggtctctctcctcatctcagaacaacaggttgctgcatttcccaggatgaactctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcccaggatgaactcttaatctgtgaaccgcatattatcattaatcaataatggggagtaagaaggacttattaattcacaagggaaaaggaaacccacagactggcttagtgaacagaaactgttcactaagttttggatgagctgtgggttacaagaaaccccagtcccaccccaagtcttcagatactgctcgcccctgttacggtcacctgggactatgctgccacatccatgagttgtacctttgagtgaatgtgctctgtcagttgacagtaatggggtcaaccagggcagatgctttctgataggctgaaaccaccaggatattaaaagattaatgcctctgattctgcaacaatcaggaaccctttgacacaatccaaagaaatgaaaccaagcagattggaatgctggaacactggagattagagataaagttaagtaatgtgcttctttctcggcagggtttcaaacctacactctgtgccaaggttggtacttggtaagattttactctatttgttaccaacagtcctaagagacagttgttcttttccccattctaggctgaggatatactggcttggatggtgtggtaatttacccaagattatatagctataggtggtcacactgggattttaacccacttttccttggctccaaaactcatactttgaaaaattttatctgctgtttcagtgaactcaacacaaagacttagctattgttaaactccagcagataattcgtcctagcaaagacagtctttccctataatccagggtgagaaaaccctcatgtgtctagacccacagattctgccccaatcttcaggccatcttattccagtcttgcagaaggctccttccccatatctagaagtcactatgtcaaccagttcctgtaggttagctgtttataaaagttgcttgtattgctcactaaagcttttcaccaactttttgtggccaggcttcatgctttcactgatggccttgtggattccatgatcactgcccactattagtgtctgttcctgagactcctcctgtcactaagtgcagtatttttatcactacataatatttcacccctaaagaatactgcagccctagaatttgtttcatggattttatctttaaattctgctctcccatgttcattgcagcattatctacaatagtcaagtcatgaaactaacctaagtgttcattagcagattaatggataaaaagtgcacagtataaaaacacaacagaatctagtcaaccttgaaaaagaaggaaattctgtcatttgtgacaacatagattaacctggaggacattatgtcaagtgaaacaagccagtcacagaaagacaaatgctacacaaactcacttatatgtggaatctaaaaaattcaaattcctagaagcaggaggtaggatggttgttgccaggagctgtaggtgtggggagggatgggagatgttggtcaaagggtacaaagtttcacttagaaaggcggaataagttctagagatcttttgtacagcaaggtgactatacttaacaataatgtattatatacttgagaattgctgagagtaagatttaaatatttttaccatttcacactgtatacatatatcaaaacattatgttgtactccacaaatacatacaatttatatagaccaattaaataaacaataaaattttgtactaattagaaaaaccttattcctgacactaagataatagtttcaaacaaggtaattattggatgcattcagatctgttctttgtcttcacgctgcaagattcatccccaaatccagactgtaagctctttttacccaatagggatagacagaaggttaggtttgacaagtgtatacccaattccattatttttcaccactgattatcactgactagtgctcagtgatgggaccctgtccgactggcttcggaggatcccgttggtaggcaaggaccagtgcttgtacatacctgctttcattgtcagctgtatagaaaaccacagtagtaaatgctttgttttattctcaagttctcatgagtttgagaacttaggcctgctgcttggcttggttgtgaggcctgtctttgggtctcctgtatcttctatttcagctattgtcttgactcagaggacctgcttgcttgggtttagagaggcaaaataatttgttcaatgtccagtgccttacagtcttgcctctcttctgcatcaacaacgggagctatcaaaaaaggacacagagtattctgaggcttttcacactgaggcaattaatcaatgtagtgttctagctctcaaaaataattagcctttcaaggaatgaagccttaaatatttaaattttgttttaaaagcagaacttttggtttactaaatgaaatcttacatatgattttaatatgtaaaataaattacaagagcggctttgaagaaaatagaatgaagggcctagaatcctaccatccagcctgcccttcttctgattcttcatgtaggtaccgtgtgaagacttctgccttattcttaattgcaggaatctctaagcctacaatttcacgcaaaagcaactaggtacaagaacatttgaggaagagtggggatggaatcccacctcagtcatggtccatgcctggctggtgcacagcagcagagccacactgggtgtgccccacctgcctctgcttgtattggtccgggagctgatgtccaggctgggaaatacttcaaatatgatctctgccctaagttacactaaataagcagacgctttattctaaaccattgtaaatctgatatatcttgctaccattcatatgagtgtcagggcaagacaatcttattggaatttactgatttgaaaagatggtagcttgtcaaatacttgtgtccttatcttgatatccttagtttgtggttaatagctgtttgtattttaaataactgttttgtgaaagcgcttgcattatctacctgcattccaggcattcccttgggacctcctccaaaaaaggaatctcatgttagctgtgattaaattgcccatatatagcacagtaaatggcaaaataactacttaataaattgaattgaagcacaacaggttaggtgaaacccaagcatagacagaaagcctggatgagggataatacggggcaaacccctgagtgttggcttatagtgcagtgctccctccaccgcttcaagcctctgtctcccaacatctgtgaaataaatggacctttgggctccatcagcgaggctatctcagtgctccctgatgttaagtaatgtgagtagaagtgatgaaagtatacaaattaaataaaattgtcacacacctggattcagtcttcatttctgattctggtcagaatattaattttaaacacatccttgagtgtttacttcgggtgccattcatcacaaaatccttttatttaggtctacactgcgctctctcctccccccagtgaatcccaaatgtccctgctttgtatgggtaataaaatttaatatgagcaataattaaatataggatggtatatttaatggattactcaaaataatttactaatattaaatagtatgcacacatatatatgcatgctcagatttttaatgatttatttttagttttttttcatggttagtgcacctggtggaattgtacatgtgcatatccgctatgtaaaccacttgttctggtaactgtcaagatttattatcccccaaggtcaatattgacttaggtgtcacctttgtgaatatttacctctctagatgatgaattgaaatggtcatttggatggaaattaatatctacttattttctgaaatcaaatgctgttgggaggtgtgcagacatgctccaccgtgtctgcttgtttcagggtggcgttcaataatcattctttgcattctgatttactgtggttatttttatacctctttcacatggttcttttgcctaacagatagactgtgaacttcaaatgtattcggcttgacatttcaataccacaatcaggagatcgtgatatttgatcatatggatagtaagtacacattggattagtgagcaccttggccttggagtttatttagggcaagatactgttacctgaaaaacacaaagctccttcaacaattatctaattatataaagaatacaggaagagacataaaattacacagtagttcctttggttttgaggtattgattcgtcgttttcagataaccttacagtatgccatgtgttttgtaaatataatgtgtttgtacatatatatatgtatgttcatacaaatataatatgttcaattctgtgtgcctgtgtgtgcctgtgtgcctctgtatgcctctgtgtgtgtgtgtgtgtgtgtgtgtgtgtgtgtgtaacagtgcttacttctttactggcagaagacagagacatctttggtagagagcttttaatatatcaaaccacaaattctaaaattgtgagactacaatagaaatatttcctgttgttcttattataactgttgcattaattttgcgtactgggtcacaatatatatactgagaaatgttcaaccttaaaataaggcatttaaatacaagtataatggtgacagttgctgtattttgttgtatatgagtggaattcatctatgcttttctatacaaatattcataggcagtgcattcttggttttgtcctttacaaacaaggagtattagtttgtcatccccacaaatctttcctagccatgaatggtctgagaaaagacctggacttaggcaaacatatcataattaagcacagactgtggcttagtagtcaagggaatcaaccactgtaaaaattcattagtaaagttaatccaaaaaacatctgagcaactgaaacaaaatcaatcctaggggagaatgcataactctattgatgttctcacccttgttgatacattgtttagagtaaagatttctatgtcttctgcataaatatcaatttttgttggcaaattcaatttgacttattgggttcctatagctaagtgttttgtggttcatcaggaaatgatgtcattttgtgtatgaggaaataaaaatacctcacttgatggccaatgaaagtctcattttacacaccatccactgcttttatgtgctgggaaggtttgagtcctagaagaagccaaagacattgggtggtttcttcatgcattatttgcatgtgtataggcacacatcctacacatagcaaacatatacacttactgtcaattagtttagtttgtgcttctttttttaaaaaggaattaacgtggagtcagattagtggttttcaatcagatgtaactttgccccaggggacatatggtagggtctggagacatttttggttgtcacagcttgggggtttctattggcatatagtgaatagagatcagagatattggaaaggaacattctacaacacacattgtattatatgttgtcttttgtctcccacaacagataattatgtagctcaaaatgtgaagataatcaagggttgagagactagtttagatctattagtgatttatgcatcatgatgtgtcaaattacatatatatatatatataatttgagacagagtctcactctgttgcccaggctggagtgcagtggggccatctcacctcactgcaaccaccatctcctgggttcaagtgattcttctgcctcagcctccgaatagctgggattacaggtgtgagacaccatgcccaactaatttctgtattttcagtagagaagggttttcaccatgttggccaggctggtcttacactcctgacattaggtgacccacctgcctcggccccgcaaagtgctgggattaccggcatgagccaccatgcccagccaattaaaaatttttaaaagaggttttcttccagcatttagacttatagagagatatataaaatagaagagaaatatgatgacatatactttcatcctggttctgcttactggctatataaattccttttcattatttcacaccttttcccaaaaaaggtgatgataccctccccaactattttctattgtgaataacatgagataaagaatatttttaagaaggtgtaaccatgattttgctgaaatcatatttattatacttttcattatttggaggagtaatggcctggctgtactgtcctcataggctttagacagacaaggataacatggaggacatgggcacagtgcaaagagggactgagggtacatatcctggacttggggtacgtatcctggactaggaactgcaaaggtaaattttataccagttttaggttttcaaagcatttttaaggttggtttaaatttctacctctgtttaaaaattatctggtcaggacatcttttggcagggtgcatgtgctataatgcaatcactgaagtctgtttatagtaaagcacattctgtcaaattttttctttttgtagaccccctcttgcataagcgtaactctctatcatctatctatctatctatctatctatctatctatctatctatctatcatctatgtttgaaaaatgggataaaaactaaaggtgccgaagttgcctatgctttggaggtgacgtaactacgtgactcaggaaaggccatgaaccaatctatttagatgacactctctaccttatttagagctcaaagatcagttagataataatcctggctttgattgcttatcttctccagtccaatattcaatttttaacatcaattacattagaaatagtctttaatttgtcttttcaatggaaagaagatggatggccttggtctctactggatgtctgccttttgaaaaaggaaagtgataaaatcagaagtaagagactgctgggttgggaaaaggaccttggaagtgatgtagtccagcctaccctgcataatgtatatagatcaccacattccctaaaacattccagatagttgactattctattttacttaacctcctaagtgaagaggtgggacctcacaagacagctcagttcctcaacaaaaattatagttggtaggacattctttcttccactgtacataagtctgcttcaagtaccaccaaaccactctccttagctctactcactggacatctcaaaccaagccttctttgtcttcatcataattattccacaaatacctaacgatagccaccacacttctctcaatcttttcaatctttttatatcttcttttacttaattttttctatgacatgattcctttcccttggacttcccatcatcatgttctcctatttgtagtgtattccattttgccaatgttttctttaaaatatgatgtctggaatagaatgcaatcctgatttgtgcttaccaacctgtgtgggctacaatgtgatggtcataaggaatcctgggtgggagagaagattcagtgaagtttacaacaacataaacctcaaagtctaaaatgaaagtaccaaaaaattgtgttgtggaaaggacattgtctctactttctctcactcactctttcacttacttggccctcaactaatgtaaatcagtctctttacttttttcagggataactggtacaattttgggtttctcccaaattaagtgaactttgaactcacatcttacctttatctgcccagatcttccccatgggccagttcttgtcctctcttctctagtcttaattagtatgactgtcctctaaatccttaatgcttgtacagtatacattacatctttaagccctgtattatatgctgtcttttattggcttccacttctattttcattcagagtacattgaactgcaatcaatgagaagaattacatttaatatagcctctgtctatagcaataggagtactgcttacggtgtgccagatcttatcattgacatacattactactaatctggctcatgaccctatatggttaataccattattcttactttttagatgaataaatttatgtttagagtgtccaagtaactttcttaactttatacaattattaaatagtttgcctgaaatccagccctggtctctgaacccaaagtactgtgtcctttacgctggagaaaagatttcacaacccaggtaggatgtgagctcctagcagtttgtcaatatatcattctaattaattgggggaaattgtattcattttacaaatatttttagaacaccaattctaaaccaggaactggtcttagatattggtaaagaaagacattcaatttctgaatataaaccatggctattttttttcaaactgtggactacagagagtcccacaggtcttgggttccaccttcccacggccacccttatggaggtgatgatttatattggctcttttctgatagttccccagtgtgctttttctcttgcttaaatatttcataaagccatatggttgcttatatctcctcaactgtcatgatggtggatgctgtgaaatgatcttggcatgtttgaggacacatatccttcaggttgaccttatctcagaaactaaacttcttaattgtagctgtaatcccaaccccgccacagacggaagcaatggtagtgaggaaacacacacacacacacacacacacacacacacacacacacacatgaataagtgaggcccatcttcctggaatgtcaatttcatccaaagagtaagaaatacacattatgtgtatatcttaaaaaatacaaatatgttctggagtagaatacaaaatttcaggaaactttcaaataaaacatgagatttcaaatatgtctctggctccaaaatgtgttcacagaaacttgatatcaatgaattcactgttttcccacttcaagatgcctcagggaaaaagcaaacaagcaagcttaataacaaatacccctgattcaatttctgtgggtctaggtaagtcttccacattggccttcatttgaaaataaatgtctttcgccaaactttgattttcttttcttttccttttttttttttttttaaattttgagatggaatctagctctgtcacacaggctggagagcaatggtgcaatctcgttcactgtaaactccacctcccaggttcaagtgattctcctgcctcagcctcccaagtagctgggattacaggtgcccaccaccaggcctggcaaatttttatatttttagtagagatggggactcaccatgttggtcaggctggtcttgaactcctgacctcaaagatccacccgacttggcctcccaaagtgccaccgcaccaggcctggttttctttaagccagagttactagatagtgttacaacacagaatgatgttatagttgtatgtaatgtcttatctcttaacaccctccgattttaaaaatgcactgtgtagacaataataatattaataaccttctttttattctaatgacagtttttagacaatctctattactggctttatgtgttggggaagaaggtagaatgaagtaatattgacagaaaggccattcctccacttcccccttggcaggcctctcacagagagtcttgctatgggtgccacattaggacccttaaaaattcacattctttgtttaagaggtgttgtgaatcccctgaaattgtgcactcatcactgtgtgtatatctgcatatttgcatttttcttggataaaggtatttatatttcacccaatttccaaaacgcatccatgacccagaaaagatgaagaaagaaaggctctgagatcctcattaccctgaacatcctcagggaggggaggaggggacagctttattctagatgctggaaatttaacctaaatgtgcctgagtggtgtgcccttttctagcacctgacggagtgagtgtgagctctggggtgctgaagagagtgggaaagagccccccaaaagggaaaaagtcttctagaagataaaagacaatgacagaaaaggaaaacttcagagatgtcacaatttgccagtggcaaagtaggcacattgcaaacaatctggaattaataggaatgaacatttttaatacaaagaatacagattttgaagaaattactcagagcctttccctttgtcctttcctccacctcccctgagatctgctcacaaaagagagaaaaaaaaaaaaaaaacagagaataacaggttaatatctagaatttgcaaggctctgaatagccacctgacaacagccgcctcctgctgagaaaccactgaagcttaatcattttcctttgcatcagaaagaaggtggctgaagtattcattttttccttgaaatgtcaggtgcccacagcaattaactaatcatgttcctaccaggtcaagttgcaagaaaagaagacgattgggtttttaatgctaaggggacattttagacattttcgtacaagaaaagaagacaattgggtttttaatgccaaggggacattttagacatagggattaaaaaatggtttcataatgacaaaagctccactgacatgcctcaacatcccctgagtgataccatgccttgtacagaggaagtgaagaaaggctgaggctggactgggaaaggagatgtagccttgggcacacatttttttcttgagtgaaaacatggccttgaatggccattaaggtctccaattgtaagaaatttctttgatacagaaatctgagaaattcctagaacagctttgagagagcggcttgttcaaatgatccatcttaagtatcaatcacagcctaagaatcgagtgtttactagataacagcaaaaataagaccaagacaagtgatgaggatggcctaacatttatccaacacttactacagactagaaacaataccgagctatttacatctattagtgccttaatcttcataataaccccacatggtaaaatatgctgaatgtttacaggtaaggaaatagaggcaccgaagggtagtcacatagctggaaagtgaaatgtccactcagggagactgcctctaggacttacagtcttcaagtcagaaggtcagtgtttagatccttattttacagaggagaaagtgaaactgggacaggtgaagtatcttacccaaggcttatcactggtacacagagagcttggacggatctggccaaagccaagttctgtccgacttcacatacattttcccattcaacatcacttcacatgacctgcatattgtgtataatcatattggaattcatccctaggagagatactggattctaacactggtgcctaaacccaatcaagtagtaaggctgcagcccaactgaacctcattaattctgttgctctggaagcactccacgcctcctgcgatgacctccatgttatctaggttttctctgtgtccctggtgcatgaaaaagtgcagtcagtgactcagctgtaaatggttcaaggtacagactccttactcagccctcctctcttttttcagctctatcgttccttgcactccatggtatttattgagtgtctgttgtgtgtagacagtgttcaatagtggtaaagagctagtacctgccttcatgccacttagacccaggatcagggaagcccagagcattgtttctggtgctctcagtgtctttatactgctcctctagcacaagcatgcacatgtgcatacacacactcaggcacatgcacacgcacacacacaggacttctttgcttagctccgtcataaacatttccaagctacactgaaacattcatttctttattttatttagcacgatttctctgtgtctctaacacattctgcctgttttactagtattcttgtcatatgcatatctttaatcttccccaaataaattgctccttgaagctagagacacttgctacccatctatgttgttctgtttaaactggcagcatggtgtcatgggggaatgctttccagaatcaaacagaactggagttaaccagctctactctaggaatgtcagcttgagtaacctcttaactatcctatttcctgtcagtaaaatgtgagttcttttcttcctcgtatattttgagcacattcttgacagttaatactgatatgccatttaatggttgctctttcctttgcgtctccatttagtaagtgtccatgaaagagttttattggtttctcccaagatattacctgataacattttgtttgtttctaatttctgtttagagatttgttaacttggttggagtggtccattggacatttgagggctctctatacactttcttaaattgtttgccaaattgtttttgtgccctgttgcattcatcatactttcaaaggaatacaaattcaaaaatgaaaagattaatgagtatcttttttgttggtaaatatgctttctttttaggcagtcttttattccccctttaacctgattcacctagatggaagtattgacagtgtgcatgctcagacagggagctagtgataaacggggtcatccaaggttatttgagtccccaagaatgctaaccattttggatgtcctcataagtatacagcagaaattggacacagtgtccttgaagaatatcactaaggcaaatatttacacacatttatttttatgagtgttatgcaatacgttaggttacatcaaatgcaagtttgtttttctttctttaatggcaattttctccaatgcttttgatatatcaatgtgcaagggaggatgtctaaaactgggatagtatagtgcttcccccatttgcttagccaaatatctcatctcacgacccaggcttgctgctctgcagaggtcactttgagaaacgctgatttcagggctttttgctttatcactgttaacgtccctatgatctccttcatttggtaccacaacaagactctgagtttttgtccttttattccctttgaatgtctgcggcaacaaggaaatgaggtgggaaactattcattgccatcaggaaggcttcatgttgctctgtgtctctggaggctgcaatacgaatgcctcagaaaggcacaccgcttactcacatcccaagagacatgcagaggtggcagtagttcctgtctaagtcttaaagatgatgttcttgctaggaatgattctggtgttgattttcaacctgaacagtcaaaacttttatgtataacttagacttttcagtatacagaactatattttttaaaccataataaaattatcaggcctactttacttcctattagaggaaaacaaaataataaaaattaccagtttaagggtcaatgcatctgaatttaaacacaggctctatcactcattagccttgttaccttctgagcttcagtttctttactgtaacatgaaggtaatgatacctaccccgatgattaaggagagggctaaagaagctaacaattgcattatacctaaattaatatgttttggcttctataataaaataccatagcctaggtgatttatatacaacagaaatgtattttttacagttgtaaagcctggagaatcctaatcaaactctgagtcaggcagattcaatgtctaatgagggcctgcttgcttcttggtttatagatagaaacttcttactgtaatctcacatggtggagggagcgagaaagctctctggggtttctttcttaagaacactaatcccattcatgagggctctgccctcatgatctaatcacctctcatagtttctacttcctaatagtgtcaccatggggatgaggattttaatatgaattttggggtacacaaatattcaaaccatagcaataccttaagcatactacttaatatctagtagctgttcactcattgatagatattcttaatacaattgttattattaagaataaagaaatgggctgggcatggtggcttatgcctgtaatcccagtaatttgggaggccaaggcaggtggcctcacttgagcccaggagtttgaggtcagccccggcaacgtggcaaaaccccatctctacgaaaatacaaaacattagctgggtgtggtggtacgtgcctgtagtctcagctactcagaaggctaaggtgggaggattgcttgagtccgggaggtggaggttgcagtgagccaagatctcaacagtgcactacagcctgggagacagagcgaggccctgtctcaaaaaataataaaaaaagaataaagaaataactagattttgttagcaagatcttagaaagagaaaggaaggtcgggataaggggcatatctactccacttctgcactttccggggtgctccagatttcaaaattccctcatgcctgccatcctgttgactctgcccctgcctctgtgtgctgcagtccctccttacatggtacctttgacacactggcaggtgagctgagcagtttgggcacctggttcctctaggatcccagaatatagctttgtactttgatgaagaatacttctgactgtatttcaattgatctgaaatatcagtctcacacactgtttgcagctgggattgcactttgcatactctgctcagggcactggcaagtcctgaaacaaaatttatagtagggaccagcccagagacatcctttcttcaaagtgtgttagtcctgaatgaaataggcaccaggataacatctagagtgcttaatctcggatgtgtagagaattttcctggactgtagcatgttaaatgtccacagttaaaacctgaaacagaagtatattcaatcattcggttaatctaatattacagatggctgaggtgggataggatcagagataatgacatgtgacaaagtgtttcttggtgatcttccagcctatttgaacatctgcaatagtttgaggccttaaaaataaataaacttagttttctttccatctctttcctcaaaaaaaaaatacacacaaacagttctcagagataaaaagaaaatgtctcatcagttcaacaggtggtctaaggtttgcttgtttttagataatgatctgatgcaggctccactctaattgacagcatggcctgcttatgagaaggtctgcacttgtttttcccagagtatttgatgctgctgtttacctctaaggaagcatgttaataacaagggcactctagggtgttgccaatcatgcaccacatactggaaatcaatgttgtgtctagtgctgtgctaggaattatagacattaaaaatggcatatgacaggaatcctgatgttaatacaatgtccatctcttcgtgatgccaagcctaatttcagcactaaattatacgctttgtagcagagaagcaggaagtattaagaagagcattgatggtggtggtggtgggggcttacatagatttgaagttgattccaacccagataacctgcacacattctcctagccccagtttgttcacttgcaaaatggctatagtggtgtccatctcacagagctttggtgaatgtcaagtgagacatacagtttacctgcttgacacagcgtagtcactcaaaactgctagggtgattttgcttgatttccttctgctacagcattccttttgccacatgaagtagaacaaggtgtctcaaactatctgtgataaaggaccaacccctcccaaatctctctttctggctccatccagcacagactaatatttttgtaaaacacaaaaagatgaactactagaaaagtagaataaagaaaataacaaagtcaaagaaaatacaagccaactttttactactagattccacatagatgaaatgatgcatctggattgtgacaggtttctaagtgcttatcctcacattctgtacctattttatcctggagtggtgacaaaagtccctgggcccacactggtctgcagataacatctggagtagcatgaactggaagacagtgatatgatccttaaatttcatcagattaagattagaaatcacctagttactttattgaaagtctttacttcaagctagtattgactgaaagaccaaccttcatctgcaaatgatagtaaaaactctgacccaggggagtagtcatacaaacagacatcaaggacaggagcgaggaaatgctcagatgtgagttaacaggacacagcaccagagttgaaggaatgagaggcagcctggatgtttacgttattccctctcaaccaagggtcccaggatttaaagcagagaggaagggtaaattaatgcaagcatttgcagtgcagaactttcagtgtttgatagatttccattccaaagttcccattcaacaattattactaacccttttgctttcttgagggggtggagataattggacttgtgttctgagctttcagctcctacctcttactgcatcttccccctgagttcagaatgatctatataaaatggatacctgtgcgcgtctctcctctcatgcagcaaataagaacctaagtagcctggttttggctgacctctctgaactcagccctcctttgcagctctgaaattaggtctgcattttgtattccaattattctgaactcttggcagttccctgcccacatgtcatttttccatatctttgtgccctcctttgctaatgccattttctctgcttagcccagtatcaacccctccttgcctggctgacttctatttatccttcaagacatggttcagaaagtcgtccagaaagtcttccctggccctccctcccccgtccctgctctgtgggcccataccttcctctgcgtaccttgatcactgaaccagccacattattcggaaaccatctgtttgtcctcatttattattcatcagcaaatgcccaataaatgtttgagaactgtctataactgaggtagatgtcctggctgcgttgagaggcactcaagaacaaactgttaaggacaagcagaaaactaaatttattgtgcaaatttggctgaggtgaagcagaaccaaaaatcatcagattcagccactagaaaagtgagaaattcataaacaaggtaatctctgtattcacctctttctatttatttgttctgcttcctttttctgatagaaactaaatacttgtacatacattttaagtgcagccatttgagcaccagcccagagagcatcaaccacgaggacaaaggtttctgtcttgagacaggtaaagaacatgagagacatgaggccccatctgggggcagaatacctggcttaaattggagttttggccttgctatggataaactcaatgaacatttgacctttctgagtctctgagtctctatttcttcagctgagaaaaccatggcaataacgtatgtcacaggattactttgagagttaaatggcatggtttacataaacacctagtacagtgtcaggtacaatacatggtagctattatgatcagaggtagctatttatgttctgtttgaaagcttgctcagtgttactctgctatgcaatttctcacatcctaatgttgcattactaggagatttggggcaatataatccagaaggcccatgaaagcatatctctactcaatgtaaaaccagccctagaaattataacaagcatctgatcttaggaaatgtttcttagcctgccgcttttaaagatgctggaaaattctagtttctccaagttgtggcaggccttggaacccatgctgaggaattggaatgaaacaaagtgaagagaaagaaagatgtcaacatgatttactggaacaaagtggcatcgtattggcactcaatcaagagcatgtagattagacaaggatcgacttatcacagttacagatcctgaaacaatttgacttgaagaacaccaagaagcaaacagaggccaaaaaatccctcaattcaagcataaaagagacatgtgttctttgccctcttctgagaaactatgtgcacttggctttttgtctggatgtttgggttggttgtctttttaaactgtatatttgggtgaggggagatatgggcatttgggcagtgggaaaatgcttatggcttttaaaggaatatgatggaaaaaatagcagtgttaaaaatgtattttttaaaaattagagctgatgcactcggatccctaggctcctagggtcctataccctcactctcgacaagggtggacctaagtcatacttcaaaagaagcaggagcctcagggacttgtctactgagagcagctgtcaatgtcaccactccacttccagcagcctggttgaaagttgcccgaggcaagacctgcagaaaaaggagtcaaaaagcatgaggagagagggaagtaaaaaagaaattaagttctgtgggatgttattgctgttcaaatcccaagtttactatagcagatctcagccccgtggatcttggtaacccatgattactcttttcataattccaaaagatatggaaactatataactcacagcactcaagccccttcctgctgttcgttagtaaaattgcctaccctcacctgctctgggtgaaagaaatacttgccttttctatttcccttcctgcaacagccctagaacttttttgattttcaaaaattattccagctagcagggcaaaaagagaagctctctctactgtacacagaggagctctggttgggaagttcatattgatgtacttccatgaattgtgtccctaacagagttttgaactggagccaaatgggtgggagtctgggctctcacccctctgcttcctatctgagtttccttagccaaaatgggcataatacccatcttgcagagtgtgttgaagattacacatactgtatgtaaatatatctgcaacacagacaagaagccaaccaaatgtttcctttttcctgacatcatgagatacagctggatgtgaacatctgtaagcctaagaaaggatgcttgtgaagccaatggtgacattttacttttaaaactgttatcaagagataaagtccaacttcttcatctggtgtggagttctttccagaaactaagactcatttaactctactttccaacattccctggaaggatccctgtcctcctcctcatctcctccaaccccttccgctgctaagttacagcatgtggggaatgcttttttatgttctctggttactccttcttcttggatagctttcttccccttctctgccagcctatatcctgttcaactttcacagttcaccccaagcctcacatctttcatgaatactccccagaatgttctcgtccagtgactccttaccagtgggatatgatcacaggggctgtcaacagtggctgtcagttgctgagagttacctgaccatggaaactgagagaatcccaagtctttgtccccatcctgacctggacctcataagttgcccagccaggtttctatgaccttgaccacctacaatccaatatcctctgagggattactccaactttcatttcctcgtgtttaagcccttctttttagcaccagactccattattttcagactccatatttttcctaagtcatcaagaagacagaagccatttgcctggcaggaccttcgtcatcttccccccatttaacaacatacttatttctatcctcaattccctctcccgcaccatccatgtccactgccatggctctgattttgactccctctgtgactgtaaaagtaaaacacctatgcctctttcccttgcaccttcatctccctctctgctggctctttcccatttgaattaaagcatacttctttcccttctcaatttcacatcccttcatctcatgttacatttcttttgctttcagagacaaggttttagaaaaaatcatttacatgcagtgctgttattctacctctcttatatactcttccacttattggatacaagttcgctgattatttcatccactcaagtttctagaaaggcttccaaattagagagaagctggtcggaaattgaccatctcctctcactagccatgtgaacttgggcaattacaaaaatctcttttctgtctcagcatcttctatacaactggagtgatggccaggcacggtggctcacgcctgtaatcccagcactttgggaggccgaggcgagcagatcacgaggtcaggagatccagaacatcctgcctaacacggtgaaaccccgtctatactaaaaatacaaaaaaaaagaaaaaaagaaaggaaaaattagccggctgtggtggtgggctcctgtaatcccagctactcaggcggctgaggcaggagaatggtgtgaacatgggaggcggagcttgcaatgagccgagatcatgccactgcactccagcctgggtgacagagcgagactccatctcaaaaacaacaagaacaacaacaacaacaacaaaaactggagtgactactcctgccatgtggtcatgatgagaatgcaaagtgataacatacatggagcagaatgtggaggtcactggacacatcgagtcattgtgaatcagtcatctcagcagtattttatcctatgggccagtccacttttcttggaattcacttttgcttttgccttcagtgattcatctctatcgtagttttcttcctctgcttttctggttacccattctcagcattttctccaagttactgttttctatcaaaagctatgttctccaaaattcagttgttgtttgtttcctttattttttaatgttttttacttacctaggctgtgaaattagctagcattaattgattgataattactcaatggccatgtccaatactaatctcatgagccccattaaaccaaccgacatcacaattgggaaggacccaggtatggaatgcccgttttgggctcagttctttacccaattaagcccattcattttcctgtgcaccctcactgtgtaacaccaccattttctggtagttatacctttatacctgactctttctttctccttgtcccctacatcgaataaattaacaagtccatttttttttttttttttgaggtggagtcttactctgtcacccaggctggagtgcagtggcgtgatctcggctcactgcaaactctgcctccccggttcacaccattctcctgcctcaccctcccgagtagctgggactgcaggcacccaccagcacggccagctaatttttttttttttttttttttttagtagagatggggtttcaccgtgttagccaggatggtctggatctcctgacctcgtgatccgcccgccttggactcccaaagtgctgggattacaggcatgagccaccgctcctggccaacaagtccattcttaattcatagatatattacttcttacccaggttgtggaaatagcctagtgaggagccactgtgcctccttttttgagctgcaatccaatctacaaattactttaccagaatgaatcttttaatggataaacaagaaggatggtaacagaggctgggaaggtaatgagagggcagtgtgtggagaggtagaaaatggggatgattaatgggtacaaaaagtagttaattgtttgtaatacaaaggagaaatgcttgagggggcggataccccattaccccattcaccctgctgggatcattatgcactatatgcttgtatcaaagtatctcatataacccgtaaatatatacacctactatgtaaccacaaaaattagatttaaattatttttttaaaaattaaaaaataagttaataagcatagctaactctccaagttgaaattattttagtagttcctggtcagcagtgtcttttgggattgtgatcctgaaactacatggaagtgaatgacctacagggattgttaaatatgcaaattcctagacatcaacacagatcccctaagtaagaatttcctggttggatcatgcttaagcacactaaaatttgggaacgtgtaacaatagaataaagacaaaattttatggaatgttatataaggttttgcataatccagcttttgactgtctctccagcccccttgaaaaccatcctgtcatatgattctcatgcctgttgcagggtctggtccatcatgccatcatgcctttgcctagtatcaaagtccttccactcccgattcacctatcacacttgtttatccttctaagaatagcccacatcaatcatctctcccttagtaagagtttgctgagattcctaatttgcacccctctgatcttagataagtccattttccatgctttcaaaaattcaagtgtatcaatccctctcctccctgtactatccccaagtctagtataccattgtatatatctcactgcatttaaatgtttggtaatttgcctgtcgttgtcatcagcctaaaagcttcctaacacttgaaaaaaatgcatggcacatattaggtgctcaaattttatttgttaattgaagaactctctctttaaatcatgatgtctaccagttgtcttctaccactcttatgagccaaattttgtccatcaatgaccttctgaaaatccagtccttgcatgggaggtttttatccccatgttgagtcctgctacatctgagcaagtgctttttcaagttgcttcctgctgatccaatctgccagggatatttaattggccatgtgcctattcccctggtactctttaaagtaagctattgtatcaccaactctggtgatggaattattttttatctcacagggtattttttttaagttacagaagtaaacttattatcaacaatataattaacagcaatgttattggaatttcttccactaatattttattgttacttcttcatattttaagtcctagacgtaaaatgtgttttcaacagcactaacgcattttaaagtttattgtatttattattttctcttacttaggtagtaaaagttatccttaacagtattattaaaatttccaaaaactaatggcctcactagatttgtttgtattttaaagtcgtaactataaaatgaattcaccatttattgaattggcaaagatatcacatttctgtgaacatcgaataaagtaaataaggtctccctctaatcacataaatgtctacaaaaaagctgtgtttttgctttttctgcccaaaggaaaactaaatgctgaatgggctcagcatttcaagtcaaactgagccagccagtttgtgtcctcttctgtaatctactacctgtgtggttgtgatgcacaggatgtcattcctgaccctcagattttcctgtcaaaataacctgtagcagcctttgtcatacacggcacatattaggcactcaataactgcattttcttttttttttaaattgattttctagcatggtagctagtatacttgtttttcatagggctgttaagaaggagttggggacactcctgccatttccctggcatgttgctgtcagccttgattgtcttctgtttggcatcagcgtagagtttttcaatatctgtgtggctctggtcttctgaacaagatggcgagttcctcaagggcaagagcctgtgaattccaagcacagagtgtatgctcagtatataaaaatgtctcatggattctagttttagaattgccaacatgatattatgaaaggaaagcaatgttatgctggaaagaataatttttcttctcacaaacatggttttcttaaaatgatgaggtgaaaaatgaaaatacttcaaatattttccaactgtaatagtcgatgatttgtaagatgttttctctagttggctggtgtccataacctctaaggcttgacacttatgagaagtttaagaaattctattttagtgtgttcagggtggcccctttacctttccaagacttgctactttggaatcgatgactccacagagcgtaaagtggaattaaagctgagagatgcctatacccacttgtatcagaaatccgtccactatgaagatatctgtcatgattaataaggctaggcagttctcaataaagaaagcatgagtgagtttgttttactgcacaggcttgccctgatcatattaatttgaaaaacagctggaggtggcaacttaccaggtaaaaacagattgggggaccgataaaattattcagatgctcatgggcagctcctctgtaattcacaggaaagcctacacttacgtctgagaagcagcattacggaaaagtcccagcagaatttgcaaactcaggtagtcaacagtttgaactacaagtattctatttgtgggtatacccgtatgggcctttatggacctccttaggtggagaagggcctgccagtgggtatacaaagagcaagaaatctgacattgggcaggctttagtttggaccacatgggaatacttctaagcgtctttgcattattagcagaacaagcatttcttacagaagacaaaatccatacctggagattcagaaatacacttaagataaaatggggctttctagtcaagctctcttaagtctcccaggatgtctgtcagtctctcagagctgtgatttctgaagactttgacctcattcaaattaggtgaacaaccaagttaaacttgtcatggtgtttttttgactggaaattttatgacagaaaaaacatgcagatacagttgacccaacagtggatggactcagccaatgtcatttaagtctgtctttctgagtagaccctgtgaaaggtctggggctgccagtgccatttactgcatcaaccaagatctgagcacattccccttccgttttttttctggaaatcaagtgccgtctccattagaaatgcatgttcctgaaggccagggaagcctagagcgaagccatgtcagccataacacatcatgagatcctccctgtgccccattaaacaaagcctcggtatttgccttgttactgcatttcacctttcagtgtggaagagggttctctaaagcagcgaagcttaactattgtctttaatctatcacttgatctaccttttctttttttcttttttgcctacataaatcattcaaaatttgtttttgtgtttaaccaaagtttcagtaatcctctaaatttatattagatgtctgactagtggtattcatcatttcactttttctaatagaagctactctgaccttaaatctatgagaaaaggaaaatgtgaaggacatggactttggaaaagcttgttagtctctgtaccgacaggtcatgtcactggccactttcctaaaagaaagaagaccatggggaggacattctagtaggtgcttttcttttccagctgataatacaaaaaaaagtggaatacatttcatgactgtaagagtttgtaattaggttgtatatctaagacacacacacacatcattgacaaataagaaaaaaatagcacagttaaaaaattagttcaaggctacctaactaaataataacagaattgggtttaatacttaatctctgaattcagccttcccagttggcccaaatttaagtcaatatctcctcttctcaacctgctatttcttttcctgagttttatcttaaggattagcactattgtcctggatggagggaatgcaataattcaaagccatcctttgccctccctcttcatgatcctactatccaatgagcaggaatctggctgattttacctccgcaatgccatccacatccatgccttcttctacacgctgctggatattccagggatttttcatctcttacttgggctgtttccacagcctccgagaggtcttgttatcttcagggctacctatcaactaaatccagccaccacatggccaatacttgcttttattacagaattaattctgtttttgtttgtttagcacctctaattttgtccattatttgctatagtttatatcacaaaacctttgtcctacatgcaaaactcttcatgatttggcttatatgaactgctcctattattataaccatcctttccatatattccttgctacctctctcctccctcacaatctactcctctgcatctttattgtaccattttctttggctcagaatgctcttctttaattctgcttaactcaatcctgttattatacttcctacaattgtactcagttgttttctccttgaggaagttgcctctgaccccagcatgggctataccactgtgattccttagatttgcatatgcaatgtgtggaactgttttgccttctatgttactctctgttaaaccattacctcactgaaagctgagaccccattttaatctccctcccctactctagtacctattacgggctccagagcatagtagatgctcaataaatgctttatatacacagtgaaagaactcttatgacaggtgtcataagaagtttaaggatagagtggtgcctgtggatttagaaccagtggtaagaaagctctaagttgtctgtgtggggaaatcctatcagtcgaggccgtgaagcaggacacacaaagttagggtccctttctccttgggagtttttttggtgtggtttgtttgtttgtttaacaggaaagaaagacacaaagggtccttttggcattttttcatggaggacacagcagtcatatttatctctgcatcggtagtagagtctgggagagtatatcacattcattcattagagaatgtatctaactgaagactagaaaatcttctaatattagtgataaaagatgtgagttattattggatttgttgttttgttatgtttttgtttcttttcctgtccttactgattctctcaaattggttatgttgttccagcaaaaagatcaagggaatattgggggcagtaaaatctgttttgttttttaattccccaccgaaacggaaaaactaatacagccaaataatgagctcataaatactaatttatgagcaggtaacaatcatgacacctaacaaaaagtcattcaacactgaacttgaagttagaaaatcatgttttaatttccatctctgtccatctagttatgtcatcttaagctaatttgtacatagttctacgtgccactttcctctttcatgaaataggaacgttgatgtagatatcttttaattctatgacttcaaatcctacaactctgatttaaatgatttcaaaaacatttattgaaaccttctcatgcttaggaatgccagccataaaataagaaggtctggttcttgttcttactgagttataatttagaaggagaagtttaaggtataaggagcattaaatgacaattatggaagtacttaaactctgtttaacatccaggacgcaacacgtatttcttacattcagcaaatataatacttctcaagtccttctatatgtctggcactaaaataagtgcccagaatgaaaagaaaaagagaccaaagcctctgcccaaatcctgtaaggcaaaccatttccaggcctgataatgaacgtggagatggagtaagattcacaagacagaaatgatgtcatcaaagtagtggaataaaggtgggcacaggacattccacattagatgattactttaaggcagcatagtatgtccattcttggtgctagatatttgtcagcttatgcccatttaaccaatgagatgaaaagcaaaatctgctatactttctgagaaagagaagtcaggcactttctattgctgaaaatcctaagaaaacatattgctcccgttgctgcagacaactatgttatgaacacacagacagccagacttaggatgaagccgttgtttgtaaaaagaggagaagtatggagagaaactcaatctctgatgacacaatgcagtagctaaattagcgacttcgaaggcctattcttcctttagattcctgatatctgagatcaaatccccctgtattaagtgcatctgaatcaggatttctaccacttagagtagaaagaatataactgatactggaaattggcctgttacatgctttaaaggcttagaataaagagcactatctgatggaggtcactcgctatagggttcccatagtttgtttttcaggcatggtgagaaaggttcagacaaggatccattgccttttttcccctcattagccatgtctaatcaatccccaatcctgtcaattccatgacctttatacatcttacctgcttctctccatttctattaacaccaacacagtccaaaccagggtctttgcatacctggatcactattgtggatttctaactggtctcctgcatccatcaattttcactcctctattttattctctatcatgcgaatcttataatttcttgacttacagagcatctttaatggtagctcattgctttttgataaagtcaaaacttcataaaatgtcttatgactgtatcaataatgtctacctctcccatgtcattattcagtgttccaccaccctcccgtgactaccactgggcttcagctattctgaatctccttcaaatcttgctaatgcatgtgtgttctcccatggggtaaagcatgtggttttcccaccaccgggaatgccattttctcatgtcagtctgattcctatcatctttcaggtttcatatacaatgttacttcatgtggaaagtgggttttgaccctagtgtagattgctcctttctgctaaaggctcccgtgacccctctgtacttacattatctcactctagtataattatttgttggattaattctttttatttttgtaggtcctcgtttgtgttgttcactgttgtaatcccccagtacctctctatagtggatacgccacatatattgaagagctgaatggtttgagtacatggagaattatgcagactaccttttaaaaagcagccagggaaggggaaagtacagacactgaggataaataaaagcagttagaattcaggcagaaaaacagcagttactgaatgttctgttttagagttgaacaaataaatggccagagattgaagtagacagttaagaagctgataaacaagataaacattaaaaaatatatacacataacactggtatcatacctgattcagaccttgagccattcagctaattctgactgattccaattggtctggccagttttctgtgtgatgcaaaggtaatttatttaatgtattctgtgggtataaaaaaccccccagcagctctgcccaccactaaagatgagctacagtatcagtagagacatgaatgagtcacacagggtcagatgccagctctaccaagttcaagcatcttaacttgaaactgataataattcgttaaacagttgtacaaatccagactctgtatgcagagcagcagctataatgtccccaaaactgaaacttatcattataataacacaaaggatccaaatttagaaccctggaagaatggctgtaccaaccaacagaaataggaattcaagtgctgagcaatgtagccacctcctctcatggttggtgttctcagtttaacacggttgagctacaatccacaaactggatgactcaaaatcaaaagtaaaaaatccaatttagttcacagtattgatactaatgttagtctccgtctggaggtttatcagcttaaagtccatctgctttataaagctaaaaaaggacgatgtattcacagtctggttttggtttcaaatggagaaatatattctgaagctattaacagtgagtggatatgctctcgaggtagagtatcagagcagccagcacaacaatccaaggaacttcccactgcagtctgcctgagtgcttaggttcaggaaatctccacttagctgacactgggtattggttcagcaacatctctaactgggtgtggggtaagaaagtagggttaatgggtagggtgccacctgagagagacagtttttttctttccccacatcttgaaaagcattatggatactcacactaaaactctggactgtttctgtttaatccaaatgatttcagtttagtcttgatcagaacaaaagccagattactttttgaaaaagatcatattttcttaaatctaatgtagacttcatttcacattgtacatttggagattaggatatacgtagttaatctagtgatgagttttttcccctctgaaactgtttttaaattagtaatatcccattagatcaatggcatctgagcattggataaatatggcatacattcttctatgtggcaaagtttcctgtcctgcaggagaagatatctattattgtgcttgggaccttcgatgtgaagaccccacctggtcagacacttgatttctccttggtgttacttttacatcctgaaagtgcttctaactggcactgaatccagacaatttttaacaaaaaaaaaatagtttatcttattatttaaaaaaatcaggacactggaaaacacttaagaaaacagagattaaatagacatcataaacccactacctatggaaaactatgaagaatgccccaatcatatgcttcctgatcatttttgtgcactgtaaaaattatttaatggtactgtccttttaatatatctatacatgtcaacatagctccatgtcagtatgtttgtttacaaccttgttttaaatggccaaatggtatcctactacacaaatatgctgctgtttgtaatcaagtgcaggaatttgaagaattcaagactacattgtactcttcaagaccacattgcaactctatttacctctttgtttagactacaagtacctagaagacaggagccttgttccattcaaactgtcttctagatgctttgcacttgatatatattcaataaatgtggatttggattaatcccacaaacaaaaagatacttgggtgaacacacaaaatctggaagtatagtctattggtttcctgtggcttcagcataacaaactgccaccaacttcatggctcaaagcagcagaaatttattctctcatagttctggagagtcagaagtctggaatcagtaccatgggtcagaatcagggtgttggcaagaacatgcttcttctggaggctctagaggacaatctgtttcttgccccttctggctctggaagctgccagcattccttgatctgtggctgcatcaccccaatccctgcctctatggctacattgccacctcctcttctgtttaaaatctccctctgcctctatcctataagataagtgtaattgcctttagatccccacagataaccctggataatcttcccatctcaatatcttgcaatcgcatctgcaaaggtccattttgccataggggataaatttacaggttcaagaaattagagcatgagtaactttttttttgaaggttgggggacatggcattttctgccaataagtaagatacataatttcaactatactttttaatcgttgtgttttcagaaaaagtgttaaggcttgagaaaagtgggaatggagaacacactgttcaattatctttttcttgagaaagctttggtgtttgccgaagttagaacttgtattttccatagttagactatactttcctatcatttaaaagcctaagtgacttgatattactcaattctattaattgaaataacagtattacatttacttttaactataaataaaattagtgcatatagcctggatatatacagtcatattggagaaggaggaataaacaataaaaccaaagaaaaagggagtacacaagtggagcaaggaggcagaatagaaagctctaccaattgtcctcccaccctccccaccctcttcaagaacgcttttaactatctgcatacacaaacgcacatttacaagaaccaaacatcaggcgagaatcacactacctatatctttcttcatatggttggaagaggcattgaagagactaggagagtcagtcttgaatcattggcactacccctttctaccccctggcagtggctgtgtggcaccaagagagaatctgtatacctcagggagacagagcgcagcaactggtggactttgcattgaactcagtgctgccttgtcatagcaaagagcaaagccatcttcgactcagccagcactcatccagggcccacagaaggagcatttggaccaggcctagccagaggagaattactcagccctgaggctgcaacttgagtttcttagaagcctcacctttgtggactgaaatgctctatggtcctaggtgaatctgaaaggcaaactaggacacaggaatggcatttcttaggcacgtcctgatgctgtgctggtcttagagccaatggactggggtggtgcatgacctagtgaaacaccagacatgactgctaagagagtgcttgcaccacccctccttcaacaccaggtagcacaactcacggcagtgaaagtgactccttccttctgcttgaggagaagagagagaaaagtaaggagtactttgtcttacattttgaataacagcccagccacagtaggatacaacaccaggcagagttctgaggcccctatcccaggccctagctcccagacaacatttctagatataccgtaggccagaaaggaacgatctggtcctggagggattcatcacctgctgattaaagaactcttgggccctgaattatcaacagtgatacccaggtagtataccatgggccttgggagaaattctgagacatactcacttcaagtaccagcttggctacagtgtagtagagcaccaagtgggatcttggggtacccaagtccaggcctaggctcttggataacattactggacctgtcttgagccagaggggagcccattgccatgaagggtgagtcccaggcctgtcagcattcacaagggccttaagtgaagagcccttgaaccctgagtgaacattagcagtggcctagcagaactccctgtgggccagtggttatggtggccacgatgagactcctctgactgtggaagggggaaggaagagcaggaaggactttgtcctgtggtttgagtgtcagcttagctgcagtagaatagaataccaggtatatttcaaaggattttaacttgaatacgtggctccaagtcagcatctctggccctgcttagggtctgggggaacttgccaccctgaatggaaaggcacaaacctggctgacttcactatctgctgattgtagatccctagggacttgaataaacataggtggtagccaggtagtgattacagcaggactcaagtgagacccagtgctgtgctggcttcaggtctgaaccaggataatttcagtggtggtggccataggagtgcatgcatcaccctacccctagctccaggcagctcatcacagagggacatgctatttgtttaggagaaagtaaggaagagaacaagatcctgtgcctgataatccagagaattctttcagatcttatccaagatcaccaagctgtgggatttcttcaacaccagaactgttctacaagaaatgctaaagggagttcctcaatctgaaagaaaaggatgttaatgagtgataagaaattatttgaggtacaaaactaactgggaatagtaagcgcacagagaaacacagaatattataacagtgtaattgtcgtatataaactattcttaagtagaacgactaaagtatgaaccaatcaaaaatactaatggcaacaacattttaaaacatatatagtgccataagatataaagagaaacaataaaaagttaaaaagtgggtgggtaaagttaaaatgctcagtttttattagttttctttttgtttacgcaattagtgttaagttgtcatctctttaaaatcatggattacaagatagtatttgtaagtctcatgataatcttaaatcaaaaacatacaacaaatacataaaatataaaaagcaagaaattataccatcagaaaaatatcactttcatttaaaggaagataagaaggaaagaaagaagcaaaaccacaaaaccaccagaaaacagataacaaaatggtaggagtaagtcctcacttatcaataataacattgaatgtgaatggactaaactctccaataaagagaaacagagtggctgaatggggaaaaaaaaaaaaaaaaaaaaaaagcaagacccaagtgatctgttgcctttaagaaacacacctcacatataaagatacagactgaaaatgaaggaatgaaaaatagatattctatgctaatggaaaccaataaaaagagcaggagtagctatactggcatcagacagaagagatttcaataaaaaactgaaaatagagacaaagaagggcattatataatgataacaaagtaaatacaggaaaagaatgatgattgtaaatatatattcacccacccaacactagagcattcagatatataaagcaaatattattaacactaaagagaaagatagacttcaatacaataagagatggggaattcagtactccattttcaggattagacagaacttccagatagaaaatcaagaaagaaacatcagatttaatctgcactgtacagcaaatggatctaagaaatattacagagcatttcatccaatacctccagaaaatacattcttctcctcagcacacagattattctcaaggatagaccatatagtagacctcaatacaagtcttaagatattcaaaaaatggaaataatatcgagcatattttctgatggactaaaagcagaaagcaataacaagaggaattttgaaaactatacaaacacatggaagtaaaacaatatactcctgaattaccagagggtcaatgaagaaaataagaaggcaattgaaaatttttttgaagcaaatgataatgaatacacagcatatcaaaacctatggaatacagtgaaaccatattatttcttcatactgaagagggaagtttatagctataagtgcataaataaaaaaaataagggaagcttcaaataaacaacctaacaatgcatgttagagaactagaaaagcagaaacaaaccaaacccaaaattagtaaaataaataataaagattggggcacaaataaataaaattaaaatgaaaacaatgcaaaaaattaacaaaatgaaaagtttgttttttgaaaagataaacaacattggcaaacatttagccagactgactaagaaaaaaagagagaagacccagataaataaaattggagatgaaaaataagaaattccaactgatactgcagaaactcaaaaaatcattagtggctactatgagcattatgagtgactatacatcaataaattgtaaaatctagaagaaatggataaattcctagacatacacagcctgccaagattgaaccatgaaggaatccaaaatctgaaaatctgaacagaccaataacaagtaatgagatagaagccataataaaaagtctcccagtaaagaaaatcctgagacccaatagcctcactgctgaattctaccaaacatttgaagaagaactgataccaaatcctactcaaactatttcaaaaaaatagaggaaaagagaatactttcaaattaattctaagaggccaatttatgaggcttctcttaccctgataccaaacccagacaaagacacatcaaaaaagaaaactacaggccaatattcaagatgaatattgatgcaaaaactctcaacaaaatactagcaaaccgaattccacaacagattaaaaagattatttgttatgaataagtgggatttatccccatgatgcaagcatggttcaacatatgaaaatcaatcagtgtgatacatcttatcagcagaatgaaagacatattatcatttcaactgatgctgaaaaagcattagataaaattcaacactgattcatgataaaattcctcaggaactgggaatagaaagaacatacctcaacataataaatgccatgtatgacagacccacagctggtattatactgaataatggaaaaaaaaatggaagcctttcctctaagatgtgggaaaaaaatacaaggatacccacttttaccactgttattgaatatggtactggtagtcctagctagaacaatcaaacaagggaaagaaatagaacattcaaattataaagaaagaaatcaaagtactttgtttgcagacaatatgatcttatatccagaaaaacaaggatttcaccaagaaaattattagaactgataaacaaattcagtaaaattgcagcgtgcaaaatcaacatacaaaaatcagtagcatttctatatgccagcacggaacaatctgaaaaagaaataaaataatctcatttataatagcaacaaataaaattgaatatctaggaatcaaccagaaaatgaaaaatctctacaatgaatattacaaaatattgatgaaaaaaagaggacaccaaaaagtggatagtccatattcatgcatcaggtgaatcaatattattaaaatgtccacattacccaaaacaatctacagattcaatgcaatccttatcaaaataccaatgacatccttcacagaaatagaaaaaagaattctaaaacttacatataattacaaaagacccagaatagccaaagctatctcagcaaaaagaacaaaactggaggaatcacattacaggacttcaaataatactacagaactatagtaaccaaaaccagcatggtactggaataaaagcagacacatagaccaatggaacagaatagagaacccagaaatgaattcatacatctatagtgaactcattttttacaaagttgccaaggacatacattggagaaaagccagtctcttcaataaatggtgctgggaaaactggacatccacatgcagaaaagtgaaactagatctctatccctcaccatacgcaaaaaatccaatcaaaatgaattaaagccttaacttaaagacctcatactatgaaactcctacaagaaaacattggagaaactccccaggatattggtctgggcaaagatttctatagtaatacttcacaaacacagggaaccaaagcaaaaatgaacaaatggtatcatatcatgtttaaaagcttctacacagcaaatgaaacaattaacaaagtgaagagacaaccctcaaagtgtgacaacatatttgcaaactacccatctgacaagggattaataaccagtacatataaggagctcaaacaatcccataggaaagattgactgagatctgaatagacttttctcagataagacataaaaatagcaaacaggcatatgaaaaggtgctcagcataactgatcatcagataaatgcaaaggaaaactacaaggaagtatcatctcaccccagttaaaattgcttttatccaaatgtcaggcaataaccaatgctggcaaggatgtggagaaaagggaacgcttatatacgattcatggaaatgttaattagtacaaccactatggagaaggtttgaaggttcttaaaaaaactaaaaatagagcaactatatgattcagcaattccactgctgggtatatactcaaaagaaaggaaatcagtatattgaataggtatctgcatttccatgtttattacagcactattcacaagggccaagatttggaagcaacctaagtgtctatcaacagatgaatagatgaagaaaatgtggtacatatacacaatggagtactatttatacataaaaaagaatgagattctgtcatttgcaacaatatggatagaactgaaagtcattatgttaagtgaaataagccaggcacagaaagacagactttgcatattttcacttatctgtgggagctaaaaattaaaacaattgaacttatggatatagagagtagaaggatgattatcagaggctgggaagggtagtggggatagtggaaggcatgtgctggttaatgggtacaaaaagtagttggaaagaatgaatgagacctagtatttggcagtataacagggtgactgtggtcaatagtaatttgattgtatatttttaaataactaaaagaatataattggattatttgtaacacatagaatagatgcttgaagggatggctgcctcagttaccatgatgtgattattacacattccatgcctatatcaaagtatctcatgtaccccataaatatatacacgtactatgtatccacaaaaattaaaaaaccattattttaaagggagcaagtgagaacaaggagaggaataatgtcatggcgaggctgttgcatatggagaacagtgcagaaacaccaaatgggaccaggggaacccttgccctctccctttggcatttatcagtgtcatgggtattgactcctagacagcacttaccagcctgtgatctatatttctgagtggagaatgtggaatggagggaatgggtaaagcaggatctataaatttgatcatcttgtgtctaccatctccagcaaaaacattgacatcagatctattcatcatcatcatcattatcatcatcatctattgtcattattattatgattttatgcaactgccaatattactcctattgttatttgattcctaagcctcatttactgtgagcaaagcatggtgctattccattttacgtagtttgatttaatcttctggcaatgcaggcagtgttccttgtgtctgtgaaagctgaaattgcatcaaacacaataatcaacatgaaaaagtgcagttttctgtgacttttaaaaaattgatgtcaaacattaaaaatgtactttttttacaattggggataaatgaatagggatatgaaaaaatataacttatacgtatttagtacaccctaatttaaaaatattagaaacactgataactaaagtgtttcatttctttattaaaataatttacctaagacagctagattagcttgcctcctttttgtcatacaacttactacacaaagcaggcatcttttctaatccttggtgacctgtcatactcctttctaagttgagatccacttctaacattttatcctctgcactttcgatgccatgaaagatctctgataatccctttcatgtgaagttttttgccatcatcagtaagtctgggacattttcaacctttttgtcacaatcacttttctcatttatgttgataagttcatctttgctaagttcttagcctgcatgtctacagtcccttgaatggcaaaatgtcaaggtttctaaggtcagctgtttggtctccatttggcttccatttaaatcttaatcccagtgttatcatttttcatttctttgctgcactttcatctctgtttcccagttctgcatttcaattaccaatttttgtaaatgtcacatcgatttaccaccgggagagaaggaagcaacacaactacacattttgctgtctgtgtgtggactgattagcagatacccagtcagcaatcactgaaagactttggaagaagtgatgtgactggccactggtcatgctgtgcatctcttatgtatgtggtgatttgtgaactaaagagctagcagcaaagtttgtactttatgcctttactcaaaattcatataccatagtaattaaacattgagccatgtttttggagggctttgtcatttacctaaactgtgataagtaaaacttgtgcatctcagaaatgtgcacaaagtgaggactgcctatactctgaagtaggaattatgagtttgcccatgatatggaaaagaaaattgagtcagaccaagattatatgattaacccaatgattatatgtattaagtggtaaaggctgatttagattttaaaattcaggtagcctcattacagatattatagcttaacttcacattgtttggcatcagattgaatctcaaaccctgacttcacattctttgtctcgactcgaaccctgactgtgatctctgtcaattaagcttcctggaaatatagttgattttgcagcagctctggttaatcaagaactctacctcctgctaatgacagagtctccagcttctcaaatttcttgaaactgtttctcaagaatcaatttacttaagactgttttcaaagactatagtctattacgattataatattacagtgtactacaggtactatagtgttcacatttgaagctttttcttgtatccttcaactccctgattatggcaatttggttgacactttgaagctttccttctttctcaactgtcctcctgtcctgggcttttaccacaaacactctcttggtgtctttaaagtttttttctcagtaatatctgccagcaaaggaggactatatgacacccctattttcttcccaggttgtccctttgcatttgtatattttcaggagagtgcattaaccctgttttggaaaggcaagaattcctttctaatctgtagtcatttcagtttgttattcactctgaaaaatggtaatgaaagtggagaagacagtggtcaaattggcactatgcaaagctgagatgctagctagtgacagctccagaatgatggtcctggagctgcagccagcataatataaaagcaatcagcccaagtataagacctataatctccctataaaaaacagctccatcatctgccatctctgtgacttagggcaaggagcatttcagaacctcagtgtcctcctttataacataaagaaaagcttgaactctcattaccaacatcagtgaagattaaaatattgttactattaagtggctgatacatgtaaaagtcacgcaaaagttagattttattattagggcttgaaagagtgaggcacagtggcatatacaattatacacaaagatgattgattgattgaatgatagcatccagaagtcttttgcagtgtctcccaaaatctgttctctaatcattgttgtgaaggccactttataactacaccgtggataacatacctctaaatacgtctcggtgtatcctccttaattttacaggtataaccagataattgcaatcagtattgtaagccttatttgagaaaagatacttgctaataggtcattctcctaaactaagctgtgtgataaactagagataactcccaaattcaaagtccagctctacttttctgacatttgtgttgtcacaaattattgggagtcctcacttaaaaacaatctgtctacctgtggccccatagcagtgtctgatgaaccaagcacatagaaaagtatatgttgacataggccatctcttgctccagaagtgttcactacaggaagcctaaccatttgtcacacagggtcagatctcaaagtcctttcccttattcttcgagttttaatttttatttagttttctctcaatgccatcatgcctgtgtttaggctggtcctcctgattctttgtcctcaattaaaatatggataaataagatggtctctaataccagctttatagaaagtaggtagaatcaggcaagattctctctagtttgtcatacaacttgacttgaatcagctttgtgagttaggagtttgactgtactccaaagagattcaaactgagaactattcctttgggctcctttgttgtaaggtccattaaacacaatgagggcatatggacatggtttaccatttcttcacaaaatccactgcagagtttctagtgaagttgcaagaaaaatgacaatgaagtcaaatgtgttatttgttgagttaacttaagcaatatatgttgactcaggaaataaaatattacaaaagatagagacaaaacccagaagaaaatgccaagcaaaacctcagattcaatccttgaaaggacaacaattctacaaattgtagcatataatcatcaaattctgttttcttatgaatatatgtacattttcccatgaagataatatgtttacaactagaattgtggtctacatattgaatagaagactgttatttttatttaacaatatgttctgaacatctttctacatctgtaaatgtattttgttatgcacttgtaatagcttattgtatataggcacaatgatttcttttgtacacatcctgaattatacccttcaaataaagcctcagaaaaaataattctgggttgaagtctataaacatattcctagttgctggtacctatggactgacctgagtttgaattccagttcttgcatatactagtggtatgatattagctcttaatttcaaattatgacttggcctaaatacattggttttattcctcaaaagatcaccttcaaactgtgatggaatcttcagttttgaacaatttacaatttttgccagctctgatgcaatatgcatccactagagatagaatatactttctgtcacctaatcctcaaaaccactgttatgtcagttttgtttcttttaattcatgctattctgatagcaaacattgagacaaggaattgggtgcaggtattttatttgtgagattgtcccaggaagtaggaggaagagtgtctggagagggatgcagggaaggaggaaacgtcaatatatggggcatggccgagcagattctgaaggcaacagggactcagttgtgtgggacctctgtgaaaggtagagaggaatctccaggtttgtcctgtttctgacataggaagcaggggtgattacatctaaacgaaaaccacctccctgtgtaataattcctcaaaatgcatggtgttggatctagcaattccaagtgcttcagaaaagacacagggctagatgcagaaacaggactgtcagggtgagtctgggcttaagtgaaactgttcactggaactgtggctgaagtcataagtaggacaaagatgcatgatttggggcagcaaaaacacctgttacgttagtccagtgtaataggcagaaaatttgatctcaaagagattaattaatttgcttgagagcactcagccagtaattggcagaaacagccttcaaactctggttttctggctccaacccccatgttcttcccatcacaccacgcctcctccaagaaagcccagcactttgtgcttgtatggaagctccaggcactctgctctgggccacagctgtttgggcatagcacagtggtgtgccctgctgtataccacccattcaacctctaaatcccctacagcctcagtgttcagacataagggctctatcctttttatctatctgaacccctgatttttcccttcacagaatcagtgaacttgtacaaatcgtttcaaacagtgcattgcaataaattgatgggttgtgaaatcagtttagtgagacttgactagcattttaaaaataaaatagatgaaaatatcagaagtgtgtggtttctgtcactttatcaaaggaaaaaatgtttattcatgtgtatgtgcgtgtgtatgagcatgcgtgtgtatgtatacgtgtgtgtgtgctgagtctctacaaggaatttatttcatatgatgggacatggataagaaacttggaaagccactgacaaataggttcaaaatgcaggctcaataatgctcaaaatgcatgggttcaagtcccaactccaccacatactagccagatatgtttcagtcttcctatccataaaacatggctaacctcaagggctgttgaagaataaatgaattgctactcatagaaagttgagaagagtgcctagcacattaggattactcagtcattgttacttttcattgtaaaagtataatcaatatatgaagtacaaagttggcatgtaatttttgtttaatatggaacaagggaaaagaaaatcatcaagtattttcaattatttggaaagacatactatggagattgagttaaaatagcattttccttacatttattttgtgctctctcccaactgcccctcactacccagtgttctagccctataaacacagtatctatcaacttaaacaatgcaggtcttaggaaaattaatgtaaaatatttagtaagctaaaatttcattcaaaaatatgcatttttctagttttcaggaggataaatgaactgtataagacggtcttgttccataaatagtcttgcagtctaaacaaatgactcttaaattgccataaactaagacaggattattataccttccggctcagaaagaacactgtaactcaggctttgtgaaagagccagtgactttgaaccgctgcatgaatgtgggtgtgttctgtttatgtaatctagagtagtcatttctgaattgattgcacacaaaattcatccgagggaacactgaaaatcatttccaattgcattgggccaattgcatagaaaacactgagagtgtccccaaatccattctataaaaaatgctcctagaaagtgacagtggattgaaagataagcagttttgaaaataccttgactgaaatttgctgactgctcattcttggcttgaaataatgccattataattatttttagtgtatctatctgaagcaattatacaatacattgattttcactgcctcttcaagaacaaccttaaaaaccatagacacggagattctgaaatatcaggagaagatcaagagaatgctttttccagggccccagtcacgataagaaccctttccctagcatccttgacatgtttgttagaggtgattgaaggattctagtgataagtagtcatttgtctccaataaaactttacagttgcaatcataaacaggcttcaaagttcttgtagtcataaatcatctggacttttatttgcttatatttttctttgaaaactgtcttataaaaattaggtgtatgttaatggagagtatatatgccttactataagtaaaaattttgtgttactagatgtactggttttttttttctaatacacacttaaatgagaaaataacaattaacatgaaatatgttagttcttacaccgtctaaaatcatctattagaaccaccctttgggaaacactctttatgactaagaggaaataagcctcctatttgtctcacctaacagcccttcaaatgcatagatctgtgaacatttttcttcctcaggggaaatatctataacttccttaactgtttcttatgtgaaacaatttcctaactgctcaccatcctagcaaccttcttttaggtgctctctgctttgtctaagtagcttttaaattgtggaagcttctctaaggtgataatttcttatctctggaaaatgtaggcattcctctatagcttccttttctgagtcataggcctgaggaactcacttctagaaaatgtgaatgaatcagcagaatttcttatggctcttgagcattatctttgtgtttctttgataggggatgtggtagcaagtgagtgcctttatatgaagatattgggcaaaatatcaaagttttttacaaggaggactagcataaggcaaaggatccactcattccttattttaattgacctgttcattttgagatagttgtagattcacacgcggttgtaagaaatagtgagagatcctgtgtttccattaccagtttctcccagtgtcaacatcttgcactgtcctgtagtacaatatcacaaccatgatgatgacattaatgttgtcaaagtatgagaattttatatcaatacaaaatcccctatattgcccttttatagtcagtttcttctcaacctcaacatctggcaatcactaaactgttctacatcctgtaatttttgtcctattatgaatgttatataaaaggactcacacagggccaggcgcagtggctcatgcctataatcccagcactttgggaggccgaggcgggtggatcacgaggtcaggagattgagaccatcctggctaacacggtgaaaccccgtctctactaaaaatacaaaaaattagccaggcgtggtggcaggcgcctgtagtcccagttactcgggaggctgaggcaggagaatggcatgaacccgggaggcggaggttgcagtgagccgagactgtgccactgcactctagcctgggcaacagagtgagactctctctcaaaaaaaaaaaaaaaaaaaaaaaaaggactcatacagaatccaacctttgagattggcttttatcatttaacttaattctctagagatccatggagttgcaagtatcaactatttatttttcttttctttcccatttacttatttcttttccttgctgagtagttttctgtggtgtggatgtaccacagtttgtttaaccattcacctatcaaaagataatacattgtttccagttttgagccattacaaacaagactgtgaaaattgtgtacaaagctttgtataatcataattttttatttctctgaatcagtgtcaagaagtacaattgttgggccatatggcagtggcatgtatactttttaaataatctgtcaaactgtattccaagtatctctaccattttatattcctaccagcaatgtatgaatgatccacattctggagagcatttggtgttgtcactattttttactttagacattctgatagctctatagttacatctcattgtggttttaatttgcatttatctactggctgatggtgttggacatctttaatgtgtttatttgccatctgaatatcctgtttggtgaaatttctctttatgtcatttgcccagttgtaactggatcatttacttactgttgttttaagagttatatatactggatactaccccttggttagatatgtggcttgaaaatactttctcaggctgggcgcagtggctcatgcctgcaatcccagcactttgggaggctaagagggcagatcatgaggccaagagttcaagaccagtctgaccaacatgacgaaaccccgtctctactaaaaatacaaaaattgactgggtgtggtgatgcgtgcctgtaatctcagctagtcaggaggctgaggcaggagaattgcttgaacccgagaggtgaggttgcagtgcagtgagctgagactgtgccactgcactccagccctgggcaacagagtaagagtgagagtccatctcaaaaaataaataaataaataaataaaatattttctctcattctgtaacttgtttttcattcccatgtttagggtcttttgtagaattaaagttttttatttggtaaagtcaaatctgactttatggattatgcactctttgtctagtattatagataccaaatagtttttactgtttttttctaaaagttttagagttttaaaaagttatcttttctctactgaattgcttttgagttgtcaaaaatcaattgtccatatttttgtgggtttatttccaagttctctttctttttcattgatttatgtgtccctctttctaccacgttcacagtcttgattgctgtagacataagttttaaaattgagtagactaatttatccttttattttttcttccttctttgttgttttccttctttccagctttccttctttctttctcattttttttcaaaaattgtttcagctattctttttttgcctttctatagaaattttaaaataatagtaatataacaattaattacagtttttgtaagtgaaataattgaatacaaaaatatcttgctgggaatttgatcggacttgtgttaaacctgtaaatcaggtttggggacaactgacatctgtactatattgaattttctaattcatggacactgtgtatctgtccatttatatagatgtttggctttttatcagtgttttgtagtttttagcataaaagccctggtcatgttttctttagatttaattactaactttctgagtgattgcaaatgatattttattttatttttatatgtgttcattgctagtatatagaaatacaatttatagttttatttttatcttgaattctgcaacctttttgatctcatttattaattccagaagtcattttgtagaggttttttttttttcctcacagcgtctcgctttgttacccaggctggagtgcagtggctcaatcttgcctcacttcagcctggacttcctgggttccagcgattctcctgcctcagtcccccaagtagctgggactacagatgcatgccatcatgccaggctaatttttgtattttcggtagacatggggtttgtttcatcatgttgcctggtctggtctcaaactcctggactcaagatccatccacctcagcctctcaaagtgctgggattacaagcctgagccaccgtgcctgccctgtagattcttgacttattgcattggctatacatacatgtatgtgtgtgtatagtatgtgtctatatatgtgtgtgtatatatacatatgtgcttgcatatatgtgtttacatatacttaatgaaggtatatgtatatatattcattaaatacaaaaaaatacattcatgtgtatatatcttcattaaataaacggtgacatattccacctttcctatttctctgttttccagaagagatagtttagaattgatgttaatttatcttgaattgttttgtataatactccagtgaaactatctgtgtctagagatttttttggggatgttttaaaaattatgaattcaagtttcctgtttttttttttttttgagacggagtctcgctttgttgcccaggctggagtgcagtggcgtgatctcggctcaccgcaaactctgcctcccgggttgaagcaattctcctgcctcagcctcctaagtagctgggattacaggcacccaccaccacgcccagctaatttttgtatttttagtagagacggggtttcaccatgttggtcaggctggtcttgaacccctgacctcgtgatccacctgcctcggcctctcaaagtgctgggattataggcatgagccaccacgtctggccgaattcaagtttcttaatcgttacaggactatccaaatgatatatttcatgtttggttgtgatattttgtatttctttaaagactcactcatttcgtcaaagtttcagatttatgagatacagctgtttgtggcagtcctttattatcattttgatgcccgtagtgacatacactgcttcattcctgatattggtttttctctctttcctttgtcagttttgccagagttttgtcaattttattgattttttttcaaagaagtagctctttacttcattaattttcctttgttattttttaatttcattgatttctgctctcttccctcttccttctgctacctttgctttcctttttctaagttcttgagcttgcagcttggatgattgacttgaactcttttctagtgcatgcagttagtcctgtaaatttcacttagcattattttagacatatgtaacaaattttaataggttgtatcttcactgtcaatcagtttgatgtattttttattacacctgagccttcatgtttgatccaatttattatttaaaagtgtgtcgttttcaagtgtttgaaaattttcctactactttctgttattgagaatctgtgatattctatttccgtcaaataatacacgctacttgatttcaattatttttaacttgttgaggtttgtttagtggcccacaatatggtctgtcttgacatacattcaatgaaaacttgaaaagaatgtacatttggctgcgattgaagactgttggttaatggtgttgagttcttctgtaaacttgctgatattctgtctccttgttgtatcaatcatgtagagaatgatgtggacgtctcaaactacacttgtgaatttgtctatttctcctttcagttctatcgatagaactgttttatcagttctatcagttatttcacatattttgcagctttgtttttggtgtacacacttttttttttttttttttttttttttgaaaccgagtcttgctctgtcgcccaggctggagtgcagtggcgccatctcggctcattgcaagctccgcctcccggctcccgggttcactccattctcctgcctcagcctcccgagtagctgggactgcaggtgcctgccaccacgcccggctaatttcttgtatttttagtagaaacggggtttcatcgtgttagccaggatggtctcgatctcctgacctcgtgatctgcctgccttggcctctctaactgctgggattacaagcgtgagccactgtacctggcctggtgtacacacttttataattgctacaacttcttggtgtattgacccttttatcagtatataatacatctctctggttctggtaattttttttgctctgaagataagatatattatctatatcttatcttctaagtttcctttgattaatacttccatgagatatctttttccatcctcttaatttcagcccattttgtcatatttatagtaagttttttgtaaacaacatagttgggtcatggcttataatcctatctgataatccctgtcttttaagtggtaaccttaggccatttatattttattttattttaatatattagaatttaacatttaatattttgttttctgtgtgctgtttgtctcttctctgctttctttttcttaacttattgtggattacttgaacatttatttaaaattccattttgctttattcatagtgcttttgaatacatctttttatatagctttattagtaactgctaggtattacaccctattttatataggtaacttgtcacagtttactggtgtcatcattttatcagtctgaataaaatacagaaaccttacttctttttgtgcccctttatccttcgcctttggtcatataattgttttaattatttcctctgcatacacttagacttagaagcacattatacgacattacaatgtttgcttcaagtgtcccaaacataatttagaaaactcaagacaaaaacgaaagcttactgaatctacccacattttttgtttactgtgttccttctaccttcttgatgttccaaagttccttcttttattttttctttctatttagataatagagtatagtcattattttaggataggcctgctggtgacaagttttcttagatttcttcatctgaggtttttaaaattccctctttacacttaaagaatatttttggctgggcgtagttgctcacgtctgtaatcccagcactttgggaggccaaggggggcagatcatgaggtcaagagattgaggccatcctaggcaatatggtgaaaccccatttctactaaaaatacaaaaattagctgggcgtggtggcgtgggcctgtagtcctagctactagggaggctgaggcaggagaattgcttgaatctgggaggcggaggttacagtgagctgagatggtgccactgtactccagcctgggcgacagagcgagattccatctccaaaaacaaaaaatatattttcttaaccacactaaaagtattgtgctcccttttttctgaactccatggtttctgatgggaaacctattgtcacttgatttgttttgttttgttttcattatgggtaagatgtcatttttctcaggtggctttcaagatgtttttctttgtttttaaaagtttaattatgatgggtcttgctatggattcattggggtcgatcctatctttggtttcctcagctccttgaatctgcaggtttatgtcttccattgaatgtgggaagttttcagccattattcaagttattttagccccaccctctttcttctggaactctgatgacacaaattttaaaacttgttactgacccccagtcactgaagttctattaattattcttcagtctactttctgtttttcagattggataagttttattgtttaatcttccagttttctgattctttcctctatctccttttctgctattaagactatcaagcctgtcctctgaggattttattacatttctatttttttagttttaatattatcatctcgttttttatcttctgtttatttgctgatacttttctttggtgaggctcttttccagtttttcatttgtttccagcgtgttcataattgattactgaaacattttatcatggttgtttttaaatttttgtcagcttattctatctttcattttgatgtatgcatttattgtttttgtcatactatttaagatcttaggttcttaatatgatgagtaattttgaattcaaacttggatattttcatattatgttatgagatcactaaatttatttaaaccttctgttttaactggctttttttttttacactgtgctagcagtcaaagtgggaagtaaaattcataattgccttgtgtatataaaaatccaagcattctattcagtctccattggtacctgactggtgggttcctcattactgccaagcatggatgaaaattctggctctccatggagtctgccctggaactgtctgtagggagcatattcctgccagtgagttcaaagtcctggctccctacttggctttatttgacaccactcaagtgcatcttgataatctcatggacgtggaagtgcaggttcaccactcggcctttgcatgagtaaagatagagccacaatattttctgggtgtttaaccagtcacagtagttatttttaagttttctgacttgttagattgctatttccctggccaacttcctagagagaacaggcttgttttggggcacttttcatctacctcatttgtaattccagattctagcttcgtcaactcagagataaatgagggaaaaacaaaactcaaggcatgcaccactgtgtcctttctgaaattccctagacaatcagctttgttctctacaattttcagtcttcatatgcttatttttattagaatgtccaggattctccattgtaattactaggcgaaagagggaaaagtctattttctccaccttctcaaaggctgaagaccccacctattttttttttttaagtacaaaagaagaaaaatatttcgttggactactctgtactgggcgtttgacttgtagcatctcatttcaaatttttactacactcttggtgtttttccagttgtacaaatgaggtacccaggtcacaggaaggttaggaaacttgccccagctcatacagatggaaaaggagagagctggaattttgagcccacatgtggctcacttaccagctccattatgttttgtactctccattcattaatttctctaatactttcaaggtagcaaaagttttgagaattattttctcaagtgttagaatacttgtgtgaggttacttaaaggagaaattatttatcaaaattacagaatttaagaattagaaaattatttgatttacagatcttgctcccagtccagatcttactctatgctgcattttctgctcccataaaaggactatgagttcacttatttatcattgagttgcacacatcttagttgatcatagctctgaagtgagaacagagtgtttacaagggcaatggatgcctggaatttcctggcctcactattatcctagctgttctagccctttcatgcacatgcttcaaatctcagcctttgggttgtgaagcacttcagagctaagagtgcacatatgtcattatgaccatcacctaatgctgagatggcttctctgttagtctgtctttcccccacggagtgggaaagcactgaatctttccatctttatattcctggcaccagaattgaccattatatcataggacctcaagagacaatattgagtaaatgtatggatggatgaggaaaataaagtaaaatcagcaaaaatatcctgcatgtgagaaggtaagttctgattgaataatcctttatttagcaaagtcatatggcctactttgaaaaataatttaggatgattataaaattacacaaattaatcagtttcggcatgttctattttttctgacctttctcaaaataaaaaaagaaccaattactctttgggggaggatattgcttttctttaataaaaataggaataaataaaacttgcaaagcacttcctgagggcaaatattttcatgggattatattgattactttagctgctgctgaagataagaccattgatttttctcattatctatgagactctaatcaataccaagtatttattgactagctcttttatgttttataagattctaaaggctaaggtaactaaagaagaaacaaacatatgcttccttcttttatgttacttaccttgtgtttgaacacacggttttcatggaagaagtaatgataaataatataagacaatgggattggagcactggcttgcattagacatattacataatcacaaatgatagctttaaaaaaagaagaaggaagtaggtattgattgtctaccattgtattagccatgatacgagaaacttttttgttatctttaaggaaaactttttcaaaccattattatcagccataatttttacctgttagaaatctgagactttgagaagctgaacaactagattaatgctgcacagtaactgaaataagtaggattcaaacagagttggaaagaaaacctgtgctctgttcaatacattaagcccattgagctaaataactagtaagtgtttaataagtgtgtttcaaaagtaaaagaaaaagagtaagaatgagacagaagtgaagaaatccacctgggggaagtgtggagattaaagatgtgtagggtttggatgcatgaggaagcgaaaatgcagggcctggaaagagtcacaaagagtcccccaaacagcggagtacagaccagtctgatcaggaaagagacacagtgggaaacaaataagacctcacctggtagggtgaaatagtgagcagggagtgtacatcgcacctgataggaagaagaacggatcagtataaaagtgtggtttcagtaaaagagagcaatttagggtgggggcaggttgtccaggcctgaatttagttaactacggtgagaaaggagtacttggttccctgagggattgcttctcagatttggatgatggacagatgtgagagaaggagagagaaatgacttgcaaaattcaaactggggtgattgctagaacctggtaagctacatggcaaagaagcttgcagtcgtgatctcatcacttattagtttttatcactttgaacctcagttttaatgtcatgaatatggggttgccaggcaaattcagtgaaataaaatatgtaaagaacctagtccacagtagctttccaataactgtgagtttatatccctgggtgaatggcagtgtttttcaaaaggaaaagaaagcacaggtgactggaatgattgagtttaccttgggagctctaacgttttcctggagagaccccacacacgtttatagaaataaatttgatctggaccctgaaataggtcagaggtcctcaatccatgaaatcagataacaagctctgtgccctgagattcttaggtaaaaacggctaggagctgtcggtgcctgtgatagtgcagatggcttctgctgagccagctggctgaattgaaaaccccaagtaggtcaaatacacattacctgaaatttctggggaatgtggagccttctgctttgcataaggcaggtcctcggcttctgtgccttctttgtgtcgatctgggctggtgcacttttgaactcagaggaatggtaattctccacaccacttctggtggcccctatctttttatcgtattatcctttctgagtacccttcctttttcctttaactctacaatctctttctgggctttagaactgtcctgttacaaggttatcttacattatacccattatacaaggggataaactaagagacagaaaggttaagggatttatttgcgatagcctattagagtaaagccagagttacatttctgtggggaagatgaggtcttaaaaagacgatagccatcaagtagtccaggggttggcaaactttgtaaaggattggatagtaaatattttaggctttgtaggctacatatcatccccattactgttgttgctgctgcttttcctcctccacctttaaaagagtaaacaaacattctcagcccgcaggctgtacacatatagtccatgggccaaatttggaccaaagtttgccaaccctgaagtactttaatcctttcaatgtatagatgaggtgacaaaaagacagatgagtttagtgaggcacccaggtgtcaccaagtctagagagtggtggagctgggctagacctcaagtttcctcaacatttttctctttgccgtagttcaatttctcagacacttgccaattgtaggaagtagttatttacctatttaaattccaaaatgggccatttgaaaggccatggagactgaggtaccaaagttggtctcctcacctctgtatctatgcttgtctcttgctttttaatgtaattttcactgcctaagtccaaagattgtttgaggtggtgtaaaaaagtacaaatagttcacaataataaatacatgataaaaatcacgtgatacaaacaatgaaacagggaaatagtaatgctaacagaaagattagcagtaagtattgaactttgcctctggcttcctgatgcctataacaaagagaagttcatggtcagtcacaaaagtcagcgttcacacatttaaaatgaatcagttgtttgttggagcacatattttgtgattttaagaacaagtagtcatttctccaggggctctgtgtgaacagtgcactatataaagccatgttcaggttttatgtctcacaattagtacatatcaggctgcactgtttattggttagaccatggcttgtggagctgacaacctgtgttggaatctcattctggtacattcttgcaatatgaaattggcaagtcctttggcttttcttatcctccatgtccttatctgtgaaatgggaactaagaatagctacctgagagcttgtggtgaggaatggtaaatatacataaagcctctagaagagactggcacatgatcaattcaatgagcagttactattatgattgctgcctgtagattcttgacttgcattttgaaggagtgatgattgttaaagcacagacaactcagaactgatttgctattagatgaatgcttaatgattcttggtaaatgcctgaatatgaatgatttgatgctagatgtttcaagtttatgtatgagacgatgggatcttatttttttaggaggaatgggcacccatagtcatattaaaaaataaagcacatttgatgttgttaaggtaaagcccaacaaagccacagctgatatttcatcttgcaaatctcgaccttgaacttatttgttcactctctctaatcttcatacttgggtataagatagagaaaatactcatggaataaggacaacaataataaaagcattgcatttgcatgtcagcttgatagaggtgaaaataaagaagcttatttcaactcagtattatcttgcatgatttgtattaatgatatcgcagcctcagtgtttaaagccaagtttggaaatttgcagatgctactaaattatgagaaaacaacaaataatgaggcacaacgtattctgatggaggagaaatttgctcatttgggcacctcaggctaatagagagctaatggatggcaaatacagtttgtttagataaatgtcgaataatgagttttgaaacacagactaaagggagggaatgcctaatgaactgaaagtgctttagcacaataaatcaaagaatgttggtgtgtgaataaaggggatggtctaaacgtgcaaactcaaattgttttttcttttcagcaaagggcagaaatggtcaccagaagtaaataacacttttaacatgcagtaatcagcatttcagagtgcagaaataggaggaactttgaaatctgtcctatgtgcatttaatttctgctccttttccaaaattatacgatttggagtaattctgttgatctacctgaactccattttcttcatctgaaaatgagaatagtagtatttgtcagggctattgatatggtgttgtcaggtgaactgcataagggtctctgggctgagaggccatcacccacattgcaaatgtcatagatttgtctaatacatttatagatttgtctaatacatatatatgtctaatacatttataaaatacatttgtctaatacatttaagcaccatgctctttatagatagactcaaagtttcatgtttgttcattttgtttgttttaatcaatatatacataataaaaacactgctgtatagaggcaaaatatgttgaggaaggggtactttttttcttttctaaattgctaaaggcacaacagcaactggtgtgggggctaaagatttcctggttggaggcatgcacagccccagggggatgagtttttgggtgagatgggcaccagctgtgaaggcacctctctccagattggtgctgctcactgataagagatgactgctttgccaggggtcagtgtgagactatggaacagtacagggaaaatcaaaacactgggagccacagaaagaatccaccatggtgggcactgctgccctcagtgctcctgtaggattttacctttaaaaagctgcactgcgtgtgtctttatagtagaatgatttacaatcccttgggtaagacacatgcacacttatgtttattgcagcactagtacaatagcaaagacttggaatcaacccaaatgtccatcaatgatagactggataaagaaaatgtggcacacatacaccatggaataccatgcagccatgaaaaaggatgagttcatgtcctttgcagggacatggatgaagctggaaaccatccttctcagcaaactaacacatgaacagaaagccaagcactgcatgttctcagtcataagcgggagttgaacaacgagaacacatggacatgaggagggaaacatcacacactggggcctgtcatggggtgacgggctaggggagggagagcattaggacaaatatctaatgcatgcgggtcttaaaagctagatgacaggttgataggtgcagcaaaccaccatggcagatgtatacctatgtaacaaagctgcacattctgcacatgtatcccagaacttaaagttaaaaaaaaagctgcactgcaattgccaatttccttatctggctctttccctttcctgtgagctccttggaaggctggaagctaaccctactatccctccttccacaggaaagttcctgaagcctgtgtgacacttggtacattgtttctgaaaaagtgaggaatgagtctctcttctgttgcctcccatggaggtcagtgtcatatttctaggcttagttattttaaattgccttgattttttgattttaatatgcatctttttttttcttctattctgaatttttggtttgtgtcagccaacatttattgaatgcacaatgtatgacaatcattttcatgctttattttaatctttagttaatctttaacactcttatgagataaacatcgttagccccattttctagatgaataagttgaggcttagatagaaaaatagtaaattgctcaacattgcatagtgagcagattgcagaggagagattcaaaactaagtccccctgtcttcaaactgctcttaaagatttttctcagtgggtccctgaacattctttcccgtgctagtctcaaaagttattctaatattttcttattttgctcgacatacacaaacatgaagtaattacaccccactattgcctcatgtagctccaaacattccagtatccttgccctgtaagtaaatcaacattcactatttgtctttagttcccatttgtgcttagatgaataacctactctattagcctgaatttttttcatattttatatctatttttcaaatctcatttatagaaacatatgggagccctgctgaaaggattatagaaaaatccctttgggcaagaggtgtgcatgaaaaaatacagttttatttcatcactctcatgcaaaaattttcaatagctccttcttgccaatttaatcaactcaattgctggcaacttagtatccattctttaggggactagacattcatttctaaatgcacttccttcatattctatgacacaaactccctcacatgaccttcacatgtctagctccccaagtagcctgtatgctcttcacagataggaggcatatcatatatattccaatgaactatttggggaactgtattccctagctctgggaaaattgttttcctctctgtggcccagagaagccaaatcttcttttattattattattatttatttatttattatagagacagagtctcgctctgtcacccaggctagagtgcagtggcatgatcttgactcactgcaacctccatctcccgggttctagcaattcccctgcctcaacctcccgagtagctgggactacaggagcacaccaccatgccgggctaatttttgatattttagtagagacggggtttcaccgtgttccccaggctagtctcaaactcctgaactcaggcaatccacctgcctcagcctcccaaagtgctaggattacaggtgtgagccagtgtgtccggccccaaatcttttaacgtactattttctttgttgaactggaccatctactcatctgccatccaaacatgacctattcctagtaataactcgaatttgggtattcttttagagcttggaaagcatgtttacatatattatctcctcagattctcaccgtatccctatgagaaaaatattttaagcatttttatttttcagatgagaaaggtagaggttacctgatgtgtccagggactgccaaactaatgaaggctttggatgggatcctgacacagacgttgtgattctaaagtccacattctaaagcactgtcacactatcctaccccaattccatccaccacagagatgttgctttctaatcgtcctctcaacctctatacactttgatagcatcaagaagtttttatcatattaacaaccaaataaatgcacaaagtgaaacagtatgcatattctgaaaatacagattaagacaaatcttttcctctcccattcccctcgccactctcaccttggaaccaagccccactgtaaggacatgctggcgccccagagcctgtgtggtccttagcatgcaccaccttgcaggaatgagctggccctttgtccattgtttccctatgctctacttgaagaacagtaaagacagcctctgaagcacattcagttgacccttggacatcgcagggtttgggggactgccccaacccggtcaaaaattcacacataaattttgacttccggccaggcgcagtggctcacgcctgtaatcccagcactttgggcggccgaggcgggaggatcacgaggtcaggagatcgagaccatcctggctaacacggtgaaaccccgtctctactaaaaatacaaaaaattagccaagcatggtgacgtgcacctgtagtcccagctacttgggaggctgaggcaggagaatggcatgaacccgggaggcggagcttgccgtgggccgagatggcgccactgcactccagcctgggcgacagagcgagactccgtctcaaaaaaaataaataaatagataaaaaaacaaaaaagcctttgactcccgaaaaacttaactactattaataatagcctattatcggccagaagcctcagtgatcacgtaaacagttgattaacacatatttgtgttatatgtattatttgctctattcttacaataaagaaggttacagtaaagaaaatgatactaaggaaatcaaaaggaagacaacatatatttattatttattacctggaagtaggacatcataaaggtcctcatcctcattgttttcatgctgagtaggcttagaaggaagaggggggaattggtcttgatatgcaggggtggcagaagtggaagaaaatctgggtataagtagatccatgcagttctgacctgtgttgttcaagggtgaactgtactcacagtgcgggtggaaggatcaacacaacttaggacataacagctaattgctttactgaacatatactatgggctagagatggttctgatgatattacgtgtagtaaatcataatcctgaagacaaccctaagaagtagtgtcccattatttcccccattttacagatgaggaaactgaggcacaggtaaaaaaaattccaggggcacaactagtgttagatttgggttatatcttcaggcaagcccaccagagcctgagccgtactctctgtgtctggcgttgagaaaaaacaaacaaacaaacaaacaactgataagatgccagcttgagaaatggcgtagagcttcagtctgactttatgcctctgggaaacatcagaaagggggataaagtgtcaggaactccactgcagtgatatcacctacatgaggaaattgatcctgtggacgcagcatcacttaccagcctgaagacactgcaccaactgcctgattaacagcaataatgataataatactaacatccaccatttattgacaaattcctattactgtcaatgtctccctattgttataaattaagcccaagctcctttgtgcagtgctcaaggaccttcgtaacacaagatctgcctatttcttcagactcatgccgcatatatccatcctcacactgtaagctccagtgatattgatgggttcattgctcctctgcacccttcaatttcagggcttcacttacactcttctcccatcttgaacgtcctttatgctctctacacctacgcaactctttcagccttgattcaactattcccatatccaggaagactccgcatagcacacagcttaggtgaaataccactcctctgggtctctagagcaggaagggtttacatctgtcttcatatttactgactataataactacctcagtttgtacatctaacattcaccaagtattgaaattctgagggcaaaatctgtcatattcacctgtaccctattgtccagcacagcacctgcacaggctgtgtcaaaaagtgacagttggcattgtgtatcagaccctgggtatggcaccttgaatccagttctaatctcagtataacctacgagtttgagattatcgagccgtatgtactagttcattctcgcattgccataaagaaatatctgaaactgggcaatttatgaagaaaagaggtttgattggctcacagttctgcaggctgtataggaagaatggcagcatctgcttccagtgagacctaagggagcttttactcatggagggaggcagaagaggggcaggcaccttacgtggcaggaacaggaccaagagaacaaggcggggggcagggggtgccacacacttttcaaaaaccagatctcatgaaaactctatcacaagaacaggaccaaatggttggtgctaagtcattaatgagacctccatccatctgatccaatcacttcccacaaagcccacttccaacactggagatgacagtttgacatgagattaggtggggacatagatccaaaccatatcactgtattaggtcatttttgcattgctataaagaaataactgagactgggtaatttataagaaaagaagtttaatttttctcaccgttatgcagcttctgcttttggggaggcctcaggaagcttccaatcatggtggaaggaaaagcaggagcaggcacttcacatggcaaaagcagggatacgaggggcggaggggcgacacatttttaaacaaccagagcacatgataagtcactatctcagggacagcaccaagaagatggtgctaaactgctcatgagagttcacccctgtgactcaaactcctcccacaaggctctacctccaacattgaggactacaattcaacatggcatttgggcgaggacaaatatacaaactatatcacaaacctactttgcttgtgaaaaaatatgagctcagaaaaataaagtaatatactcaaaactgcatataataactaatacgtataataagaagtgttcaattcaggattcaaatctagcattgttcagagtctggaattttttttctaggtctgtattctctatcacactaactgtctccttaagaataaagtaaagttggctgagcacagtggctcacgctcataattcccgaactttgggaggttgaggcaggtggatcatttgaggccagaagtttgagaccagcctagccaacatagcaaagcctcgtctctacaaaaatacaaaaattagccaggcatggtggcatgtgcctgtaatcccagctactggggaggctgaggcactagaatcatttgaacctgggaggcagagattgcagtgaactgagatcacaccactgtactacagcctgggcaaaaaagtgagactctgtctcaaaaaaaaaaaaaaaaaaaaagaataagataaagttgatgtttgggaaactgagcagaaaaagcaacaatcaagattctcaattcttaattcatgattcctgaatcgatgcacttgaaaaagagaaaaaaggatcagctttgggaatgtgttaaacactcacttctgaacacccatggtttatctagaaagtgaaaggacccatagaacttggtcaacccttgatcacgacagatattgaggagatatgcgaatgcttggaagattcacaataatcatgttgctcaggaacatgaaaataattataggtgacatttttaatcacttacataagatgtagatggctttatgtgatttactatataatatattccttataacaaaatatgccatcatcatttttagatgaaaaagctaagataaattaaataatttctgcaagtttgtcttctgctcactaagtagaagacctcagactcaagcccagtctgatttcagatcccacgctcattaataagaatccttccttgtctggctactgttgacctctaattaggtgctcacctacattaacctggaggaacaaagctggaaaggggcacaagaatcctaggcaagagtagggaagggacggtgcaaccagacaaggcaggcatatttgaaggtggtttaggaatttacatcacgaatcccaaacatccatggagacctccttttaacacatgacttggcccagaggtaggcagtaaagagcaagttcagataaggctttttccctgcttataaaaaacatctgcaagttaaaagttgaaaagttatttatttcagctattcactcacttcagccccaatcagcacatgcctcagaatatctggagactgtgctaatacactcttgacatttggactaagacagagactgcaattcaatgttaacaacctggggtacctaaatggccattccacattgatcacttatttcaggcatttctccaaatagaaaaggttgattttatcagacattcactcttcttaatgtggatcagtagttctgtctcataccagccgtagccgcctggtgcctgacttgcccctctcacaggctggtggggttgctgacagcgtatcactgattttccacaaccagctccagagacacttgcccacacatcttctaggaaccattgcagatgtggctctatgacctccccataaactgaactcctaaatgctgaggcttccagattccctccaccaccccctgaaccagaattaaatattaaagaagtaaaatacattgtattttttaaagcaacctttgcgttgtcctttgcaaatattaaaagcaatgccactggcacaggaactaatccaagtccctggggccacttttcaaagaaagaaaagagtaatagtaagtaaacctctaaatgaaataaaggaagaaactccagctaaaattgctgaataataaaataaagacatgtaaatcatcctcgggggataattttctcctcgatcctggctgattttgcagatgaaaggaacacagcgccagaagttcagcgaccaggctcttcatcccactctgcccattcattggctttgtagcctcacttcaggcaagtcactcaatctctttggagctcagtttatgcttctgctgtagagaaatgataacaccaacagaagtcacagaggcggacctggaagcaatgagaaagctaactattttctgcctttctctctgccctcatcacataaattcaaataagccccgtgctccagttccaataaaggagtctcctcctcccgggaaagctggtttctccatctgcgcttgtgaacccacctcccgttcctgtgggggcatctggcctgagcttcggtctatatctatgaagtgggattaaaaataatgcctgcctcacagcgatgttgtgaggataaatgagctgaatcaggtaaagcacttaagacagtggttggtacatgcaaagtacacaataaatattagctcttcttatgtgtggctcttatttatccacatataagaaattttcaagtgtctttcatctgaaatacctgaatatctaaacatagttcagtcatgcaccacatcacaacattacagcgaatggaccacatatacaacggtgtttctgcaagattataacagagctggaaaattcctcctgcctaatgacatcttgatgatcctaacccgtgtgtgtgtttgtatcttagtttgtaacaagaatgtttcaaaagttaaaaaaaattaacagttagttaaaaatagaaaaaagtcttacaaaataagaattataaaatattttgtatagtggggcaatgtgtctgtgttttaagctcagtgccgttacaaaagaatcaaaaagtgaaataaaattaaaaactgtgtaaagtaaacatgttatagtaagctgcagttaatttatgattgaagaataattttttaaaataagtgtagggtaggctaagtgtacagtgtttataaggcctacagcagtgtagagtgatgtcctaggccttcacattcactctcccatcactcactgagtcaccgagagcaacttctagccctataagctccattcatggtaaatgcccaatacaagtgtaccattttttattttatgctctattgttactataccttttccatgtttagctatgttaaaatacacaaatgccattgtgttacaattgactatagtattcagtccagcaacatggtgtataggtttgtagcctaggagcaataagctgtgccataaagcctaggtctgtagtaggctatactgtctagatgcgtgtaaggacacactgatgttcaattacaaaatcacctaatgtcacacttcttagaacagatctccgttgttaagtgaggcatgactgtatattaagttatattatatataacttaaccattatatatgttattaaaatatagttaataatagatatatataaataaatttatataatataaatataatttatatattacatatgaatctgtatttctatatagattatatattatataatttaagcattatatatgttattaaaatatagttaatcataataatatatgtactgcatatgaattatatatttatatattataaatatatgtatacattatacataaatctatattatatatagattatgtatatagttctctcttaacctcttctgacttgtatcctcctctagatactacctcatttctcaactttcctatacaaccaaacttcttgaccaagtgatcaacatttacaatctttatttttctttcatttttgaaggaaaaaataaaagtatcataaactccatgtatgtatcacacattccatcatcaactccatacctcaccaactttctgttctctacattattttgaggcaaattattgacatattatttttccataaatatcagtaagtgtcattgagaaatttttttctcctctattttttgaatttccactcactcttgaacatgtagacacacatctattctagacaccaattagatagatagagcagtgatcatctgggcaatactgaatgccctcccttaacactccatattctgcctcattttccccatttatgaaaaggtttttttgttttgctttgtttttgttttcaggtaagtttgctaatgatttcccgactgtcaaatccaatgaacattttttagtcctatatcgtatagtgttacttatatggcaaagtaaagcactttcctataattttattgtctcctcccaccccactctgaacacttgcagaacgcattaccatgagtggactctgatggttgatataaataacagaagctttagaacttacacacaattctcctggcccagcactagttccactccatgactttcccattcaaaacagcataggagcctatcatgctgacagctttggtagctggtactcgggttgctgttgtccttgtttttatttgtttttgagtaattaatacatttatattatacacagttagaaatgtgcataatcatatacagttaaagtttcctgacatcttgtcccttagaaaaccaagtcccctccctcggaccaaccacttttcaggctgctgtatgtccttcagagctgctctacacatatataagcatataaagacctcctccctcctttttaatacacacctattagcatacaaatgcactgttctgcaccttgcttttccacttagcaataaatcttactgatctcttcagatcagtgcatgaaacacttcattccttttgaggatgcacagtattaaattgtgtgggtgtatcataatctcttcagccaatcttccactaatagacatttagactgtgactaatcactgccattaaaaacaatgttgcagtaaataactttgcatacctgacattttgcaaatgtttgaatacatgtataagaaatttctagaagtgttattgctgaattaaaacatatgaaaacttgtcattttttgagagatagtgccatattgtccaacagagaatttgcaccgatgtacactccaatcagtgaaaagagtggcattttcctaatactttcatgtaaatactgcttattaatttttctgacctactcaagtccaattaataaaaaacaatatcttggactaattatttagcattatctatcagccttgctttatctagatttttaaaattttaactgttattgttcattgttgccatttttctagatattatgcatatttttggtattcattatttatactttaacctggtggttgttttaacatattgtggtagttttgtttttgttgttatttaatttccaggtagtagaataaatggattttctggcttttatattgattttagttttaccccaccgtgaccagataatgttgtctgcattatttccatgtttgagaacatattgatgctttcctagtgattatttttttgagaattttcaatggatcatctgaaaaatgtttaatctcacctattagtctacggagggtaactatatatctattacatctcatttttaaaccatattgcttaaatcttttgtatatgttttttattcatttaatctttcatgaaatggaaaaggagaattgaaatctacgattactttatttctgtgtatttctccagatactgcttttttttttctttatacaagttatcattgcaggaattaggcctacacaaaagtgcaagaggtggggaagtgaaggtctagaagtagactaaggattcgagaaggtgtcctcactaaccacttgtgataaaaaattaaataaatatgtgggctttgtctctagttcctgacatacagctcctaaagtccttagaatctgcagagttctgtgcctttggtgtgccaacaagttactggtggctggagcaccctggatagatgcaggatggaggctgggcaccagcaagtcctaggcatggttggaattatagcactttaagcccgacctcccaacctctgggcagaggaaagagggtagagattgagttaaccattaatggccaatgaactgatcaaggatgcctatgaaattaaacctccattaaagcctgtaaaggggtttggaaagcatctgtgtcagtgagcgctttggggtgctgagaggtggcatatcccaaaaagccatgaagactctaccccttcacccattcttttccgaatgcagctcctccatttggatgttcctcagctatgtccttgaacataaatcagttacattaagtaaagtgcttacttgagttctgtgagccattctggcaaattatagaaactgaggaggggtttgtggaaacccccatatatatagctggtcagtcagaattgctagtgacaacctgaggcttggggctggcacttgaagctggagccatcgtatgggactgagtccttaacctgtgggatctgacactgactccaggtagatactgtcagaattgagttgaattgttcaacaaccattggtgcctagagacttgaaaattgattggtgtgagggaaaaaaaacccagacatttggtgtcagaagcgttgtgaataaaacagttcagatcagtgctcctgaagcaccagtgtggtggacaagtgggagctttcaggcatgtctgagaagccagcacatccaaccacgtaggcaggactgtgaaatgagagctcagggagaaagagagctggtgctgttgtgcagtgattacctttgtgggtctgaaactaacctctgatgatgggcttgggaccactatgctctcagggctggcagtgaggaagaaaagctggacctggaattgagaacaatgagggctattggaaaccactgcgtctatctttgtccctgaccatgaagaccttccagaggcatccagaccacattttgaatcttcttcaagtgaactttttgtctcccagaaccatataggaaagggaaatctggaaaatgaattttctagcttaacaaggttgactcagtacaacacaactcacctttgctcattatgatattccaaactttctgaatcacttgttatagatgtgtctcctacatacagtatagagtttagatttgattttgtctaatcttggattttttaaattttaataggtgagttcagttatattgattagattgtgtagtagaaagttatgcttttagttaatcaaattttttgttacagtatttcctctggtgactgtatcaaaataattcaagtagactgtatgttcttggctttgtgctagcaatgtgtgtgaacccaaaatatctgagacaggtctttaccaatttagaaagtttattttgtcaaggttaaggatgcacatgcatgacacagcctcaggaagccctgatgacctgtgcccaaggtgactgaggtacagcttgcttttatacattttaggaatatatgaggtatcaatcaatatatgtaagatgtgcattggttctgtctggtagctgggacaacttgtagtggttggggacttccaggtcatagctagataaaagacaaaaggttgcattattttgagtccttgatctacctttcactgaatacacaatttagttgagcatagtgaatctgcatttttacataaacagtggggcagaagaaacagtcagatatgcatttgtctcaggtgagcagagcgatggctgtctgtcctgcacctgtgaagattagctgctggtttacattgccagggtgaaattgcacaaaagtattttagggtaaaaatcttgaggcccacaaggaattttaaccttagagctctaacttcatataatatccttaatcctctctctctttaaacattatctgttgacttctggttatgagcaatgattaaattaatagctttcctctcacttgcaactgtcacctgatcttattttattatgttctctttctcagtgtttacctttgtaatattaaataggcttacccttctactacttcaaatgttattgcttagggaccatcaatagaagacgagcagcccggaagacacttcctcccacttctcacccctttgccctctcaggccatctctctgtctcgttaatatttgtaacagagtttgcacgtatgatactgttgctcccgtgctctgtgccatgtctcagaaaaggaaggtaaaatgcctacgttcctctctcatgtgcacattagaagtatatgggaagctttgaatgtgttcaaagttaatgatttccaaatttagtcacttagataatattattttctaacgtttatttgccacacagcaagataattttagccacccactggtttgtagaaacccttcactggagaaccacttgtccagtacagatataacagcaacttccttaagacatttcagaaaccagaaagtgatcaattattttttatctaacttgagtttataaggctcatgtgtgctccttacaggggatattcttagactgtcattcatgcccctatcctcatcatattcccacaattctagtaaaccacagcttattactgagacactatcacattgaaaccctaacataagagctttccagagataaattaagtaggagcatacatcctgggagcaagcaagtggatcccaaaaagcacagagatgtgaggtcttcaatcacgggcagcttcctgagccggcagccagtgaggtcacataaggccccttgctccaaagggtccctgattgaaaatctttgaaataattaattttgtatttaaatttgtgctttttaactgatgtcccaggggaaaaaggggcacacactgaggcctcaaacccttgcctcacaggtagattttaggctcccagcttctctgcctctggatgccccaaaccccactcagccctcacctcacacagtgatagctgccatcctgtactcgaggcgaggcccaggcacacacacaggtagagttggggatggttacacatccccatagcatcttcatgtggggcatgacagagctgtcccttgccaggctggaaataccaggacacatgaggtaggcgcatcagtagtggcaagcctcttgcccacccttggttcagataacaagcgtatcctggaacaaaagttgtggtccttcagggaatacccatccttcttggactgggaagctggtacctggaaaccagagaccgatttccctgcctggggacagggcatctgtcaggtagctcacagaagggataaacagacagctggtgagccacaggtgtggctggctacatcacagggctgacccccatgcaccttggtagccccttgcctgatagggtataatgttaaatagcaggtaaataacaccatgacaagtcaacagagataccaggaagaaagtaaaatatgtgcatatggaattttgcactattaacggcactttattctggtttttgaacaaaggatctgcatttttatcttacattgagctcctcaaataaagtggttagtcctagaagtaatttaagtacaagacaatcttaccaatggctctagctattagggcataacttcacaaaattacaacaagtgctcacaagtactattgtaggctattctaagtaggccacacatgtgttcagtcctacttagggattaaaggcatatcaaccacttttttggggtatttacttgcttcaggaggtccaatcatttgcagatttgcagaatacttctccaggttgtgattcttttgctgtgagctcagtggaagcctctgtaaacctgactgtgacatcttccctttaaatcatctgttgttatgtatggactgctccttttgtactgagcaccgggattcagatttgtgaatggggaagtatatacaaagataagcaaaacactgactgtagattccatattcaagcctatctggactcatataatcgatgaattcacatgcatatattttggctgtttggccctggaagggagggaagttaaaacaataaaaaaaggccggtttttcaagagcttagaatgaaattggcagcaaaacacatattcatattaaagagaaataaacaatcaaaattaataataattattatggctgtcagatgaacagtgtcttcaaagagttataggaaagataagactgtttattgactatttaccataggtgaagcagtgtgctagcattttatgtatgtgatttcttccttccacctctcctgagagagggctattggtatcctcattttatagacaataaaactgaggctcaagtagcttaggtagtttccgagggccacacaacctgttgtcatttaaaggcaggtctatgtgaccccagagtattctactgtaaaatgtaccttccaaggataactgtctcatctctatttattcagtacatttgccattcaaaggactttcacatctattacctcatttgatctgcacaaaggcccttgatagaaagctcaccaccagaacggggagctgaggcacagagcaggtgaagagcccaagttcattatcgattcacaagtgaggctcctctgatctcccatgatctctacttgtctggtaaatgaatggactgaaaaatgagtgtataatcaaagtgcgatttgtccagggtggtattgtatgaataatttatgtagcataaatactgctggatggagcacttaactaaacccttgatcagatgcctgttattatctggctggaagacaatcaaaaaatgaaatgaaatttgggcaaattccatacacacttgggaaaggccacagagagcaaaggaagaacacaaaaagagaggaggaactcttgagagtttagagtgcatttggattcccaagactgctggaagtccatgatgaaaacgtgctaaagtgtagctgcatatctaggggagaaattacatgtagccactgtgattgcaattaaactggaggctcctttctggctatgatacggtgggtgggttgtttcatacatttgtagcttggcatgactgattctgacattgctaatgatcttaatatcactcgtacactgatgcatatgagcctgtatcagtgtgtattttaaaattcatggaatataaaattattgatctctcctcaaaatccaaatcaccataccacaggcttcatcactgatgtcagtaactaaaaacagctctcatgaagaagccacagtacaactgaaacaaaaccagaagggtggtcacaaaagggaatatcaaactttcaaaactcgaaggcccaaggcaaatgatttattgggagttggcataaaaatttctatgacatccccttgtcttctttccggtccttcttcacgttaatcatacagtgggcctttattccaaataataacttttattcctgtccttacaatttctccaaactcaaagctttgtgtcactacactgtatctattcaggtttttttaagaaatcaattcataattcagcatgcacactgctacggtactggtccagtctttctcacttctgtcctggaagacattatctgatgggcaagaacactgaatgacttgtccctagctagccatgggagtaccccatctatgcaagtttgctggaatcttgtgctgctcagaatataatactggagtttcatgtgttctcccaagcaaatttgaaactccctgaaggcaaacatagagatttctgctccattcaggcttgtatagaaatctggctggctttttaagtattcacagggattaccttcctgactattaattttagcttgtccttccttggcatcactttatttagtttccaaagacattgatttcccacttttgctgtgaatacttccctcaggttccccctgagttgactatttggacaagaatgtctagaactctgtctcacacctaaaatatggctctagctctgattggaagcatcatattttcatataagagatgttctggcctcctgccttgcttgaaaggtccatgcttgctgagccaacttgtcacactcctcttagataggatggctgttagtttctgttctgtttctcttataggcttctcacacagttagacatagacttccttgtatgtatcaactgagctctcatgttgagtttagtgttttattttttaatctttataaaattttgtgctcctaaagataaactcatgaaacaaaaatatttagcatgatgatttgttgcaaagtgattgcttgtgtaggcaccaatcatgttgagaatgaaaacatcacaagcattcaaaagtccccattatcacctccctcctcccaaaaaaaaccccatttgtacttcttgtttttctttatagtatttattacctctgcagcaagcatccttaaacactccgtatttttcaactctataaacagaatgtatcattttgtgtttcatttcttgtgtataatattatgtccccttaaggttctttcaagttgtttgcagcaatacagatatttcattattttcattagcaatcaggaaaatccacacaaaaccaaaataagatttcatacacaatagaaagaatacctaaggttaaaatgaaattttaaatggacaatttcaagagttagcagagagctgatacactgcctgtgaatgtaagtatatccagataatctggagaacaatttgttattatctactaaaatttaaatgtgtatacccacatcccgtggctcaacaattccacttctacatatgtatccctctgaatcacatgcacatcatcctaacagcatgattcatagtagctagaagctggaaacactccaaatgaatgtcagaagtaaaaggataaattatttcataatcttacaattaattctgatgtgggataattcctttaaagttttttgtacacctttctttataggtgttatatgtctcactcaaaaagaaaacgttaaaaaattctttattgtacaaatttaaatagaagtactctatacctctatgctgggtaaatgaaatactaggtctgttcaagtctttcgcccacttttttctatttgaatgtctatattgtatatatctattcaactgatacatatatatgtgtgtgtgtgtgtgtgtgtgtgtgtgtgtgtattatttgtagtaattttttaatatcctggattggagccctagttctctcttgtgttataaatatgtcatctcatcttactgtgtgtttgttcattttcttaattaaatgaaaagataagttcttaattttactaatctaattcagcaatgtttttccttatagcctcttgcatcttgttttaaaaatgtataatatattctatcatctagaagccttattgttttacctttcacatccgtatttataatccttttgaaattatttttgtggattatgtggagtaaggtcacactttattttttccaattgtccacatcattgaaaagatcattttttcactgctctacagcatcacctttgctatatatcaagtgtctctctctctatatatatatatatgtctattactaagtttccaattatatccccctgatctatttgcctaaccttgtgccaatatcgcatgtcctaattactgtagttataatgatttgtggtagatacaagggaaaaaagtccctcacctcattcaagagcatcattagctatacttcttatttttaattttttatacaactcttagaataagcttgccaagcttctaaacaaaatgtattgcgatatcaattggcattgcattgaatcagtagatcaggattagttcaggaataactcacattgttacaacattaagtcatgaatcaatgaaactggtccatctctctcttcatttatttagttcttcttgtatatttcactcaatgatgttttaaaattttctaaatacaaggctgtgcttctctagttacatttattcttagatattaatatttttatgatacattataaattgtatcttatttaaaaataggatcttctaattgtttattactggtatacggaagtaaatttattttactaaattgaccttgattcatcagccttgctaacctcatgaatcctaataatttatttatgaattttatcacattttttgtgtatataatcaaaccatccatgattaatggcatttatatattttcctttctggtcctaatatttaaatcattatcttgccttattacattgaaaaggaccttcagtacaatgctcagtagaagtaagaattatagacaagcttcttcattcataatcttagtaaaaatatttcaaaatttcatcaataaatacgatatctgattgaatatgtttgtagataacactttactaacttaaataatttcatttaatatttgcaatataccaaacatatggatatatatattatatgtacatatatttataatattgaaggtggatttttcaaatgctttttctgcatctaagattttatttttatgtcattaatataatgaattacactggttaatttttaaatcttaaacaaacctcaccttttaaaaataaatccaaattaattactgtatttagctctatatatctagagatctaaatatctgtagatactataatgatgttatgataatagcacattattatgattagcatattattatgtcatgatatataaaatcaaggattctacatatcttttttacatattactagaatcatttgactattatattttattttttaaggatgacatatatagaaatgtgcaaaaatcatagatgtacaattcaaataatcatcataaaatgaacaccctttcataactaagttggctaacactttgctacaggttttattagatcatagcaatctcataaaccatggacacattaagagtttttttaatttactttttattaatcaccaggcttaggaatttcggactgaaactcagggtattggaaataaatatttggggcataaagattattgacattctaaccaagtaagggctagccaggccctcagtttttggaaaacattgaaaagagtaatacgttttgaaaacaaaatcgagtgggctgctggcagagctataggcaaaggccttaaggtaggaaaagatcaaggattctgaagtcagatagacctgggtgtaacacgatgaaactaggatttctcttctgtaaaaccaagaaatgattgaattattgctttccgtataatagtcttttttttttttttttttgagacgatgtcttactctgtctcccaggttgacgtgaggtggtacgatcaaggcttgcttcagccttgatgcctcagcctcctgagtagctgggactacaggcagatgccaccacgcctggctaattgtgtgtgtgtgtgtgtgtgtgtgtgtgtgtgtgtagagatgaggtttcacatttgtgcaggctggtctcaaacttctggcctcaagctattcttctgcctcagtctctcaaggtgctgggattacaggcatcagccaccatgcttattttaagagtcctgagaccaaactgtgctggttggtaaagctcaatgcttggcactcagtcaacgctcagtcaatgttaatttctttctttctacatcttccttcagttaacacaaacttacaacaatgaagaaataaacattaaatgctctacagggccagtttttgttttcttttgttctttaggtataaacaaggaactaataagaggaaaaacatagcagcacttacagcagaaggaaaatccagactggatagtagctgaggttgtggtccctccctcccacttagtacagagataaagtgggtaccaggtgttcaaactataaatgctgagttaggagggatgtatacaagggtgtgaatcctgctatcacagtccccatagcatgagcacatgacctattactttctgtaggaagtgaagaagggtatcgggtaaaactctcttctgtgcaattattcacacaaaggaatcaaagagaagggaagagatggcagtagcagggctagcagctggacatccatagttttatttcactgtatccatgtacttagtcccctgaggtgagcttcgttgtttcctttccctttggtgactcaacacagactccccacctgtgcatgaagcactgcacatacattgagctgggccatggtgattgggcttttcctagaagataaactcttccatttttacataaatttaaatgtgtagcacagatctcctagaaatgtgggtcatgtttttattgaaaattttgtatttgtctattagtaatttccatacaccagaacttctgttaagattgcattaaaggagtggacatccttcatgaggaagatcctctgtgacattcctcctacatcatcttttggaggccacctttcagagtggcatgcatttcactaactgggtccttcatcccaatacagcttactgccagtgagctagaatccaggctgaaataaagcaagccaggacttttaagaaaatgaaacgtgattacaattttaagcacagatatctgagtgggtccttggcatgttttgccattatttccatagctttgcccttgaaatgtgagacagcactgaaacactctcctatcctcctctcctaacagagtagcacacactgatattgtcagcattattctcaaagtgttacttcagcttaagtttcccttattttcatttgattttctggttttgctttcagaaaatataaaccgagccaagaatttgcatcttcctagggcagaaacctgaggtctattctggaggctttatctgaatttcacctctcctcacatttcctaatcccacttttccatttgatattattctatcactgtctgacatattatatatcttacttgattgacttgtctcttacttgtctcacttagcacaatacaaactctgtggaggcagagactttattatgagtccttaatacctagagcagtacaaggcatatagcatatgctccatacatttgtgtagagataattcattatctcaatttataacaagaagcactgcatcctaaattatccaagttgatttggggtaaaaagttaggttgggaaacgaaggaaaagaatatttaaacaatctataatgaaatatattaatttaatgagtacttaacactgtattttctaatcaaatagtactcagtaaaaaaagccttgttcagcataagtgaatttctttccatagcaccgacttcttaaaaaaccagtacttacctactctcctgttctgcactcaagcacgaaattgattaaatcacttaattaaataccaatttaaattaccaattctgaggctccacttccagaatttgttaaaatgtaacatctctgtgcctcactctcagagtttctgatttagtcagaaattaagtgggaggattgcttgagcccaggagctcaagaccagcctgggtaacatggcaaaatccggtctctacaaaaaaatacaaaacattagctaggtatggtggcatgaacctgtagtcccagctacatggaactatatttagtcagaaacacagaagcatacatttaaaaaaattttcagggaattcttacatgcagtaaagcttgcaaaccattggtctaggtatttttttttaaatgacactattcttttaaaatcatttttctttcagtccttctgaaataaggtttgttcatgatcatgcaacagatactttagaatatatgtatatatctttttatatatttgtgtttaaaatacatacacacacacacccatgttatacacacacatatacaaagcctataaagccaaatgtatatccttaaatgttttgataactgaaggacctgaaaagccacagcacccaccttggattgtcatttgtgcaaactataagtcttgcattcaacttcaaacagtcgacaagtcattctcagacctgtccctttcagaggacatctctgtcactgggcagattgaagggatagtaaagaggattcaaaagcactgagccttgttttccagtaagaaactgacatgacagtaagctagttcactgtgtacaccatcatgacccaatctgcgtgtgggaattctgagctcttgagagaacatgaagagtgttttgggaggaaataagggtagtggaaggtcaaggagaaatagttctttgatagcagctcacacttcttaatgaaagctgcctgctacaggacttgtggagagctgctatgtgacagagagagacacgtaagggagaggaggaggaccaacatttgcgaaggccctctgtgggctgggaattaacatgcgtatctcatttagtcttcgtaataacccacatgctaaaaaaagtccatttgtattttagacagttcagttttaccttcagtttcctgtaccacataatttgtccagaatcatagatctagtaaatgggacccaggtctatctggctccaaatactctttcatgtatacaatgctgctaggccctgggaggaggcagagtgtcagaattactcccatcttactagtggatatggtgaattcacactggctttctttctgttggtggatcagaccaagctctttagggccgttgcacttagtgttctctttgcctggaacactctcacaagcgagtctttgtgaggctgacttttcctgccatttctgtgtcagttctaatgaattctatcccgagtttcctgactacctagaaagaaggaacttccccactcactctcatcgcgtcactgcttcattgtcctcttggcacttatcagctgaaatttctgtgcattgtttatgcctttgatcactcatttattgttctatttttttaattagaatgaacatttctctttttttctctttttagaatgaacatttcttaagagcaggaagcttttttttttttttaatgcctgttgtatacttgatccttagagcaattcatggtaattactaggcacttagtatgtactggatattttaatagaatgggtaaatcttgttctcaccagtaaaaacaaaacactttcaatttttaaaaattttgtctatagcactgtgggactgaccgatagtaatttttgagcaaaacgagctcaccaaattccatatgggtgatgtcatgttatgtacaaaaataatttgagatagaataggggccgggcatagtggctcatgcctgagatcccaccactttgagagacctaggagggatgatcatttgaagccaggagttagagaccagcctgggcaacacagcaaaatcccaccccttaaagacaagatataagatagactatgatataacattttatttaataaagtctaaacctcaaagtgatagtcaaaagctgcagtgaacagaaaggaaaggaagaaaccactgcaggctctttacatcagggaatagtgtattcatttattaatattaatttagtgttggacactgtaaagcagtggttctcaaacttggaaccaccttgaggacctaaaaagtgctcttatgactgggttccacctcagagtatctgatttaattgttctgtggagtgacctgggctttgggatatttaaagtctcccaagatcactctactgtgcagacaggtttgaggaccactgttctggggatagagcaccagccattgtggttgtcagagtctgatgcaagtgacagattcagcaattacggtatagggctggaagttatgtcttgtgataaccatgactgtaggttactatggaagcacaaagtagatgctccccaaccgaggtcctcccatcacctcccagagcctaggctgagctgcaaaggatagagagacaaaaaaggaaggccattgagggcagaaatagagagaattcaattggcagggagcaaaggtgagccagagagaacttttgcatctttggtgcatgaagtagcaagtaaaaggaagaaaaaagccaggtctggacaagtactctttgactcaggacataaactctgtcttaagagatgaatagaacatgaataggctcagagaaaaggaagttaatcttggagaaaacaagagttataacaggtttagaaactatctggtgtaatcagctaattttatagatgtcttaactagggtgcagaacagttattcaacctgtcccaaccaaccaaccaaaccacgtaaggacagaacctcgactgcaatgtaggcttggcgatttacaggcaagttttcaagcactgcagtgcagtcataggggaaaggcatgaatggaagcaaaaagagtgtagtgtgcttgaaagagtcacaatactggtcttacaagaaagtaaaatagatatcaactaaatgaagacatgtcatttttctcgttatatgacctcaatgaagtgcctgggtatgcaatcacccatacctgagtcttggttcaaaagatgctcttctttttaagttgaggaaggcatgtgaggggtctctgttggatctatttttttgatgttgtttgaggataaattttggtgtaagaaaggtgctggtgttaacaatagtgccataataactgttcatctgtataacagatttggatcactcaggaggttcagtgtgttccctgccttggccatctccatcttactgacagcatttctgtatcttaaaagcatggaagcttttggtcttattgccatacacacacacacacacacacacacacaaacacacatgcacacacgcatacagatgcatacaatttgtggcctttgctttgaatgaaataagtgaacacccttactacctcctctaagtgtcttaacttcaatttattaggtacagactgaccctttaaatcacacttcatcagtgcgaaccctgaccaaaaacacaaggcttcctctccagctgctctgtggcacacacgtgtgcattttccttcctgcttagcatgcttgtgttcctgaaatattttggaggctttctcctttttctgtattttggtttcaccgacatcagcacacccaaggcagtggcgctgcaggagagactgctgtgcatgattggtgtgtctgcacagtcaacacaattattgcctatgtctgacttccaggacttttatcatcattggggagagattcacaagtaatagcaaatgtcgctgtggtcaaatggtaaattaggctttaagaggctacaaatgggaaaattatgaggtattttaagacacgagacgtacctgagggaactccttgccccatcccccaatcattcctaaactatcccatgcacccagtttttacaaccctcatcaagacctgaagtttccctaccactgcagcccacattgatctttcccttatatgaacatcagctgagttttatagtgtgtatcaaacaatttagcacttaacgctaattaaatgaggttaaataaaatcacttctgcagaagtgcctgctgtgaactgtacaagacagatgcatggaactattaccaccattaattagattaattggcttttgtatgttcatttttcctcctcagctctttagcaagcattctactggaggtttcataccagctaattcatgatggggagaaaggagatgctaaatagctgtggatttattaaagatgggattacgtggtgggccagattcatggctcgttatgcacagtggtcttatttcttcctgccaccattttctccttgaaaatttcccctcatctttgcaaagggaacaatgccagaaccctatccagctatatttagacagccagaaatgaaataactgtaacatgattgataaccttaagtccagggaaatgatattactaattaaatcgtgaaacattaggcaggctgtcaggcacagatatatttaaagtcataacagcccttgcttatttttaaagtgtttgcatattgaatgattctggtaaaattgtttctatttatcagaccaagtataaagtgctcatctccatggtatctgcaagcatagcagtcaatctaagataaatccaggcccaagagagcaatttctcctttatctcacattctctccttctctgtaacccttttatgaggttcactaaaatgagtttcattcaactttggaattagcacattccacactttacaatttctagaagcacaagcatgtgatgagctgagatagaaggaaaaggcacaagtcacagagcttcgatttactggatgcttattgtgtgccagatcccttagatctttgagttgctaatcttcctgtcccaattttacagatgcaaaaccaaaccacagaggtggtaaaagacacacacacacacacacacacacacacacacacccacaccttttcccagctaacagggagcagattgcttttggaactgagggctctttgacacccatgtcagtgccccttcaaggtctagtgataagaaaaaaaatatatgtatatatatatatatctcacattaagaagcagatgagtttttttcagtccaagatggccaaataggaacagctgcagtctacagctcccagcgtgagtgatgcagaagacgggtgatttctgcatttccaactgaggtaccgggttcatctcactggggcttgtcggacactgggtgcagcccatggagtagggtgaggcatcacctcacccaggaagtgcaaggggtcggggaattccctttcataaccaagggaaggcatgacagacagtacctggaaaatcaggacactcccaccctaatactgcacatttccaaaggtcttagcaaatggcacaccaggagattatatcccatgcctggctcggagggtcccacgcccacggagcctcactcattgctagcacagcagtctgagatcgaactgcaaaaaggtggcagcgaggctgggggaggggcgtccaccattgctgaggcttgagtaggtaaacaaagcagctggaaagcttgaactgggtggagtccaccgcagctcaaggaggcctgcctgcctctgtagactccacctctggggacagggcatagttgaacaaaaggcagcagaaacttcagcagacttaaacgtccctgtctgacagctttgaagagagtagtggttctcccaacatggagtttgagatatgagaacggacagaatgcctcctcaagtgggtccctgacccccgagtagcctaactgggagacacctcccagtaggggccgactgacacctcatatggccaggtgcccctctgagacgaagcttccagaaggacgatctgacagcaacatttgccattctgcaatatttgcggttctgcagcctccgctagtgatacccaggcaaatagtgtctggagtggacctccagcaaactccaacagacctgcagctgagggttctgactgttagaaggaaaactaacaaacagaaaggacatccacaccaaaatcccatctgtgtgtcaccatcatcaaagaccaaaggtagttaaaaccacaaagatggagagaaaccagagaagaaaagctgaaaatactaaaaatcagagcacctctcctcctccaaagtaatgcaactcttctccagcaacggaacaaagctggatggagaatgattttgacaagttgagagaaggaggcttcagacgattggtaataacaaacttctctgagctaaaggaaggtgttcgaacccactgcaaagaagctaaaatacttgaaaaaagattagatgaatggctaactaaaataaacagtgtagagaagaccttaaatgacctgatggagctgaaaatcatggcacgagaactatgtgacgcatgtgcaagcttcagtagatgatttgatcaagtggaagaaagggtatcagtgatggaagatcaaatgaatgaaatgaagtgaaaagagaagtttagagaaaaaaagagtaagaagaaatgaacaaagcctccaagaaatatgggactatgtgaaaagaccaaatctacgtctgattggtgtacctaaaagagacggggagaatggaaccaagttggaaaacactctgcagcatattatcctggagaacttccccaatctagcaaggcaggcctacgttcaaattcaggaaacagagagaatgccacagagatactcctcaagaagagcaactccaagacacataattgtcagattcaccaaagttgaaatgaaggaaaaaatcttaagggcagccagagagaaaggtcgggttacccacaaagggaagcccatcagactaacagcagatctctcagaagaaactctacaagccagaagagagtgggggccaatattcaacattcttaaagaaaagaattttcaacccagaatttcatatccagccaaactaagcttcacaagtggaggagaaataaaatcctttacagacaaacaaatgctgagagattatgtcaccaccaggcctgccctacaagagcttctgaaggaagcactaaacatagaaaggaacaaccagtatgagccactgcaaaaacatgccaaattgtaaagaccatcaatgctaggaagaaactgcatcaactaatgagcaaaacaaccagctaaatcaaaataacgggatcaaattcacacataacaatattaaccttacatgtaaatgggctaaatgcaccaattaaaagacacagactggcaaaatggataaagagtcaagacccatcagtgtgctgtattcaggagacccctctcacatgcagaggcacatgtaggctcaaaataaagggatggaggaagatctaccaagcaaatggagaacaaaaaaaagcaagggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagcccttagagacctacaaagagacttagactcccatgcaataacaatgggagacgttaacagcccactgtcaacattagacagatcaacgagacagaaagttaacaaggctatccaggaattgaactcagatctgcaccaagtggacctaatagacatctacagaactctccaccccaaatcaacagaatacacattcttctcagtaccacatcacacttattccaaaattgaccacatagttggaagtaaagcactcctcagtaaatgtaaaagaacagaaattataacaaactgtctctcagatcacagtgcaatgaaactagaactcaggattaagaaactcactcaaaaccgctcaactatatggaaactgaacaacattctcctgaatgactactgggtacataacaaaatgaaggcagaaacaaagatgttctttgaaacccgtgagaaaaaagacacaacataccagaatctctgggacacatttaaagcagtatgtagagggaaatttatagcactaaatgtccacaagggaaagcaggaaagatctaaaattgacaccctaacatcacaattaaaagaactgcagaagcaagagcaaacacattcaaaagctagcagaaggcaagaaataactaagatcagagcagaactgaaggagatagagacacaaaaaacccttcaaaaaaatcaatgaattcaggagctggttttttgaaaagatcaacaaaattgatagactgctagcaagactaataaagaagaaaagacagaagaatcaaatagacgcaataaaaaaatgataaaggggatatcaccactgatcccacagaagtacaaactaacgtcagagaagcacctctatgcaaataaactagaaaatctagaagaaatggataaattcctcgacacatacaccctcccaagactaaatcaggaagaagttgaatctctgaatagaccaataatgggctctgaaattgagccaataattaatagcttaccaaccaaaaaaaagtccaggacctgatggagtcacagccaaattctaccagaggtacaaagaggagctggtaccattccttctgaaactattccactcaatagaaaaagagggaatccttcttaactcattttatgaggccagcagcatcctgataccaaagcctggcagagacacaacaaaaaaagagaattttagtccaatatccctgatgaacatcaacgcaaaattccttaataaaatactggcaaaccgaatccagcagcacatcaaaaagcttatccaccatgatcaagttggcctcatccctgggatacaacgctggttcaacatacacaaatcaataaatgtaatccatcatataaacagaaccaaagacaaaaaccacatgattgtctcaatagatgcagaaaaggcctttgacaaaattcaacaatccttcatgctaaaaactctcaataaactaggtattgatgggacgtatctcaaaataataagagctatttatgacaaacccacagccaatatcatactgaatgggcaaaaactgggagcattccctttgaaaactggcacaagacagggatgccctctctcaccactcttattcaacatactgttggaagttctggccggagcaatctggaaggagaaagaaataaagggttttcaactaggaaaagaagcagtcaaattgtccctgtttgcagatgacatattgtatatttagaaatccctatcgtctcagcccaaaatctccttaagctgataagcaacttcagcaaagtctcaggatacaaaatcaatgtgcaaaaatcacaagcatttctatacaccaataacagacaaacagagagccatatcatgagtgaactcacattcacaattgcttcaaagagaataaaatacctaggaatccaacttacaagggatgtgaaggaccttttcaaggagaactacagaccactcctcaacaaagtaaaagaggacacaaacaaatggaagaacattccatgctcatggataggaagaatcaatatcatgaaaatggccatactgcccaaggtaatttatagatttaatgccatccccatcaagctactaatgaatttcttcacagaattggaaaaaactactttaaagttcatatggaaccaaaaaagagcctacattgccaagaaaatcctaagccaaaagaacaaagctggaggcatcacgctacctgacttcaagctatagtacaaggctacagtaaccaaaacagcatggtactggtaccaaaacagagatatagaccaatggaacacaacagagccctcagaaataataccacacacctacaaccatttgacctttgacaaatctgtcaaaactaagaaatggggaaaagattccctatttaataaatgttgctgggaaaactggctagccatatgtagaaagctgaaactggatcccttccttacaccttatacaaaaattaattcaagatggagtaaagacttaaatgtcagacctaaaaccataaaaaccctagaagaaaacctaggcaataccattcaggacataggcttgggcaaggtcttcatgactaaaacaccaaaagcaatggcagcaaaagccaaaattgacaaatgggatctaattaaactaaagagcttctgcacagcaaaagaaactaccatcagagtgaacaggcaacctacagaatgggagaaaatttttacaatctacccatctgacaaaggactagtatcaagaatctacaaagaacttcaacaaatttacaagaaaaaaatcaaacaatcccatcaaaaagtgggcaaaggatatgaacagacactaccccaaagaagacatttatgcagccaacagacacacgaaaaaatgctcatcatcactggccgtcagagaaatgcaaatcaaaaccacaatgagataccatctcataccagttagaatggccatcattaaaaagtcaggaaagaacaatgctggagaggatatggagaaataggaacacttttacactgttggtgggactgtaaactagttaaaccattgtggaagacagtgtggcgattcctcaaggatctagaactagaaataccatttgacccagccatcccattactgggtatatacccaaagaatgataaatcatgctactataaagacacatgcacacgtatgtttattgcggcactattcacaatagaaaagacttggaaccaacccaaatgtccatcaatgatatactggattaagaaaatgtgtcacgtatacaccatggaatactatgcagccataaaaaagggtgagttcatgtcctttgtagggacatggatgaagctggaaaccatcattctgagcaaactatcgcaagggcagaaaaccaaacactgcatattctcactcataggtgggaattgaacaatgagaatacttgaacacagggtggggaacatcacacactggagcctgtcatggggtatggggaggggagagggatagcactaggagataaacctaatgtaaatgacgagttgatgggtacagcacaccaatatggcacatgtatacatatgtaacaaacctgcacattgtgcacatgtaccctagaacttaaagtataataaaaataaataaataaataaaaaatacccatcagaacagaaaaaaaaagaaagaaagaaatggaagcaatgtacaacaaaatatttgcgtttaatacaactagatggtggttgcatcatacatttgtaccttgtgatgtatttaattcataataaaaagagataaagttataagcatattacttagaaaaaaaagtagatgaaggtgtaattcttctccagaggtagtcacacttgtgagtgaagttcttttaaagacagttctctaaagccagtgggatgaagagaactctatgggcttcgaggttaagcatatctttgccccacagccaggctgggctaagaactgtgtggccaagatcacataacttctctttcccaggcatcctcatccccttctgtaacatgcagcaatgatacccactttgctagtatttaagaagattaagtgggaataatttaaaaaaaaactacaagaagacaaagggcaaggaagaggggtgagtgtaggacttcctgacatttccagaattgcattcatgcaggggttttcttattctctgttaaagatggtattaaatatttcctagtgcacaaattttggcaaacataataggcacatcttgccccaacacaaggtattagattgagcacaataaaattgtgaggaaaggctggaaaatcatgttaaatagtattaagaaagccttaattgaggctccaaaatgattgctttaaaatctctttatcttggtttgttattttcctgacggatgttggagggaagggtgccttcagctgacctgtgttgcattctaaaaggctttctgttaggattgcaaatgagtaaacagatactgtccctaatcctgaaagcactgaagacatcatggtaaattacatgcacagaaggaaagaaggatcttttggcattaaatcccggtctgggatctcatcttcattctatatggattgtcaatttgccaaattcaaagcctcaagctattgtaattagactttgaaaatctctctctgatttccttttcaccattgacaaggatttgctactgaaaattacaaattgcaaatatattgtcagggcctgcaactggtcatatttcatttcactcttaagttccaagaaattacctttgttttagtgtttaatttagttggcttcaaagtactaactctgatatgagtgaacaggagaaggaatgagaaggaatcacagactcctatatcttggtggtcaggatccttcccaaacacagtgccctgttgccaaatctctgggcccaccgactcaggctcaattcccactgtgcttgttcagtcttttgcctgtatacctgccccctcctccatccaagctaaatcttgcaggtggaatgagtgccctttagcctattcatgggctgaccatacaacttttgagagtggaaaaaagaaaatgatcattcctgaaaaagtttcaaaaaatgaggcttggctgggccagacaggttgtctggtcaccccatctatgcaaagctatcttctttataggtgcagtccaggggtcctccatggaagtttcactggtggcgacagcatcctattagctcttccaacactaactgtgagccccaaactcatttttatatttaattatttcaaggcttatataattttttatcatactttgaatatatgccatactaggccaccaaccctaatcctaaccctaaactgtcatagagaatcttctcctttagtgctcggtaatgtactgtggtcagagcagacattcagacattgaatgaatatatacagaatatgcattcattaaaattatttgtatgcttttcctctcttttataattaagaaagaaagaaggtgatactgtaataatagtaccagccccagaagtataaagactctgagaagaatattcacataaatattatagtaatagccatttgtggagtttgatttttctgagaaatttaaacattagggcaatctagttagccagttttcattaatgtgaatagctgtgttttagttgatgtatccttcacctaagacttgggttattgtactgaccctgatgaaatagctatgcaatcttaagtgcattatttaaagctgatggagccccacttttctgatttataaattttagtgaagattatctctgccttagagccatactgtagtaatgcatttgaaaccatgccctcgttaagatcacacattctatatgcaaaaggcaccttgttgtttatcttgtgaagaaatgccatgagatgcttcccccaggatcattcagtcctgccaacaatcttatatcgtaagtattactaactgcatttgcagatgaggaaatggagaagggttaagtaaattgaccacattagtgactgccagatgtgggattcaatctcaagtttatctgactctccagtcaggaattggattgtatcattgtttcagcaaattcaatgatgtgctgataggtgactgatcgggggtaatagattaggaattaatctcaggattcatttagttctggcggctccatgcagattcaacccaaatgtgtttgcgtagtgcagctgcaagacattgatagtatttctccattgaggagagtggatggtttctatacaagagctaaataaaagattttataggaaaaaaagccccacaggcatgttataagcattcttctatttgtgtattttttcatcccactatggaagctttagaaagaaataggccccttctcttatgaacagctctttttagttgagtggggataaggacaatgtttcattttgctgtgtgtcttggcattgtgcctcaggcatgagcgtgcaatgggtgtgtgtgaagagtggatgaaaaccaagggcttcgtcctctcctggaaaaaccatcaaagagacctaaggagacatgtattaataataatctacagagacggtcctttgaatatgctcacactctcctgagataaaggatttcacaggcaggtcctgttctgctttggcaggaagaaaggagattattcaaaggccctgtaccgacagtgccattgggtttcataagggcccattttcagactacacttgagtggaaaggtctggagatctgagcagaacctatcgcttctccttgacagtttgctgagtataagaatacacaaggttcctcatagcgctcactggtgaatggtcattctcaccaaatccttttgttggcttcataaagtgcagagttaatggtctgtattattgtagtttgatatttaagtgagctgaactgtgctgaactattagagttaagattttcttgcacagataaatatttcctataaaatatggtattatggtggtttccattaatctggttgtattatgcttccaaatgagctatctgattttatcgttagaataattttgtgagacaacgaggatcaacttcatcccattttacagatcagcaatttagttaacaagtggtcattattgttcctgaggctatccaaatattcaagctatataagcatccaataattgtgatataatattactaacactaatataacaatattatcaatagctaatatttcatgaggactcactatgtgttaagcactcagctaagaatcatttcaattttctcacctgccaattggagatataattactgttctgtccactgcagggggtgtgtacagattagatgcagtaatgtgtgtttgagtaccttggcatgttcaatactgttcaatctatgtgtccatttctcagcttaccaactgtactaatgaattcttctctctagctcactgaactgcctactcctcgcacctctgtctaagctgcttttgtcatgcagctctattcacatttctctctttaattccttaaaagcaatactaataaccacaataataataggaataataattacagtgcatgtcttccattgtagaagcctgcctggtttacaaagatggcatgtaattgatcagcaaaatatccctgagaagaaaataggctagttatcataatgctcatttttcatttgaaaatgcaaaaaaggtagttgagattcagaaagactgacaattctaactcaacctggtgacaaagtgaaattcacactcagatatttccattccgctccatagctccttctgttttaagtgagtgtccctctcccttccaaggccctttggtccttaaaaaaaacaaaacaaaaaaaaaggtctatgagagtccctatagcttcttcaaagcttcttatatcaacaccttttgcaaagtgacttgccttccttggatgatctaagcttccgtacagtctgaaggagttctatggtgatcatctctagttctatttctctttaaagggcctggtcacacagttggggcaagggcatgtgtcattctttctataggaaatgctttccctctgcttatctggctggagttgtagaagattccacccacatgtctcctctcctgtgaagcctttgccaacacctctccacagagcactgctctctttgtgtctcttctgtatccagcactgactttctgtggagcaccagtagtgctttttttccctctgcagttggaacagatctgtgattatgtcagggatcagctatcagacccctgacatggtgacagatctgttctaactgcagactgtgtgactcctgacagctgagaccacaccttggtcatatttgtgtgtccatgtcctagcacagcaaatggcaaacaaaaaccccatagtgtatattttattgttttctacagtaaatttttgaatgaatgaataactttaacaaaacaacacctgcatctgttaaagggcagtgtgtctaccacttctgtgaagcagctgtggtctgatggaagttgaagtggctaaagtagcctcctctttttctgtgagtccttaattgctgttctttcctgcaacattatcagtgtaatgtgctaactcatcctacgtgtcacccaagcacattttgtagatgtgtgtgggacccaattctggtgtcactcatttgtaaaggccaaagttgaggtgttgtcaatgtctaaactccgtttgtcagtgagcttctcaggggttcgttccactggaccattagttgcctaatcctaccctcattttcttcctggagtaaaagaaaagaaaattacaagaacgatgaaactgtgtatattaaagggaaatagggctgacacaattgagaaatactcctccacactagttagcccttgaaaaagaaaaaaaaaaaatggtaaagccaaggcaagccatttatattaacacacctgggttccagacagaaactatggagtctattaattaaaattagtttggaaacaacattctattataagataatcttttcttcagaaagcttgctattagtaaattaacctcagccagtgttctggcacaatgaatgctctatctcataaaatccatattgtctgcttctagtcaataaaacacacaatctaataaaacccaattgtgcatggtcctggggcccagaaatcatgcagataattgaaatgaaagacacacaaatataaataattggctgcagtcaatagtcctaatgatctttcccacctagttttttacatgtacttggattccccatcttcgcagccaccatttcccaatattcttctgacctgtccattccccaagactctatcctcccagaagaaaggttacattgtagaatgattgctgaggtttatacttgaataaactaggcttcaaattgtgattttacctcttcctggctgtgtgacctgaattatattgccaggattttggtttctttatttgtgtaactgtataaaaatatctactatacagattgttgggagaattacattgaaatgaaagggataaggtatgcccatgtggctagcagagttccatattcattcccatttctttcctttacaagcagtgaggctcttaatagaatggcaagaagaacaagaagtaagaaagcctggagaacaagaagtaagaaagcctgaaagactcaaacactgtataatttttctctgaataagctaatgaacggccaaggttttcaccttttatgaagcgttatcatttgcaatatttctgagaactcatatctgctggagaacaggatatttccccagccagctcccactgagggccaggcgtgtttccagaaagcaacatgacattgcaatcagttttccaccaaagccagacacaggcaagcaaagggaccttgggctggcccgtacttctttggacctcagtcattccacctctataaggaagatgtaagcttgttttctttatttcctctgcgtttctgttatacatgtctgccctggattagtaagaatgggcttcaagaaagactaggaaaaaaaaattagaaaaggaacaggcaactcaagtgctcataagaagaacttacattaatcaaacaagtgtctgtatccctctgacactgcaaatactctgcctccccttgtggagtctataagcttgtctcatcctctagctatttccactcctattcctttctccacagaaactatacaccagtgtctacacatccctgtcaaatatttctcaccaccaaaaatctaggtgtgaagatccaggcttcgtttgttcatttggggttttgtgttttgtgtgtgtgtatttacacaaactgtgatacttgccagtgtcttttaattcatggtgctgccatataaactgcgtttattcctttctgtcctccaagctaggacaatcacaatctccttcacgaagacttattgatggcctgcttttttcatcatgccattatctgaactcctgtacaatggagtcttgtggtggcgttgaaccttaaatctaggtgaactgtctaacagcagatgaggaatgttgaagttgtgccatgcagctaatctacggcatgtggttttcatacttaaaggctgtgatgtccaatttccaattaaatagagacacctattttttccctgagaatgtaatcttgtcttgtaatcacctgaccctctcaaggatatagtctatgtcttttccaatgtataaatccccagagctgtaagtgaatcagagaaagcttgagaaatggcttcatgctttcatattttgagctttctcactgctgcagccatagggtaacaaatatgagaagaataactaacaatagaggggagaagtgaaacagctacagaacttacagactttcaagggggttatgctccaattggcccatcgtaagttaaaaaaatcatagattgaaacacactttgtatactttacctactcaacatcaaagcttaacctagtccaccttaaatgggatcagtttgacacttattatacattagcctacagttgggcaaaatcatctagcacaaagcctattttataataaaatattgagcatctcatgtaatttacagaatacagtactgagagtgaaaaacagaatgtttgttcaggtacttgacgtacagtttctactgaatgtgtttcaccttagagttactgtgaaagtcaaaaatcataaatagaaccatcataagtcagggactgtctgtagagttaacaagactagggaacgtgtaagcaaaatcaagtttatactgaaactggatggctgaaagcaatgcacctcttttctgcacattgcttagactgtcacctcctcttggaagtggcccttcatcagaaaagctctggtgagtgaaagcaacatgctcccccttcacaatgctcttttgtcattgtatatgcagtcttgtctttttgggatgtcctgtcacaattcctttggagttttagacagaacaacctctaagaagtgtgacctctctaacctaggctggaggagaaattcctcccctgagttctcctgcctcacactctttccttcagcatgacttatattgtgctgagttctgtgctcatgcctgtcttctcctccagcctatgagctcctcaagggctagatgaccctttctatcaccacctcgtactgcctagaacatggtctgactggctactggcctgctgtccgtgtgttaacatagggtgtgtgagggagtcaatttgtgaatgaatgaatgaatatatgaaaaaaaaataaagctgcctttgacacttttataatgtctcttttcctctgtagtttttttttcaaatttgttctccatgttaatccaaactttatttgcatataaatgaaaaaggaggaaatacaaggaaaaaaatcctcaattttgtctggatccacataggacttggtgtagagaaaacttcagtgaagtcttttgactttgaattctaaaataaactatgagcccatttacccagatttaatagcttaaaaccactgcagcatagagaagttcaattttagagattttttttcagtcacaaatacacatgtatttaacacacaaaaaaaattctactttgggcgctttaggggaataaaaattgaaattaaaaccagtctaatactaaggggcttacattctggtgaggagtatgtgacacatagatatatcaatgctgttgcgaggtgcagaaactgtgtcaggaatctggagagaaaatggtggacttgtacttgccattgaagagataccaagatgtgaacatgtggagaagtcggtggtcgctgtggagagatagtagcatgcagagggccatgagcctagagactaacattgtttggctgaagtcaacagcatcagaggaggttccaggttctaaattcagaagaaaagccaaggagatgccctgcacatgccttcattacccactatgattcatattcaggagcaactcaattttgtgggatttcgtagatttcagcagggagcataatcttaccaaaattagatttcctcaatgaaaaaatggagaactgaaaaatgttacctcaaagagaaagttagagatgatcctttaccgatgaggaagtgtgggcaaaagcctggcagttgaggccgacctcctctccctcctctctgtcagcatctcactagtgtatgtgatgagactcaggtgaggccccagcactgatgagacactaagtgtacatgagctctctgtttcttgtcacatggcctcccctatacagcaacaacaagcaaatgagaaaagagggcaggcataagccaaagtccacctgctcttaaacacattcgtaccatgatttcctaaggaactgttatcaatatcctgttttcattcagggactttgacaatactgtctgagggagccttgtactcttaatggagcagcatgcagagaagttagatttcatgcctcattacaaatattaagagatggactttcagtgatatgtatgtatgccttttcatgaagaccttaaagtttgtttgtttatttttttcacctgagagtttctctacacttcattactctataactgtaccaccatacattgggcttcaactgttctagcatggccagagcatctggagctggagagaagctgtattctgcatgcaaagccaaattggagaattggtccccgagtttgagagaaaatctatttaatttgattattgacagaaaaataaatggctctattatttgtctagaatctccgaaatacggcatgtaagaacctacatgatctgaattccaggagttccagctgatccttcccctacaaacacacacacacaccacatatcatatatatatatcagccctctagatttacttataattctagaagaagccatgtcctgcccatcagtagcagcctttgcataataaacgtttcctctctagaacactcttggcctaactattattagcccttcagtactctactagggtgctatatattgagtcctgagtctacaggaggttcccttccaccacatccctgcagctgttcaatcttcttttcatcctggaaatgaacctgtgggaattatccattgttttattttgttggagtttttttttcccccataagactatgagccactcgaaaacaaaggtcaagctttctaatctttgatcaataaatctaaatatattcctaacaaaataaatggtgtaaaatgaagtatttaatataaaatcctcttatttctaccccaacacacacacacacacacacacacacacacaatgctgtttcaagagacaaaaaagctctcaagatgttatctgatcaccttcataccattgaataaagaattgttcccatttgaaaaatactaaagacaagagaagttcaatgacgctccctaaagcaagtccggccccttgaaaagcaggagagtagttcgcaccatgatctgccctctcttggtgtagacttctcccagttccccttcacctggtagtttacttcagaggaggaacaagagagtctcgggaaagaggactctcagaagcaggatacttgccacgtgaggcaggtgcctgtttctcctgtgcagtggtctccagagaccggcgaaggagactctgatctgtaattatatccttccttcggtctctcattagtgcacactgttgctgaatacagataagcctgtatttgagaattctgtgcccgatcattgttattaattatagggaagatttgatattttaaaatatatttgaggaaggagccaagatggccgaataggaacagctccggtctacagctcccagcgtgagcgacgcagaagacgggtgatttctgcatttccatctgaggtaccgggttcatcgcactagggagtgccagacagtgggcgcaggccagtgtgtgcgcgcaccgtgcacgagccgaagcagggcgaggcattgcctcactcgggaagcgcaaggggtcagggagttccctttccgagtcaaagaaaggggtgacagacgcacctggaaaatcgggtcactcccacccgaatattgcgcttttcagaccggcttaaaaaacggcgcaccacgagactatatcccacacctggctcagagggtcctacacccacggaatctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagtcaaacaaaaaaacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacctatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaacccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaatagactttaaaccaacaaagatcaaaagagacaaagaaggccattacataatggtaaagggatcaattcaacaagaggcgctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatctaaagaacagaaattataacaaactatctctcagaccacagtgcaatcaaactagaactcaggattaagaatctcactcaaagccgctcaactacatggaaactgaacaacctgctcctgaatgactactggatacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaaatcaataaatccaggagctggttttttgaaaggatcaacaaaattgatagaccgctagcaagactaataaagcaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccatcatataaacagagccaaagacaaaaaccacatgattatctcaatagatgcagaaaaagcctttgacaaaattcaacaacccttcatgctacaaactctcaataaattaggtattgatgggacgtatttcaaaataataagagctatctatgacaaacccacagccaatatcatactgaatgggcaaaaactggaagcattccctttgaaaactggcacaagacagggatgtcctctctcactgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcatctcagcccaaaatctccttaagctgataagcaacttcagcaaagtctcaggatacaaaatcaatgtacaaaaatcacaaacattcttatacaacaacaacagacaaacagagagccaaatcatgagtgaactcccattcacaattgctttaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacacgttatacaaaaatcaattcaagatggattaaagatttaaatgttagacctaaaaccataaaaaccctagaagaaaacctaggcattaccattcaggacataggcgtgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccattccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatcacacgttagtgggtgcagtgcaccagcatggcacatgtatacatatgtaactaacctgcacaatgtgcacatgtaccctaaaacttaaagtataataaaaaaaaaaaaaacattaaaaaaaaaaaaaaaagaagaaaaaaaaaaaaaataaaatatatttaatgggatttggagctttgaagttcatgggaaggattgaaatgtgatacatgttgatagtgactgtaaatgatacacagctaatgaaaatttccattgctggggtgttgaattaatagcacttggcatttgtacagcaatttttattttaaaaagcattttgtgagcaatattttgtcttattctcagaagagcccacttaaagcagataggacaaaggtcaccatacctgctaacaaagagaaagggagatggaggcacagagaggagcaggcaggtgtttgaggccaggagctggcggcagtcgtcctgacactgggcaggtgtctttaccaccggaagctgccacctcagctcagacccgagctgttaaatgcctagatgcctaactgtgccaaaagccactcatgctgctaaacttagttcccaaaacaaaacatacacaaacacaaaaccctcccttcccaaatttcctgagaggggtaggacacaggaatatgagaaaattttcaaatcatattaaatttctttcagtgctaagaaccttgacactctggacctttcacctgtgattttcacttctgggaatctatcctaaataaagagagagaaatgttcacagattttttttttttgaataaggatgctcatctcagaattatgaaagtaaacatttgaaaatgaaccagttcttcaacatcagaatacttaaataatttatattatatgtggggatcttatgaagctgttaaaatttctacttccaaagaatatttaacaaggtaggaaattcctgtgacttaaccttaagtaaataaagagtagataagaaattaaagttatgtcaaattattaatagtagttatgtttattatttttattctatctctttgttgttttagtttaaaagtttcacaataaacattatttgagtaacagaaaggaagacattttaagttttatttgtaaaagtgatattctaaattaatgtattatctcattaaatgtggtttcctcagcttctcttatggccagacactcttcttaggagccaaatatgccagtctcttcccttggggagctcacatttgagtgtggatgttggctggggttggggggagacaaaacagaaaataaacaataaacatacaaagtacatgacatagcatttataacaagtactctatgatgctttctcgaagtaatccaaagatgatacaaaaaggggaaaaatgtgcaggatacagagcttggagaaagacggagagttgccatttgaaggagatgatgaaagttgggcttttgaggagtgtagcatttgaataaagtcttgaaggagatgagagcctcagccagaacataacttcttctttaatactttgggcaaggtttgttttcagttttttttcaaaattcagagaagtaattcaatgcatgtactatatatcagctaacacactatatattagctaacacacagtgggatttgagacagtgcccttaagcaaacacattaatatttctgcagggaaacatgaatattcatacaaagcggaataaagagagtattagcccacctgagttctggctagggttctccaccaaatgaattttgggaaaaacatatttgattacacatctttatggatttcaggaagagagataaagagttgtaaaattgtaagacacacagaggttgagtgaagtgatgcaatcagaaataacatttcatatttattgctgttagcatttacacattttgctccagatgtccttctgacagcgctacagctctggagtgggtttgaaacagctccattgaggggatggaacggctctaactagctctgttgggagcctcctgtcaccaagaggcaagtggcctgggcggcttctctcagagggaactcctgcagggcatagaggcttgggctcgggcacccttcagtgttcctcttctccaagataatgcacgtccttaaattcatcaatgcatctaggtggatatcttcaacagtgacttttccaaagggagagtagtgaggcagaaatgtttctgagatgccgaataaagccggccgttagcctttgcgaacacgatgctgattcatgtgggaggtttaataaatctgtgcagaaggaatgtttggttgatggccacgctggctgcgggcactttcactcacactgcccatgccttgcctcacaccaaggtttcacaggataactgtctcaggttgtcaaggcttataagctactttattatatttttatttagtttttaactaaattactttggtgaacataatttctaaaatttacaggacatctcatgattgaaaatattctcactaccgcgtgaacccaggaggcagagcttgcagtgagccaagattgcgccactgcattccagcctgggcaacagagcgagaccccctctaaaaaaaaaaagaaagaaaaaaaagaaaatattctcatttagttttggtttccacattccaaaaactaattgagaaaacattttactatggaaatgcagattgtcatgagccagggactagtggtggttttgtttcctgccgtatcgtcatgtttctaaactctgcctataacaaagcaggcataatgcatctatggagagagaggtatatatatatataatatatacatattatatatatacatattatatataatatgtatatatataatatatgttagggcctattcagtacattcaagtaattcagtacattcaaggaaactattgataatgctcatttatctcatatatatatatccactaatgcatattatatgagatatatatatgcactattgcatatatatcaaactattgataatgctcttttatctcatatatatgcacatattgtatatatatttgcgtgtgcacatatgtgtgtatacatatatgtgtgtatacatgtgtgtatataaacacacaaatatacacacagacactatgcatctatagagagagaggtgtatatatatacacacacacatatatgtatgtatatatacacatgtatacacacatatatgtatgtatatatacacatatataggcacacacactcaaatatatatacatgtatgtgcatatataagatgagtgaatgagcattatcaatagttttccttgaatgtactgaattcctacaaaatgatcagcagctgttctttttcagttgtattccaggttaatcacatatgttacctgtttccttgcaatgcttcaaggctgtgggtgtttcgttaagttcttcttcacttccaaccatccagatctgctccagttagtctgttcatagccctcactctactctcattatccttccagtcattacattttgggtccctatatcttatatttaattttgataaatgagtaaagagaggaagtggcctgttcagacattaaatcttggtgcatattattacaaaaaaaggatcactagatcaagaggaaggaacatgcatttgctagcataccatgtgttccaagatggcgtcaattgcaaaaaaaaaaaaaaaaaaaaaaactcaggaaaactcaacttcattctgagatcagttgaaatgggggctaatatcacaaacacactggctttacagttgcattatctgtattcagagctctctgagatgtgcaaccagggcaaataacacaattttctgcattacttctctttagctaagaaattttcttcaaacagaagggaaaagaaaaagacagactaaactcttttgtaaaggctatcaccaggtctgagagcagtagtggagtgagcagcgccaatccgagtgagaatagcaacagtcaggctgctgctgcttcttcctctcctatggccctgactataaaaataaaactcctcccatttttacagggccagcaaacactgaacagctcgcagctggccgggccaactgtgtgtcttctgttgccgccaaaacaatccccttggcatccgtgaacagtgcagaagcaggttcttcaccctctcagaccattcctgatggagatgaggagattctggcttttcaccttctggccaacactgctgctttttgttaacatctatcctggtggttagaacctagatctctgtctcttgtaccctctctgctttactcaaaaaaatctggaacaatggtgaagtgggaaagcccttaattctgtactctttaaaaactactgtggaaagtaaagggatgaaatcctaatcagaatttttttttctacaagagcgtgtggatttatttccgattaaaaaaggaacagcaccagaaagtattcatttgctgttatatcaaaacatttagatttgtttgccctactatatttaaattagtgtgttaagtaactgagaattgaaatgcagcaacatatagttccaaacatgcccaaggtgtatatcccagcctctgtttatcgattttgtgcattcattgactaacttacctcatggaggttgtagttacaaccccaaatctaggctggtaacttataaactggctatagatatggattatgggaacagataatttagagatattggataatggattcttagtcagtttcagctgctataacaaaaataccatagacttgtgtggcttaaaaaacagacattaacttctcacaattctggaggctggaagtccatgatgagggtaccagcagattcaatgtctagtgaggacccatttcctggtttgcagatgactgtcttctccttgtaccctcacatggtggggagagagaaagaaagagaaaaagaaaaagaaagagaaagagagaaaaagagaacaagctgtctcttgtctcttcttatcaggatactaatttcttcatgagaggtctaccctggtgacctaatcacctcctaaaggtcccatctttacataccatcacattgggaattaaggcttcaatatgtgcatttgtggggggcacaaacatttagtccgtagtatggatattagagattgttactcagccccctgtcccttctgaagagtagcgtgtgcttttggcatatccaagtaaatgcagtcattttttaaaatgcctatttaacacctactacatatctatgggtcaagctcagtgctagagatacatatgtgaataacagggacacggtatgctggaagtgtctgctaggggtagcaggaagttctaagcagaagacctaacacggtctaggatttgacttcccaacttagaccccagagtggggcagagaaaggaggtgcacgtgtccaatgagtacaagggagaaacagtccatgatatggggtgaattgggccggagctcccagtgggaaccttgtggccagtgtcagcaatttaggctgaatcctaagaacaatgccaagccctgagaggtttctaaacagaggagagagatgaacgcattggtcccctcttttccgctaggttcattttgcactgccagatctccacagtgactctcccttctctacgcttcctcatgagcttgctttcaggacttggtaagtgctgctgactttgtcaagagcacttggaagtcggatgaaccaggtttaaaaatcagctctgccacttaccagttgtgtgattttagacattgtgttaccgagatgttcttcctcatttgtacctcctagtgggttactaattaaatctctgtttcagcacttaaaaaatgttcttctctgttgtctttgtcatatgaatttcaattaaatgtcttaactcactggcctaaggcccttaagaatatgtatgtaccacgtctgacagataacgcaggacctagctctatggagttgtctcgtgtaaagataattcacccctgtctccctagcctagataatccctgtttatccttcttcccaggtgaacaaggatctcagacccaggaatcaataacaactactattagtttagcccggacatacactgcatgtgattataccaaatgtacatgtgtcctcaggcatataaccaagaactaattatctcgtgactgccaggcactgttacttaaggaaattacaacttcttaaggggtggctgagaggataagtgagaataggaaaataagtttataggacacccactgaaatacattaacacgcacttgccatatggtgactcattaaattaaacttgactgaaactatgggaagtggatggtggcaaatgcatttttttagaaaagaaagtgcagtctgagagaggtaaagcaacttgctgactgcgctctacctcaggtaagccagcgcacatacaggagaagggtaaaacagggcttgtctgactttcctgtctaagtaccttacctgaggattcccccaagaagtgaagcaacacaaaaactgatatgatttaactattattgactaaatgcatactatatgctaggcaccattctaagtgcattatatccacgtcccattgaatttcttatatggtagattgtactatcatccggattttgcaaatgagaaaactgagattcaagcaggttatgcaagtagcccaaagcctgtgaacaaatacgtggcagagctggagtcgcagatctcccttttgctcattcctttgttcttaagtattcctcttacgcaccagaatggaatcattatatatgctgtatgaaattaaaattgatatatttttcagggttgagatcagttaataaggactggaggaggttttgtggagggagagagcatgtggagggacatgggctgagagctggagagaattcagaaggtagagaggaatgaggagggcattccaagcaaggcgatgtcacagccagtgtgttggagaggaacatgacagattggagggaccacggacagaacagacaagcaagcatctaaatttcaattctgaaggaaatagccagtgattctgtcttattatagcatatacttctccgcttggcaatcataattctcctctagtttcctattaaaagaaagttgtaactgggagacaggcaaatgaaaatcatcctcattcatcaatgttggtttctatagaaactactggtgcggctccatacagaatcctggaatcaaggtcagctagaccatccctagggttagttctgctttgaatattccaggagtgattaaccaacctaaaactacccttaggccaaggctgaaatttgaggtcaggattgctaaagtagatttataaaaacttaacccttcatagcataatgacatgatttaaataattcacatcactcactgattttctgaagataggagaaaggatagtgaaattcattaaaaagatggaaacaaactgaaaattaggaaaagaattagaaagcaaacatgaagtggggcacacacagtaaatgatgcttaataaatatttaaaataatagtctccaatagcaagaggtctagagtgtggcccctggcatccaaccttgctgggttcagatgctgactaggctgccggagaagtgaatacagtaggtcaatgtcttagtcagctcaggctgctatgaaaaatactagaggctgggtggcttcagcagcagatatttatgtctcatagttctggaggatggatgtccaatatcaagatactggcagattctgtgtctggtgaggagggcctgcttctcggttcatagacagtcatcacctctctatacctttacatgaagatgaggcaagaaagccccccgggacttttttttttttttttttttttttgagacagagtcttgatctgtcacccaggctggagtacagtggtgtgatctcagctcactgcaacctcctcctcccaggttcacgctattctcctgcctcagcttcccaagtagctgagattacaggcgtatgccaccacaccccgctaatttttgtattttttagtagagacggagtttcactatatgttggccaggctagtctagaactcctgacctcagttgatccacccgcctcggcctccaaaagtgctgggattagaggtgtgagccactaagccgggccctggggctttttttcttttttttaataggacattaatcctatttctgagaaatctgcccgcatgacctaatcacatcccaaaggcttcatctccatatgccatcccagcggagattggctttcaacatatgaattttagggggcacaaacattcagttcataacaagtagatacatcagttatttaacctccaatgtcctcttctgaatagctagaatacaatcctccttagttacacgttctgttcttgtgggctttccttgtgaagtgggcccttttgagccagaaggagcctggttattctatgtctgagccagaatgagcctggttattctatgtctgctgagtttgtattcccctagagcagaccctaagacaggaattcaagtgcaaggggtttgattgggagataaacggaacagtagtaggtgccagagacaagaaaggaagaaagggcatggcaaaatgggtgctatgagctgatgggggtgaggagaggtggaatgagagccaattcactgggaaatgcgaagggccagtgtacaacacctcacaattacacctcccctcccccgaggtgcagaagttcacattgttcttgggtagagggatgcagccaaggagcaaaaattatcctgcactctgtcctgccacatgatggacaaagagacctccactggaaagagaaacttttccaatgaagaaaggtcagtgctgccttgagaagtccagtgtgctgaagtgccagaatggacaccattttctacccagctcagagcagatcaggcctccagtgtttgctccataaatacccatcaaataatgaccaatgggatgaatgcagcctcaagggatgaatgcagcctcaagcccaggggttcttctcctgggtttttcactataatcagatgaggaattttaaattgcctgatatctaggctccagtgcagaccagttaagtcagattatctgctgtggggtccaagcatcagaatttttaaaagctcaccaaatgattccactatgcagccaggactgaaaattcttgttcaactaacacatgaatcttttctacaaagtccttgacagatggccatgcaagcctctttttgaaactcttcatggggagggactctgctattctcagaagcaaaccattcccgtttttttttttttttttttttttgatggcactaattgttccaattttttttccttactgtgagccaaaacctgcttctgtaccttccatcagtcattcaagctctgcagtttggaaaaatgcaaaatgagtctattccattttgtacatgactgctctttagatattcaaagcctgcaataatgccctaacttgaccttcatttttatgctctaaacgttttcagttccttcagctactgctcttcaacctcctgtaatcattttcatttgccaataccacttttctcctgtggaattctcaactgaatccgtggtctgtgtctgcagttggaaatatacagggcagcaaatgttaaatgaatagcgtgtgtgtgtgtgtgcgcgcgtgtgtggtgtgtgtaaagtgtttaaagtgttatgagtgatcggctgacttaaagtaaacctgctttactaggaaaaaataggatttactaggaaaaaaataagatttcactctttctgttccatctcccaaaatttgttttcttaaacagcatttttctctcttggctaatttgtttgaacacctcagctcttgttttgcttttcagggaaatgtagatatatatttaacatgcataacttgtagaggagagggcgtagaaaaggtttatatttgaggttttttcacccatccgttttttaggagtgctgagccatggaattcatggcctgaaaaacaaaacaaaataaaaatcaataaatttgaaagaaagggagtactgcatctgtgatacttcagggaaagcaattcttaccttaatgaccaagtctattgcaaattctgggggcaagcagttgagcctcttctggacaagtgggatagagcaagcctttgctccactggagataatgtgcgtggccagccaccctcacctcgtataaaacagaagcccagttggccttgcaaagtgcatctaaaaaagggttcagggtgagggtagatttgtgccaattaatgtatcatgttgcagaaaacacagacaaatagagttgacaggtaatcttgatttcgtaaaagggttaaggctttgagaagctcatggtcgactctgaaagaatcttaaagagacagtttggaattccagcaagaccagtgtggagcagcaggagggagagtagagatgacctagggacaagaggaaagacttgaatcgcagggcagtcaatgttcctccagctccactgctgattatcacgctgatctgtggggagtaaaattccctttcaaagccttggcttatggatttgtgaaatgaagatgaatgatcatcatgatgtcaatgttcaaccacagaattgctgtaggaatagcatgagtgaattcctgtgccaggcctggatggcagaccctcaaaaatgtgaacattttgcctatttatttttgttttttttgatacagagtctctctctgttgcccaggctggattgcaatgctgtggtcttggctccctgcaacctccgctttccaggttcacgcgattctcctgtctcagcctcccaagtagctgggactacaaacatgcgccaccatacctggctaattttgtatttttagtagagacggggtttctccatgttggccaggctggtcacctcaccttaggtgatccacccacctcggcctcccaaagtgctgggattacaggcgtgagccaccgtgcccagcccattttgcctaatttttgagagttcacagagctggtagttcgggatcaaacttcagctccaccaatcaccaagtagcatgatctagtgaagtcactgattacctctgtgcctcagtttcctctgtaaaataaggaccataacattacctatcttgtagagttattattaagaccaaatcacctgatagttatggaaagcagatggagcagagcctgatacatagtttgttgcaaaaagagctagctagtaataaaggattctcccctaactgtgttccactagttctaaaacctttggggctctgtttattcaagtgtaaaatgaagaacgtggttaaagtctttgaggattcttaaccttattcttggtatcgcaggatttgcaggttgcaccgtgagtctggtcacatgtctgtctccctcacagccaccctcttcccctgggtagagagaccatgagtttttattttccagtgcctcgttggaaaacaaagactcagcatttgataaatgtttttgaagaaataaatggagtaattcatataaaaattcagtaacacctgttcttttggcattggtgtttggcttctctagtgctctatggagaagaagctgtgttaggctcttggagacaagaaactgaaaggcaaactttgacttttcggtttcctagttttcccaccttatgtttctttttcagtattccatctttatggttcctttactgaaatttcctcacttactttctatcttgtttttctgtagttaaaatttgaatataataattctttttagaagaaagaaggggtccatacaaaaagaaagaaaggaaattccacttctattaaatagtttggagtaagttatgtaacttctttgtgcttaatcattcataatctaaagggcatctataggaggtgcaattagtgaccattcaaaattcctttctgtcttccttcctgccaaaaccacaattttcttcaagaatttcccttcttccacccaactgtgtgctcatgaggagatcccaacctaaccttaacaccaaagtctaggacaatcatggaagtctaatatctctgccaagaactgcctctgacaagtttatatgacaaaattctagcaaagcgaaggatgttcttgccctaaaaggaggtgcttaagaataaacagctcattttattctattggacagccataactctgttcattttgcagctttgaaatgaagatgacatgctgcaaatggtcaagtggaaatatagagagaatgaagggtcttgttaacattggtgggtcactgaattaaacaatcctggagccactgaacctttccttgtttcctgagatgatgaattttcttttctggttaagccagtcaatttggccttttctattactgacaacccaaaaccctcccttggaaaacattatccatagcctagaatgattgaaggagttgatgagataatgtacaatgcctagtacaaccatccctctgtatccatgaaggattggttccaggaccacccacagataccaaaatctgtggatgctcaaattccttatataaaatggcatagtattttcatataacctacgcacatcttccccttttctttaaatcctatctgagtgacttatagtacctaatacttgcgtatgtcacttcagttgcttaaattcaacgtaatactaccatgtgtggccaattcacgttttgccttctggaaatttgtggattttttccccaaatattttcaatttgcaattggttgaatccacggatatagaacccatgaatgtggagggctgactctatttactttttgtgccagacaggttagcatgtccaacaaatgttgatacatttatgatagctttcttttcttgctatgagaggatattttatttgtttctgggttacctaatagttatgttcttgtcctcaaaatagattgttgcctttctaggcatcagattggtgcacttcctcttaccaagacatctcactagggtgaacatttggcatatctttccattaaacctcaagagcgcctggcaggtatgggacaggtgtgctaaaggtacaaggctggtggccagtggagtgcttcacaatagacagaaggaataataagatgccctcgacacccacaggaatcttacagttcaacttctagtctgtcttctttgattaagaatttcttaatggtcatttcaaaccctagggagagaggttatgtgaggtggctttgagagacatttatacttcaggggtttcaacatgcatagtcccttaacagaacaattgcctttattgttgacattgcatatatgacattgtgtgtctcttgggatataaaactcacttaatgtaaaaacatctaacatagttgttttggttgtttctttttattcagatttttttaaaaggtttaggtgatatctcagtttgtgagttgaagctttggaagtattcttgttcttaaaccggaatctgcaaactttttctgtaaagggctagatagtaaatatttctggctttgcaagccatatggtgtctgtcacaactgctcaactctgttgtaatatcaggaaagccatagacaatatgtaaatgaatgagagtgtggctgtgttccaataaaattttatttacaaaaataggtggcaggccagatttggcctgtgggtcatagcttgccagttcttgtttttaatcagtgaaaagatcaatttgaacactttgtcccagttgtcactaaccaactgtgtgaccatgttaagttatttaaccttactaggtcttagtttccttaatctggaaaacaaaagcactggacaaagtgacccctaggtttgcctctacagctaatatgtgaaattctgtgatttcagcatgactcttcaagggtatagctaaaaactaagtaaagatgaataagaaccttgtggtcttgttttgaatacactcaattctgaagtcactatggagtatcaacaaacagcatgtccagctgtattaaaaaatcaaaaattctatgaaattcataagaaaaattgttcatccaagttttaaaggactcgagggataaatgcatttgaagaaggagaataactaggagtactactacttattaagagtcttccaaagactaagcaatattcctgttttttacagatattgtttatccttacacatagcctatgacatagtgtattgtctgtgtacaccagaggaacagactctctcttattatacatgcaggagagaaattataagaaatcgattcacatgattatggaagtcccagtatctgcagtcactaagctggagactcaggagagcagatggtataattctagtctgagtctaaaggtatgagaaccaggaacaatgatagttaaagtttcagtcagatgtcaagtctgaaggtaggagaagaccaaggtcaggcaaagaaagagaatattatttcactcttttataagagtctgttctatttaggccttcagtggattgaataagacattcttgggctaatagagaataagactaatattcccatcatggaaataaagaaatacaaatctacagtggtggaaagaaatgggataacattaaggtgatcagatcaacagtcggagtccctccttctccccaacaataagctctttagtggtagaggcagaaattttaatcctcttctctccagtgttttctgtctttgccttttttttttttaaagttaagagcaatagaccatggcccataagcaataaactatacaaactgagcctgtaggtatacagaatagtggcataattaaataaaacttacaacagagttaatgtgacacacacctaatgatatacataatgcagttttgaagcacggtaattaggtataaaatggtaagctgttgacataaatggctgcaattagtattgcttctgcacaagcaaaccctgtgttaaattttacatttgtcacttggttggttctttgggatttataaataatcatcattgttgacagattttgtaactgaagagtgcaaaactatggaaattcatggccaaagagccatatttatttatttcattttatttgtttccttatattgtttgtttgtactatatcctgccagtttcacaaaggctttggggtcatctgcataaaccatctataatgcaattaaaaaatgcatatacaatgataaacaaaacagcaagatcagaggaaatatcaacgagaaaaggaagtatagataataaaggaggctaacagttaactttgcttcttgtagcaatggctagatgttgataacatctgtgaactgagtgcctaatacatcaatttatttcttattattttaacaaccccgaaaagtagatgtttcatttatattttatagatagggtgagatagatgaaagtatgttgactatgttcattcagccagcaaatgagtggagctgagacgaaaacttggtcttcatgactccaatgtcatagtgcactctactggatataaggagacttggagtgaggtgaggtgagggagatgatggggtttggatttggagaaaataaactttggcttcctagcacctaggaaacagagagaagagaagttggtagccttgcatggcccatgcaaacccaagcactaacaggaaccacatgacagctcctagaggctattagcagtcagcaagcacccagcatttatttaatgatttattgataggaggagatgtttcaaaatgtattaagtatgtgtttgtcaatacactgatatattacttactcatttgagtgtggacccactccttgctgtaaagagtcatctgtattttaaagaaaatgattttgaaagatgataatctctgtgctcattgcaaatgcagatcaaaaaaaagaaaaggacaaaaacaaatgatctctgccctagattaagagaggctaatggtttaatgttctaccacagaccctgaaaattaaaatatgagcatcattaaacagatcttgatgattaaaatttagaaagcttttcagaattcatctgtgaattcaatagaagattatggatgattggaaaatattttataggttcaatgatatttgagacatatttaatcatatcaagacttcaagagttgagaaaacaaagcaaacacaggaaaataataaaaggaaaaaagggtagcagatgcacaccatatgtgtggacatgattgtggcaaagctcattcaacttgaatcctgtgccactcactacctgaaagccttgggcaagctatttactcatctcttatgcatatttctctctgtaaaaatgccacaaggtaaagaataaataatgtagtgcgctttaagttcatgctgccaagcctggcacataataagtactcaataaatgttgggttttttttgttagtaattattgaatgaagtataggacactggagttagaccattattgcatatttaatttatgacagagattgtattgattatttataggtattacttcatttaaacttggtaaaaaaattatgaggcagatcttattatctttacagacagtaaatcaagacaaaaagaggttcagttactcatgtgatgccacaccaagtaaaggtggcagagctggactttacacccacacaaagtccaatgtagctggcttgccacctggttagttttttctcaagtcatccacagtatgcagataaaacccttatcattgatttgggaaagatgacttgggggttaaaataaaggaaacatgattccttctctttatttctgtcctacccccacatgtagtgtgaaatgaagagtgaaaagtagaaatcaagataagggtaagattaaaattttttaaactaggattttatctaaaattaagagaaaaacactaatttttgtctttttgaaaagtaagcttggaattatttagtttctatatgcctatgtgaatcaataactataataatcataataatggcaagcacatcatagaatgtatttcaaggcatgttttttatgcatgccaccatgatttctgctcctctctgcacctcctcatatccctaaacatcattaaccaagtagaaattccaaagacagacagagtcctttgaaagaaattttctctaaagtaaaagtcatcccttgaagttgacaaaaaaggggacctcaagtttctagtgacagtgtacttccaaaatattatgtaactggtacattcttgaaccctttctcctacgaccattaaagacttagaatcatggattcttaaatttgggaaccaactacagggcatatttaatctcatccatcctttcatttcgcaatggtggaaactgaagcctagaaatgagatcatgaggaactggaagtatcagatcaaagcaaatatatcccacccatcagtgtttgatatttgggccacaccacactgaccctccaccccaccaacattgcaatgaggaaggtgacatgctgcctccagccctggagaatagggctatagaaatacctaattcatttatatcaaattgtcatcataggagacccttagaaggaaagcctgtatctacctactgacagagagttttcatttactgcaaatgtcaagatgggattagcatgctttgaggagtcaggcatgggggtgtgaatctgatctacatgaagatgcttcaggacagaaatgctagctctcagggctcctcattttacatgaaattgaacaacaaaaaatgctaactaccttcctcccctaaaggtcaatacaagcaacactggctttgcttgaagtttccattttgaaagcaatgtggtttcctcccttaaatctgcactacaaaaaagttactaccttttgtgacagcccttaagattatatgcctcccccattctcaccttaataactctcctctttcatttcatttctttcaagttaaggaaaggagaaataaaataacatttactcttcttccatgaagaacaaatcttctctttcttttaacttcaattattgcttctgcatgcctctaagaaaaaaaaaagaattaaaacctctcttaacaacattcacaacttgatcattttcattctttgttccaaggtctatgactctgttcttcacttcacttacttagctggagtctatccaaaacattcattttcttacatctgtgtttatccctagtatttgttcttagtggatttcaaaacatgactgttctccttgtgtttctggctctgaaaacactaaaatgcatgccaaatgttagagaatgtacatgcacttttgaagtctttcagccattcattcaaagaggtgtgttcagtgcagacttagacactgttctaagcaacgctgccatgaacacgcaatactcctgccttcatggaacttacagtaagggatgcaggcagtaagaataataaatctgaataatttacagcaagtacatggagcggtgcagtgactggctatctcctcaaggcatgtgccattgattaagacacaacccccaaaactccccattgctttcacacccagcctgctcattcatagatagattataatataatttcagatagctgtaagtgacaaagagagaaataaacccagctaagtgcagagactctgttttatatgtatatatacttttctttcctcctgaaataatatctctttgaggaagtgacatttgaacagacacctaaataaggtgaaaaagtaaggttttggagaagaaaattctaagtggaggggaagtccatgacactaaaacacctttgatttattggacaatctgctagaacactaaagtgattggaaatacggaagagaaaggcagaaagggagaagagagaggccaaggacagattacacagggccacgtaaatcacataaggaaatgtggatttcattctaagcataatcataagacactggaggcttttgggtaggggtttaaatgaggccgtttcaatattcacctcacctaggtaactctgtagagggtagatctcagctggggaaggaaaaatcaggttttgtcttaagctactggatgggtggctggcaggactgggtagcatgtttgtgcagggaaatggggaacctgcagactttatgacacattgtggtggagcaggtagaacacaagccctggagccagccagagaagggcttgatcctcaggttgtaatctatctgggctgacttaatgtctgtgtacatgtggataaagagcttgatctcaactgtgaagtgtggacactgttgcctaccctgcagtggtgttaggagttatcaggtgatgatataaacagagtttctaacagggcagctaatgtgttcatagtcaaagccacagtcttttgagtcagaccaggatttgaatcccagcttaattagtcactttgcttggtagaggagtttgtgcagtaggtaaatctcagaggtcctttctcctcttctgcagaatttgtagaatgatatccatttcacacgattgttttgagaattaaaaccatgtgtggaagcacctaagacacaatggatgcaatttagtagctgccgcaaggttttgaactggttcccttaacctctctttgccacggtttctccttctgtgaaatggaaacgtctgatatgtttgtgaagatcaaataagaaaacatatgtgtagtgtttaccagaatgcctggcacgcactttatgttaaaaacaatgtagggtgatgtcatgaacatcaccagcaggacctttctctcacctcccctgctccaagcacatgaaacacatttcacatcaaagaccaagtttctgaatggcttgaggtgctcaggctgaagaatgcctgcaatcctctatctctgcttttaagtcaccaaacatggaggggtagcatattctagggtaaaagacattagacagaatctggagggatctgtccctgcctctacgattaaaaatcagaaattttccacataaaacccccagattgctgacttggctttggtagaaatctgaatgttttacaacaagtacatggagcggcgcagtgaccggctctctccacaaggcatgtgccattcatttagacacaacccccaaaactcctcattgctttcacacccagcccgctcattcatccttgttgcttaatgagtatgcagaggattgtgagtgtgaaatcgtggctgactctaagacagaatatcatctagacctggagactctccagacttccagatcccagaattcatgttttctggtagaaacatgaatactaataatgcagacaaaattcttgaaacagccaaatgttgggtctgtgatttgcctgctctggttcattagccatcgttcctatggcttcacatctgggagtctgtaaacaggccatgggctgaatgacacggactgttgttttgtttaaaacgaatggctgtaatcctgattaaagcatcatgtgggagattttataataataattatctgtagttcccattagagccagcaggaatctgaatcacatttaataatctaaagcttggaagtagtgacacttaagtacattgagatttaagtatagggattccaagaatgaggaagtgggtattgctgctctctagccttgattaagtctctaactgtcagatcagcttagactagttgatactaaaaccttctctggtagatcattcagctacttattgtcaattttctgttataccttgttctcttattgacttccacttttacttattcttaatggtggtggcagctctattattgtgccaataattcaagctaattaacagaaaccaccaaaagaaagatctctactatttccagttccttaggtttccttccatgcagtgatggccaccagagggaacaaatcagacaattaggctttatgattagaacatttatatgaacaaagactaacatgtcattggcagagattaggagtctgcagaatccaagaagtccccaagctacagactcaatcctttctctttgtcctttgataaaacttcctcaaatccatctccaagccttcccccaagatggagcccacaggattatatctaaggcctctgcccacagagtgaatgccaatgcaccccttccctttttttcttctttaatgaccttaactcttgtatatatgaatataaaacactcttcattcttctcatttttgtatatattttttgtcctgtcgtcttctctaacttctccaacttaacaaattctcttctgtaaactatgtctcagatatctctctctttcaaacaaaagactaataatccatactcagggacactttaactgttggtatttcttcccacctgaagactttacttttaagtgatgttctcatgtttgggaaaaccacacataattcattaaaacatgttgcttctgctcctcaacacaagttttaggggtgatctctatttaatgtattttcacatgtgactgtagccttaaaaccataagagattaataataaagtttcttttacactccagggtcagtttttacttggcaatattaactccacttatcaccaggagttgtcaagtaaaacaaaacaattttgtaaaagggttctcacttttctcaacactgcataaaaattcttgaaaaaaacacttttctcactgtgttttttgttttttaaagcaaaaaagcaaggtagcaggtttaatggggaaaaactgatttcactaccgtgtactctccctagtattctgaaaataattgtggggcaatggagaacagattgtctcttcacatctcttgttaggcagggaacctgtctagacagcaatcttaaggacagctgagctgcttcctgcagggtcatagctactctgcagtgtgagagggccagcccagtatgctttcaagagcccaggaaaggtcacatatacaaagaactaccttccccttcctgtgctgattcttcatgcctgaaatctgttgaagaaagacaagtaggatcccaagtggtgcaaggctgaggcaggaagccaaaccaaaataaagaaagggagggagtaccagaggagacagaaggaaatgtagggaggaagagaagaaagagagccaggaaggaggcacgtttttattccaatgcttttcagatttttctggatgtatgacccaggataagtcagttccttactataaaagaggaagaagggcacaagcctcatgaaactgttgtgaggattaaacaaggtcttgctataggaaacacatcaatgtattagttaacgtgataaatggtttccttcccctctcatgattacatttttcaactgtaaattattaattctatcagggaacagaaaactggcgctctgtgtttataagtccacactatagcatagatgggtatctctgatcatttcctaacaaattatcttaggaaggtgagcaagcaaggtaaagagtctgcccggacgttggactgttagagagcagaaggtaaagctttatcgtgctaatgcatatttttcaactttcagtattttcttagcatgggttttattagtttggcagtgatagtggcaagcataagctcaatgtcccttcacccaaatgactccatttgtcggacaaaaagttcttcatcttgtaaacattcagatggatgttaagaaagagttggagcaaacctgctccgatgtggttggaggaagaaaaaggtacgttacaaaatatccccttaatactttcaaatatctgcaagaatctcatttggggattagacctggcctcaacagaaagaagaacaaaacaggaaagcaaatggaattgtttagcaccatttatattttaagacattaacatatgtcatccgtgatctcagatcttctgtataaaaatatagagtaaaaaaaataaaattaccaatggctattaatgttattacatcattactatttattgaaatttttttctcaccaaaacaaagctaagcatttatatattaatacatactgtcaattgaggatttgacctatctgcgtggaactttggagttgatgtaaactttaaaaaaattcactccatctgaccatccctacctctgacatagcacacctgacagccatcatactccttagatggaatccaaagattctacctcttccttgaatcacgatgcccacttagaatcagtaggctagctatttctattcggagcactgcctccatgttttgtttcttgatgctgcttcttttttttttgttcaattcacaaacctgtcttctttcccactggactggatcttatccttcacagccctcatgcatacttagagaatagcatggggcaaaactgaagagaaccagagggctgctttttcttttcatatctcttgtggtggcattggggttcttattggcctgggttagggactggctcggggatgttggacatgaaggctttgatgatgctctgcgcagctatccactcactcaaaggacaaatggacaaaagcagaatctgattcatccattaaaaaaattgattttgaggatgatgaagaaacacaataaagaaaaaaggaaaaacggttccttctgaaagaaaactttagtatgggcaaagttcctgtaaaggctcttgagttatgaatagaaaccgcaaagacttgacatttattgtgaactttcaaggaatgctggacaaaatgtgattcatttttagaaaagtaataaatcgtaatgcaatggtgcacttccagcaaaacccactggaaaactccatttctaagattgaagaaccctatcctgttggatttataatgcttcaaaaatgaaaatatgatgcccaattattaattattattgtttgtttgtttaaggtacagaacaaagtgagggcatatttaaggctcttagactcagacttagcatgtgacttccctaacatgaagggagcagtgtgaaggcagtagcccctggttctaagagccagcatcatctgcatagagcaaaggtccaacaattgatcttatccttcagagccttactcttccacatgcataatgcgagggtagccttccaccaccccacatagatgtgtcttgtccttctcttcatgtgggaaaagaaaatgggtaaagaccaggagtagcctcagtatagactgcacctacagctaaaaccaaacagactcaactgtatatttagggaaatgggctatatattcatctccaggagagagaagaggcagcatgacttagaaaagcagggtaatcatctacaacaggaccactaaaggatgacacaggatctgaggacaagaactgaaagaataaagagaggcaggcagcatatggtgatagttatgaagaaatccactttcagacattatgtcttaaatatatatatatatgtttttgtttttgtttttcctgaaagggcattgggttgacttctgcttcagtcactgacataacctttgcttttctttctgagagttaccttgggagcagcccaatatggatttgacttgttcatttggcatgatttagtacctgagttagcttttcagaaatcttgccagtattagcattgtgtgcagatgcttctcagatgagtggcgtcttgggacatcagcagagatggtgctattaaatcacacagccagtgtcctctgccattctatgaaaggcaggcaagagtgccgcagcttcccgatgcctccagataaactacagggccttttaaggagtgccctgggtaagctaccacggtggtgaggtgcatttgggtaagtgtgatagagacagccaaggtggcggccatgggccacggtgagctgtgtcagcctttcccattgcatatggctgcctggctgcctctatggtgaaaggtaactgtgggtagtagaaaaatgattggtgaaaagagaacaggaataggaaaagggcagaaaatgcccaccgagacaggtaattggggaagaacaaatagacagagggagtggaaagaccgtgttcacagaccccatggcacatcccttctagctgtgtgaccttgcaccagttaccctggcttccatatctcttacgtaggaaacccaacaggctcttgtggctgtgttctgatccattagccatttgagaagcccctaacttcctttcccatcttctctaccctgccatgtaggttgattttattttttattcatttctaagttgctgagaactatagtaacaaccccatatggctgtcactcagatagaaagaaggttattgctttttcaaaacaggatagagttacagcagcgatataaaatgttggctttcatcgagtaatttcagatgtcctgttggctctcctgtcctctgcaaatgctctttctctgttcactggccggaagctgcttcgtgtccttcagcaaggtcagagaaaggagctgaagtatattttctgctagatattgaacacacaaattatggtaccccatttggccagccacaaaatgcccttgcctcgtttttgatcactggggtgccagcacaacagtatcaccacaaaccctcagcacgttgctaatttgagctgttctcttgatatgatggcagctcctggatgggcaccaagagtcataagaaggcagaggaatggtcagattggctatgtgagcagccatcaccagagtccttggggtcatcctgcgagctgaagtccttggcggccacattttgcaaattatttctgtctttaactcagactcttggctttctcctatctctggtgttgggaattgactatttcctcagagtcaaggtctatctactagagcaaagggcaaggtgtcctagccattctgggcattcagtaaaggccaagcttttttttgtacacagagtaaatacagacacacagctctctgaggaaaatggtccagaaaggatttctgtcagccaaatttggttatgttttaggttctttatcagcaaataggaatactatgactcccttcctcacttagatgtaagccagtctctttcggccagcttattagctcagaggctatcttcatttgtccttgtgtactcaaaggctggccataggacctactcatgaatgacaccaaaatgctgaatgatttaggaattaaggctttaacatttctatttacttttctctgtcagtatttaatgaaatgcagttttcatttcttttagactttcatagtttccatatccctcatgcctatatttaaaataaattatgtagagaaaggctgcatttttccttttgaaatagcagtgaaatttgtaggaattcttgagagtaccaagaaatatatccacatgaagatggatgtgataattaacttggtataagtcattgttaaataactactaaaatattttttatttttttaaataactactaaaatatatttgtctgattataaaagtgagacgtgctcagtttagaaatttctaaattccaaaaacttagaaaatatgaaacacttgtaattaaatcagtgagtaatattgacttttaatatttttgatatcatggtccttttctctttttctttctttcttttgagacatggcctcactctatcacccaggctagaatgcattggccgagtctgggctcactgccacctctgaccccggggatcaagggatccttctgcctcagccttcccagtagctgggtctgcaggcatgcaccatcatgcccagcatttttttagtatttttagtacagacaggatctcgccatgttgctcaagctgatctcgaacttctgagctctagcaatctgtccttcttgacctcccaaagtgccgggattacaggtgtgagccatggcacccggcagtatcatggtctttactttggtatgtttgtaaatgcttgctctctctctggctctctctctctctctgtgtgtgtgtgtgtgtgtgtgtacatgtgtatgtgtgtgtgcataaattgtttgcacagtaatatatacagggcacctcacttttttgcactctgctttatttcactttgaagatattatactttttaaaaattgaatgtttttggaaaccctgaaatgagcaatctattggcaccacctttccaatagcatgtgcttatttcttgttttcattacatattggtaattctcacacatttttcacacagttattattataactgttatggtgacctgtgaccagtgatctttaatgttagttatccttttccttgtttcagggcaccaaaagtgcacctctataagacagcaaacataagtgataagtgttgtgtgttatgactactccactgatgggccattcccctatctcactccctctccttgggcctccttattgcctgacacacaacaataaatattgaaaatagaacaactaataaccatgcaatagcctctcagtactcaagtgaaaggaagatttgcacctctctcactttaagtcaaagctagaaatgttcaagcttagcaagggagacaagacaaaagccaagacaagctgaggcctaggcctcttgtaccagttagctaagttctgagtgtgaagaaaaagttcctgaaggaaattaaaagtgctacctcagtgagcccacaaatgataagaatgcaaaacagcctcgaaaatgttagtagtctggacagatgatcaaaccaaccacagcattttcttaagcagtagccccatctagagaaaagccttaactcctttccattctgtaatggctgaaagaggagagaaagcttcagaagaaatatctgaaactagcacagctctgcttatgaggtttaaggaaagaaactgtctccataacatacaagtgcaaagtaaagcagtaagtgctaatgtagaatttgcagggaattatccagaagatctagatgacatcactgatgaaggtggctacactaaacagattttcaatgtagacaaaacagcctttcttttggaagagaatgtgatctaggactttcatagctagagaggagaagtcaatgcctattttcaaagcttcacagaacaggctctttctaggggttcatgcctctggtgtcttaacattgaaaccaatgctcatttaccattctgaaaattctagggcccttaagaagtatgctgatataatctacttgtgcctcataaatggaacaacaaaacctgaatggcagcacatctatctatagcatgatttcctgaatatgttgagcccactgttgagatttactgctcaggaaaaaaaaaaaaaaagattcatttcaaaatattactgctcattgacaatgcacctggttacccaagatctctgataaaaatgttcaaggaagttagtgtgttttcatgtctgctaacacaacatccattctgcagcccatggatcaagtagtaattttgactttcaagtcttattatttaaaaaatacgtgttgtaaggctatagctgccagttagtggttcttctgatggatctgggtagagtaaattgaaaactttctggagaggattcactattctagatgccactaataacatctgtgattcaaaaaggaggtaaaaatatcaacattaacaggagtttagaagaagttgattccaaccctgatggatgaatttgagagattcagcagagaaagtaactatagatgtggtggaaagagctagagaaatagaactaaaagtggaacctgaagatgtgactgaattgctgcaatttcatgatagactctaaagtgtgagacgttgctacttatggatgagcaaaaaaagtgattgcttgagatggcatccactcctggtgaagaggctgtgaacattgttgaaatgacagcaaagaatttagaatatgaatttgagaggatttactcaaattttgaaaaacgttctactttggataaaaggctatcaaagagcatcacatgctacagaaatatctttcatgaaaggaagagtcaatccatgtggcaaacttcattgttgtcctattttaagaaattgccacagccatcctaatcttcaacaaccaacaccctgatcagtcagcagccaacaacactgaggcaagaccctccaccagcaaaaacgttatgacttgctgaaggctcaggtgatcattagcattttttaacaataaaatatgtttaattaaagtaagtacattttttttagacataatgttatgcacacttaataaactatagtgcaaacaacttttatatgcactaggaaaccaaaaaatgtgtatgattatctttattgcaatatttgctttacttaaatggtctggaacaagacttgcaatatttctaagttatgtctgtatgggcatgtatacatcacacaagtgggatctacacatacatatgtatgtatagaagcttacatatatataatttagcaccctacttttgttcaacattaatttacattatgatctttcccttgtcattaaatgctccacaaaagtttgattgaattaattaatttatttttaatggcttttatactcttttattccttataatttttttgccaaataatatccgtatattctcctgtgatcttttttataatttcaacttttattttagattcatggggtacacgtacaagtttgttacatgggtatattgcacgatacttaggtttggggtacatatggttccatcacccgggtagtgagcatagtacccaataggtagtttttcagcccttgcccccacccaagtagtccccattctctattgttctcatctttatggacaccacacccaatgtttagcccccacttataagtgagaatacgcagtatttggttttctgttcccatgttaatttgcttaagatgatggcttccagctacatccatgttgctgcagaggacatggctttattcatttttatggctgcaaaatattccattgtgtatatgtaccacatttgtaacacattttctttatgcagtccacaactgatgggcacctaggttgatttcatgtctttgctattgtgaacagtgctacaatgaatatactagtgcctgtgtctttttggcagagcaatttgttctcatttgggtctatatgtggtaataggattactgggtcatgtgtgaattttcactcttataaattaaaatgtggaaacgaacacactagtttggtagtccttgtggctgaaaatactgagtccacaggagagctccaaagtttgctatgttctttgcttccccatttccaggatctttctcctcctttctaatgtcttccttgttctccatgtccctggtctaaagaagtgatggcacatgctgtgcgtgctccctagacttcagttcccttaaaacatggcaaatgaccattaagtaagaggagacaataccactatttcacatctcattctgggggaacatgaattaatttctatggatgaaataaagagaaggaaagccatttactgaacttgatgatgaaagattgtcaaagtaggaaactcagagctctgaagcagtcctccttctaagggtcttgtcacctttacatcaggaagcactcaattggatagtataggggccaagggaaaatttccccattgcctctgaaaggtagctgaaaatcactgtcagaaggcagattaataggaagaaaggcatacaaatttacttgattatagttttacatgacacaggagccttcagagtgaagagctgaaaatacaagagaaactccacttttgtgcttaggttcagtgaagtttggacagttctccaaactttgattggacaaatagagtatgatctaatgtttacagactgagagggaaaaacagacaagcattgtctgtctagcttcttctctgactctgagcagcattccttctttctgggcatggggcagaactttctctggaagggggatcttatgacctaaaatcagacaaagtagatcagataatgtctttgttattgctggttttttttttttttttttttacatggcgtttctctcttgttgcccagggcggagtgcaatggcatgatcttggcccactgcaacttctgcctcctgggttcaagcaattatcttgcctcagcctcccaaacagctggaacgacaggccatgcatcaccatgcctggctaatttttttttatttctagtagagatgaggtttcaccattttggccaggctactctcaaactcctgacctcaggtgatccgctcgccttggcctcccagattgatgggactataggtgtgaatcaccacaactggctcagataatgtctttatggccagtttttacacagaaaggcgggaggaaagttagagtaatatttttaggttttatggttggctttgggaaaaaggggttttagcttctgtggctagccccaggggagaatgaggggccagagacaggagggtcggagaaggtcagagaaaatcttttgtttctgagaccttcattttgggatatcatttttctgagctccaacaacgggcagacagctatttatttacttccaaaacaacttctgggttctctatcagaaagtgtgatgagaaaacagaagctattaggtagaacaggtctggactcaaatcctgactcttgtatctgaaacgttatatatctagatatgccatttcttccctttccatgtgtcctaatctgtcctaatctaaaaagtggcaaaaatcccctatttatgttggtggcttggagaaacagatacatgaatgtatgagcaatgctgggcatgttttagatatttttaatcaatgctcattctgtgtgtgcgcacgcacacaaagcacacacaaacacacttctcgcagaacctcatagcaaggagatatttggggtaaatgctgtaatgtacctacagagatagttttaacagctcttcctgctttctatatcaggtttttgtttgtttggttggttattttttgtttgttttgtttatggtttacttttttttttttttgaaacagagtttcgctctgttgcctaggctggagtgcagtggcatggtctcgtctcactgcaacctctgcctcctgggttcaagcaattctcctgcctcagtctctcaagtagctgggattacaggcacccacaaccacgcctagctaatttttgtatttttagtagagacagagttttactatgttggccaggctggtctcgaactcctgaccttacgtgatccacccgcctcggcctcccaaagtgctgggattacagacctgagccaccatgcccagccaatggtttacttttttattgtttgtgttcttcagcatcccttcttgtcaactcctgggttattgcacatactaagcaactatcttttctcagtgatgtatttctttcagttgaactcactgtacgtgtagaaattaacaccctcatttacccaggcatccgctaggctataaaatcaattcctttattattccttgctgtctaattcctctatcttttgaatagaagtgttgctttccactagaccttatccaagttcttaatattatcattcagtttctaggactacaagctaggctgagcactctaattatagtctaaccaacctgatcaaaatttgggaattaattggtagttcctacatgctgagatctcccatagtaatttcaatgtttttgtttaatgttttatttaatgctttgtttaatgctttagtctgcttttggaaaccactatttagcttgtgttccattaagactaccgagtcaactttgatctcagttcctcagaggtagtgctcattctccaccttggaactgaagtgtttttgttgtgatggtgatggtggcagttgaatttttggttttggactttttttaaagaacttctaagttcaccttttaagattttcacatttatcctgcttgaactctagatagtgtgctcattatcacagacttcatatagcctgtaaatagatagcaacagcaatagtttgaatatgaatacaatacttgtgaaaagctctctgatttttatttgttatttatttatttatttatttatttatttatttatttatttatttattttgtgtgtgtgtgagagacagagtcttgctctgtcacccaggctggagtgcattgcatttttagagctctttcaagaaaggctgtattgatattagtgtttcacccactcactcccattccataccccacccagcccgtgaccctggctttgcattctcatgtacctgcactcattctctaacttcagctgcttattattattattttttttaattttgatatggagtcttgctctgtggcccaggctggagtacagcagtagcgtgatctcagctccctgcaacttctgcctcccaggttcaagcaattctcctgccttagcctcctgagtagctgggattacaggcatgtgccaccatgcccggctaatttttgtattttttgtagagacgaggttttgccatgttggccaggctggtctcgaactcctgaccttaggtgatctgcccgccttgacctcttaaagtgctgggattacaggcgtgaagcatcatgcccggcctaacttcagttattggtactgaacacatcaattttgcttaggaaaaggtatgaaggctttctttgattttattctccttccttttttaaaaaatcacaaaacaacaaagttagagctttttcttagagtgattacattattgtatgatgctgcattctaccaaaccagagcaatcatcattcaagatgaaaatgcttcctttaattatatgaaatgtcagtctgcaagttgcacggcatggaaggggttgggttattccaaatcaccaaaagacaaatgtatttacaacttctattaaaatcctaaccctgtagctttaacaaaattaacaggatttcgatgcattcctggtaagtttgacttataaatttcaattcttggcccccatgccaaagcttgatgctgctcatctgcttctttctgctccccgaagatagagctatttcaggagacacgttttgtatttccatcaaaaccagggagagcttcattaaaaaataaacccatgattcttttccattttttttttctacctaggtaatttgggtaattccacagtgaatgaaagagatgaaaagatgtgatttaagacacattaaggatgtaaatatatacaaaaatttggcttcttgtctcttctccaacaattaatttcatgaaagtgttttctggtggcttacaaacaatgcatgaacatgcacaatggtctttgacaggatgtcaaagagcctgcatggctgagatgacttccatcacagaaaatcaatttcctgtaaatagtgaagaagcaaagattttaggccaacatcagatatgattctcgagaatctatttcctgcttgttttctggaagcgcttggtggaaatttgaaatagatattttgccccatcaattaatttcttattttttcatcatcatcagaaatatcaaagttaatattttatcaatattttagaccccattttgttccaacagtacattcaatacagttaaaaaataaatattgagtgtttcctgtttgcaatctgaatatacatataaatgctagtgagaaatgaagaaaataaagattcagtaaccaaagcctaaatctacataaattgaaaataaaatgataagtttagaaatatttagataaggttaaaattgcatataaattcaagatgagttttattatgactcattataactaattccaacagttgatagaaatcatttaaagaattgtaatactgtttggtaatatgttatgtggaaacatagttaggaaatctttccacttcctcagtctggatttcaggaaatgaaagcccccccaatctccccccaaataattcaagctctgctgtgtaagttataggaaataccctcccctgccagctcatttcctcttattgttcaccttgaatggggccctcagctaccttttcatgcctccctctccctacagatgtatcaagcctggtaaaagccaagggcttccacaggaaaagagctaggtcagagatacccaaggccaccatgaagtccccttctgtaagagaatgtgaaggggagtttgagaaaagccagaatttaaaaaaaaaaaattctagccagtcaactcatttagaccaatacattaacaagaaaaggaaccaagtttcttctgtgttcacattttcgatgtaattttgtatttaattccatctaaatattaattttatagttatattgcatattttataaaatgttagatatttatttgaataactatagtaattaggatagtactttgccttgaagactcaataaataattgtagaattaattaaagtatgtaagaatttttgtgttcgtaagagtgattttatgtttctgcatcaaaattatattgagtaggagtttcttttttgtatataatcaagctgtagcaacatagtatattaagcatcataaagatattctaggaatataaattacctatgtgcaaataaccctatattcaggttttccttttttttttacatttttaaaattatttctttctttctagctagctgcctatctcctggtatatttttattctatatctaatgaaactagttgatctagctaacaggttaagtggataaagtgtcccattgaattacatgaaaattgttctgcactaactgagaaaggcttacttccagccctggctctgatcttcactgtatgtatgtacttgagcaagtcatttcgttttatgtgtgctatttcttccttaactaacaaatagaaatcatgtatctcctgcctgcatcactggctaaggtgaagatcaactaagattataaatgcgctctgagatgtagaaaatgctatatatttataagatggtatcatttgtacaatgatgatgatggtattaattatgtgacagactaatctttaatatacacagcaggattttctcttttaccctttcaatcctgatttaattgatagctatttctggatctaagatatgttgagattcaaagctggcactgggacagagggaatgtcatgattccaaaatgtattagacataaagtcatccaaacagctataatatgtagagttttgttttgactcatacaagtttaattatctgtaatttaagaaaagtggctttaatactaactacttacaaatataatttcttctcacaataatcagaattgggagcgcacttttagccattacattaatctagttttcctttgtgacagaaaactatatatgtgtccgttccttatttatccttcatatgaatattgtttatcagcactggaaatctcaccctcacatcctcttcaaatgaaatatgaaaaaatgattagtctacacacaggcactcctccttaaatataatgctaggtgaatttacaaacagttatctcaatgaattatcaaaatatttctaacaagggattgattgtcccaattttacggatgacaaaactgagactcaggaagcggaagtaacttgccaaagctcacacagtatgtctagaatactaaaaccttgtatcgatcaagacgagcatgttgacctatgcacaaggaagctttgaaatctagttcatcattgacaaatccggtgaaaattaatcttttagtctcatccttcctcttcctaatcttcttatgagactgtatgtttctatttaagtatttttcagctacttaactgtgtccactaaaattctccaatgtttttacaagttccaagcatttgtcatataacatttcactcatatttttgcatttaggtcgttctttgtctccaaggtattaggttttcttgccattcatcttctgcctgtgtctttagtacccatgaagctaccttggctctgctgtttctctccttttaatcagaagatttgttccattttgttccataccagccaagttatttcactattacatttctgaatctttcatgcttacagtttgccttccttaccaaggagcctctgcttatgacagcatttttcttcttcattctcacaagtagcaagtaaatagcaaataaatccttcaacatggaagaccctccaccttttgcttatttatttttgtaatttgtaccaaccctttatatttggtgaagatatcacttttatcaggaagactactaggtacattggtatgatttagattcttctctatggacattaattgctatattcctaccacttggctatagtgactggcatttaataaacattccattagtggtagaatacgggagcaatttaatggatgaatgaaatgtgtgtctaaaaatgaggttgcttaaaaaattctgtttctctgattcatgttatagtgttagctccagaagggaatgttctctactaattattttatggtaatcttaaaaacctttaatggttttccatcttaactatttttgataaatagtaaaaatgtctagtttcttttgaaatacattcaagtcttgtgaaaagttgagaatgagatgtatattcaatgtgtcacaatccagtggaattgaacttatgttattgtgcttgtattatattgcacaaggttgaatagcttcctttcaaaaactgtcagacctggcattaatcaatccaatcgaacagtaaactacagtctgtcctttcttatttggcaaacagataaagcacagttaatatatttcattgcaaccctcaggtgttctgtttctaatgtttactttagaaaaggttataatgaagttgacttactttattcatacattcattcaaaacccatttttcagtgtaatgtgccaggaatctctcaaaggctgggagtagagagaagaaagataacgtccacccactcaaggttttcacaatcaagatggggaggaagataagtaggtaattacattcagttggtgcaaaaataatcgcgatttttgccacaaaagtaatagcgaaaaccgcgattacttttgcacgaacctaatagattatgtgattaagtctcagcagataaatgcccagaattttatgacaaaaagtagaagggaaaaccactcaggccaagacatttagaggattccagagggagttctacatttgctaagttgcaactagttgctggtagagtattggggagttcgagggaggtcgaggagtttttgagtgggagagaacagcatgtgccaagacatatacacaagatgggcagaggaagtgtctacaagactgaaagcttattggctgaattatattataggaacattggattcgtatatctgaaagaatggaaggagacaaagctggaaatacaagtgagaattacttcaaaagggaccatatatgcccctccccagctttggggtgggcggagctttgcatggagaagcaatgtgattatattagcatggtgaagcagcacgctggtgtatggttgtcagataaaatatagttacatttcagataaagaatgaatcttttctttcagtatcaacatgtcgcaaatcttgcatgggacatatttacacaaaaaagttattcattgtcaaattgaaattaatctttcactgaacatcctgtatttctctgtgttaaatctgacaaccttactctgatagcagtgtggagaatgaattggagaagaaaggacaaggcagaaaggccgattcaagggacaacctattaaaatctgcattcaccctttgagtcacaatggcattgctatttattacattgtgctaaagtgcaggatgtggacaactttgttaccatggctgagacccagagaggcacagcctgaagagaaagacaatggatattctggaacaaataggagattttagtgctccaggttttacaggagcactggacctaagatggaaccatactttaaactgggaagaagatggcatgtgtgcacatttcctctgaagactgtggggtaaaatcgatactgttgtaataaaacataggaaacaaagacccactgcatttatcctgggtctcaaggagaagtattcaaacatgccccatattcgtgtttgtataatgatttgaacttttcaatttcttcccatactcagtatcttctatctacatcacaatggctttgcagtcaggaaacagttatcattaacccaattgacagataaggatatctgcacatatacacatattctgccttagtttccttattaaaattccttttgcatgtcaaatccaagctgaaactccacattttctaccaaaatgttcagcccacagtttcttctccctgccacttactatgtcagcattactgagccctgcacaaggttcctctctgagaccttgtttggttttggcttgtgaactcatattgccacccactggactgtaagctgccaaaaggcaaggacaaattttagcattttccaggacacttctgtagtatcttagtattaggcgtataaaagactcctaataaatgtttgattatcagactagcagtggaagagccagaaataaattaaaaatctagtatctcaatatgcagccttctgctcttttgggttaccttcatactttttaaaaattttcatcccctgtcaaaccatacagaggtgtgatttcaaggagaatgaagacaacactggaggcccagagttattcagaggatgctttattcatctcccaaactcggtgcaggaatgagcaccagccacactaaagaagagcgtctgtttaaactgcaccatcaggatagggtctaccaatgagatggagttaaggaagctgacagctgactgcaccatccttggctcctcttttatgaaccctcagggtgtgagttcagtcttccccaaccattgctcagcttctttgcttcccagggagggggattgtgagcaggtccctctgcatatcagagttgaatccactaactggttataatccgctcctaactaatgagcagttgctttatgttaatggatatattcaaatatttgtttacttgttagcataggacatacgtgtatactcctataaataagataattgcaaagtacgtttactatgtattgtatagagcagctattctcatggtaaccatgccaacaagtatatcagaacccccggaggatttgctaaaacacagcttgctgggccttagggtcctgagtgggcatgagaatttgaaattttaacaaggtccccaggtgatgctgattgtgtttatccagaaccacacattgagatccatcgatgtagaaaatacagtttcatatttgtctgtgtacgtgctgtgcacacactggcttacatatgaagacatctattctatagttgtgtgttatgtttagacaaaaattactgtaaatatgcttatctgcatagctactcatacatatataaaaatatacaaataaaatgtttactcacaaaagttgtttgtatatgactttaagtctaaataaatgcttatgaaaggttataagcctatataatgttatgtatacaaacacatatgcatgtttgtacatagaaatatagttatatttctaggtgatacttgtgtatgtacatgtgtatagtatcaacgtatctttcccttttacaacaaaggccttattaagtataacatcaaatttaatattttagttaaactcatcatcaaaagcagtgtttaagtgttccaacctgagggcggagatgtctccatgctggccctgttaagctttattagaaggatgatcttttcaatttccctagagcctcttacatatttgctatatttcacatatggaagtgccaaattaaataagcttcatggtctttcagaaccaccagggccctcctataaagtcaaatttcaatcatttcacttctttgccttcctcccaaagagatagtacaattcttctggcatttaactgactaaattaacaaaaatgcagtgcaaactcagtgtgttgagtgctcctgggtcttacatccttcttgtgctaaaagggtctgctttgttcaaaggcaaactttgtctttggaagaggaggaaatgcgagacatgagtttggggcctgacacttaggagggctaaggtagaaacaaaagaaatgaaagcatcagattgaccacatctcctgtgacatacagtacaataacagcttctttcttccctactccacagttcttcaaatgcaatagaagagaaaaaaagagcaacctggaaggaaaaaaagaaaaggtagcaaaaagagatggatatgcattactagtcacttcatttccaagacatgattatgctttggttatatctcatgacatcacattgcaataaatattacccatcatgcataactggtggctgaggtccagaatctttgggtaaactatttaagaactctcaactaaaagtggaagagctagaatttgagctaagatctgcctgatttcagtggttagatccagaagcataaatcagtgctttcctaaaatggtctgcaaggaagagttaaataataaataaaaatccctgggaattcatttaaatatacatgttgcaatggggacaagagaagcaggagaggaccttgtgggcttgaattttgaacgagtaaaataattttgggatatgaaagaggggagacttacatggtgagctgtcaacatcagcatttctcaaaaacaaggtggtgagttgcccaaataggaacttcactggtataaagtctgaggttcatatacttttacatccacagcttttagcaggatgtttgacctgtggtaagttcacagcaaactctcattaaattagttgcctttttagagctgattctgcttcaagttcaacttcccttcctggtcctctgatgactaaaacaattttaccaggggataagatttcatttcaaatccgagataaggttaaatgcaaataatgcagaaaaagaggaaacatattgactcagcacctgggggtataaatgatcaatggtagatcatcttctgatattatggtttattggagagatggagaaggtcactgaagatctgatcagggagtagggatgagcacaaaaatgagagaatctggtggtatcagacaaagtgtgcttatttcactagtttcctggcatctggtcttctgagcagaactgcaacagaggaaaggcaagaaatggctttgggagctgggagaccctgtgcacaaaagccttcctggcagcctttctttccagggtcattgtgcttagactttgttttacatgagaagaagaggtatcaacgattcaccatagaaaacaaaagatcctgaaggtaggaaaaacagtagtaacaaggtttatgaatcagctaaacttgtgtttccccaaatatatttgtttacgatgatcctttaagaagtttggaaatcaagtcctttaacaaaaccaaacgtgattcttaagattatataagttaacagaaacatctatttataaaagaaggaacaaaaagaaagaaggggccgggcgcagtggctcatgcctgtaatcccaggactttgggaggccaaggtgggcggatcatgaggtcaggagatggagaccatcctggtgaacatggagaaaccccgtctctactaaaaatacaaaaaattagccgggcgtggtggcgggcgcctgtagtcccagctacttgggaggctgaggcaggagaatggcgtgaacccaggaggcagagcttgcagtgagccgagatcacgccactgcactccagcctgggtgacagcgagactctgtctcaaaaaaaaaaaaaaaaaaaaaagacaggaacagtgacaaagtgagagagagaaagagagagagacaatgggacagaaagaattagagacggagggttatctcagcaccaggtagaattcagcagtggcatctgacattgtcatgcttcagacattctgccatcatgaaaaattggattaatcataacctaaagggtttcacatctgggtttcttaaacctggcctaaatgagtgaatccaagaccgcatataatgggatttcagtattttgaagattaagtttttcatgaattcttcaaagtttcctcctgccaaacagactgaaataaatcaaaatatttaggaaacacatattctaatcatgagtggcctctagataattaagaattgttatttttaattttagttatttttcaggagagaaatatttgtcaagcaattgtgtcaggcatttttttaggtgttggagatacagcagtaaacaaaacaattaatttctgatcttgtggagcttattttctaacaaagggagataaacaaagtaaatcagtaaaatatgtaatattctgaatacttaatattattgaaagccctcataaagtccatttctaagccttgctagccagaatgactcccggggtcaatgcagaccctgtgaggtttggaggtgtggaggccctgcagcttggcttggtcctcacacacctaccatgcattttattcatcttttgaccctggagaggttccagactactctgagcctcagttgccgcaactttgaattgtgattctgacattaactctgaaagtttttgagcattttataggagataataggtgtgaaagagtgtgaatgtaactcttgatcaagacagccatgcataatcttcattaacataattttaccaatgtcactaactcaaattaaccaaggagaaaaatcccttttatttatggggattttgttttgttttgtttaatagactggacagaggtctacaccttaagaattggcaagacttttgttggcatctattactatagattccacaccttgcagggcttccaggttggtattctaaatataaagtaacaatgggttcatctaaagggcataggggatgaaggtataggagactaagctgctcttagcacatcaacccctcggaaagatggtactgcggagcagagcaggtgccttcatatgcctggccttttctctgcctcccaagtgggctttgaacaagtcttttaacttcactgagtatgtttgcttctgtaaaattggaaacaattaccaactttcctatttgcagagcttgagaattgagttttctctccaaagagaaaagaagatacaaaaccttcatgcttgaattaaaaattacaaccttcatatgttttgctagaccactttttctaagtactcttaagggtgagcttcatctctttttattccataatgtgtatgttattcaaaagatttattgctttggtggtctgaatagggatataagagccactattaggctaacaattggtagcaatgatgtttttgagcaaacttcaagggtagttagagaagtctaacagagtgtgctttatgagctaaacacaataatggatcgtagccaatgctaaaggttccattagggaggaggaggagatgagtgcgtgagtttccacttacacactttttccctgtgtgagttgaggactcaactggcagattttaccacactgatcctgtaggatgcttattagaccaagtctcccaacccaaaaatcagagctaccccagctttacaaacaaccacttcctggtatttcaattaattaaaaatttatgtagaaaaagaaaaccgaaagctcaattaaactactatgatcctagaaaaaagataggaaaatggaaatttctctcatgctatccaattttctgaagctgctgcttctttcttaaaacaggaataagggtgttataagagatgtctatgtcattgataagatcatagatctattaaataatacagttattaaaaacaatatacaagtattacacacatgtatatgcacatatgttgtgtatacatatacctacgtatgtaaattccatgtctgtgggtagtttgttctaagtattttctcaacttttgtttatataaactactgactatgtgttatttaccccggcatgagtttttatcttctcattctctgggaggataccactccatgtgtctattgtttatcttgcaaaagtagatccttctcatctactgaatgataacagtagaagcctggctttttttgagacatattttattggaacaaaagctgtaaatatatacctatgttttcatggattgtgttttatttttattggtgtctttaaggaatttgcatgttcaaatgcaaacaccaataggtatctttgttttctgactaagatctgaaaatgaaattgagtgcacattttatttacccatctcatcaggccaacaaatccatatgacacagatctggttgttcataaactttttggtgtgggatgtttggagaagatctcaaaggatggggattctctgaaccgcttagttgtgtatttcagggtgtactaaccccttttagttttgaacttccacttgcccactatgcttctttaagaggttttgcttgtttggtatttttgccaaacagactttcataaaatatttcttgcaatgaaagccttccattccttgaaattcttgaaaaacttccaaattatatattatatatatatcatatgtatagtcaagttggagaaagagacaagtcagttgccaaatatggcagtgtgcttaggttagatgacagaggcaatcattcgatattaggagagtacagtggaagaacacctaaaacagactggcctggctgggcccagtggctcatgcctgtaatcccagtactttgggaggcccaggcaggtggatcacctgaggtcaggagttgagaccagcctgaccaacatggtgaaacctcatctctactagaaatacaaaaattagctgggcatggtggctcacgcctgtaatcccagctgctcgggaggctgaggcaggagaatctctttaaccctggaggcagagatcgtgccactgcactccagcctgggcaacagagcgagactccatctctgaaaaaaaaaaaagcaaagaaaaagtaaaaagaaaaatacaaaactctccctagcaggctttaaggagctgcagtctcgtgtctccttagtttgagacattcctggaatcctacagaggacctggtgatggggagcctgtgttctttcattcccatgaaaattaactctattgcttaagtgtggagcaggatgctttgtgtcaaacttgcagatccacatgctccatttttcccctgctctggccctgggatcctagactttctcagttgtttttctttctctctggtgtctgtggggctccgtccatgggatgcacaagggcagacaagggcttgggaagagtgggtcagaatgttcgttgtacattccattcttgctctctgctaccacagttggcctcttctccctggagaatgctgtagctcctgcctgtcctgaccttcacaccagctgccccctgcagccctggcacttctttgcccgatcaagtactgcccactgtggctgtctagggtgattcactgtcctgtgggggtttctttccatgctccccatgccctgaggacagtatcttaactctattccccccaaaccatgcgtctgatggtgccagtggcttcctgctgatatccacaactgacattcacatctaataggcatatcagaatcagagtgtcaaaactgaactccacacactctccacctctcagcttctgcatcctctcagctgtggcacctctaaccaaccagttgtctcgctgaaaatctcagatccttctctgacttccctccttctcctgggctactgtcctcaaatcttcgtaaaatgtcatggccacgaggagtcctaccatgaccaccctattgaatattaaacctcatctcttgcttccccaaaaactccttcttctcctggtcttgctgtatttttttctttgtttcttagcatttatcatttacaataggactgccatcaaaattggatggtttaaagctacagaaatgtatctcatttctgaatgctagaatttcaaaatgaaggagtttctacttcctctgaagcctctgagagaggacccttccttatctcttccatttcttggtagcttcaggtcttctctggcttgtggaagccaatccaatttctggctctgttttcgtgtgtttgtgtgtctctgggtcatcacataacattcttcctgtgtgtctgcctctatgtgtccaaatttctctcttcttataaggacaccagtcatactggataaaggcccaccttccttaatggccttagcttagcttaattaaatctgcaaagaccctattttcaaacaaggtcacatttacaggtacttgaagttaggacttcagacttcaatgcctctttttatttaatttgttgagcgggacataattcaacccataacctatagttgacttatttattatgtccactgtttattgtctatctccactagctaagaattagtatttttcagggcagagatctttgtatcttttgttcattgatatatcccaagcatccagggctatgtgggaaaacagtggttgctcaatagatgtctgttaaattgagggaaagtctgaacagcaagctgttttaagattaacgtaaaatggaattttactcagcatggggaagaaatatccctgaagctctaggttggcattcctgattgtgaaaagcaaacaccttgttatgatataaacagataccaaaccactaacgtttcacttggaaaacaatacctcactggacaaggagggagcgaaatttcaccctagtatttcttttctttattctacaattagtttatgaaatgtgaagcatttatttttaagctaactcctgttaaatcttctgaattccagacctgaggtttgactctttagcagatggtagatatgtaccttggagagaaagagagggtggagagggaggagacagagacaggaagtacaagaggggctgccaaacctcagccctggacagacttcagcaaacaaacagaagtgagacccagcaggaccgggtgtgagctggttttattgctgtccaccagctccaggtcataagtgacctaatcaaccttagcttgcatctttcttgcgatagctttgtgcctgttcgctgcacacagctctgattctcactcatcctaggccttggcgggcatatccagagccctttatgggatccaggacacagctgctgcaatatcccttcattccaaatcacctctcaacccctcccccatttattttctctgcgctactgaacatttccaacacttggtataccagcatcctcctcatcccctccccaaatgacttggctatatctcatatccagaaaggccagctatggaggaccacaggtgggagcaaccacccaccatagctattaacaaaactcaaattgcacatagcacaggtataaattaggtcatatatatatatatatatatatatatatatatatatatatatataaatataaataggtgtgctgtatgttcaggtaatgcaatgaggcctgttttctcttttctagaacatgtggtaaactgacaaacatgcatttactggtcatctgtgtgcttcctttagaggccagaaaattattctaaatatttgaaaatggtttacttccaatcaaactagttactaatctgtattatttggaaaaactgaatccacaaaaaaattttgcttagaataattttcttaccttaggttgccacattataacaatgaaataataataatgtaattataatcatataacataatattttatatataaccttatatattataggtaacattacacataatgtagtaacaatatataatacaactatgtgtaatatagaaatacaataccaatagcttcactaatcacacatttatcttctaaaaaaacgtttcttttgaatattggacacaatggtaaaaactaatagatggaaaagggaaaactagaagttatttgcagtgtcccaattcagtaagtaattgctgttatactatataagggatcctgcaaaccaaaaatcataactaaatggaaaactacaccaatagaaaactggccaaatagatcacaagtgctttcagaattaaataaaaaaaaaactcaaaaagcataaaaaacatctaaagagaacctcaatcgtattaaaagtcaagaatgcacgtttgagcaaggatgagaattcactgaacatttattactctggcaaaagcaagaagctgggcaccactgggagtggtatggccgggtgtggccaagctggagagccaggtggcagggagagcagacgtgaccccacagttcctgcagagagcgtgcatcctggagaaattctcacacaggatcctagaggaacactactgagaatactcacttttgtgcttttagaggtgttgagaaatgcagtgaacccccttgcgcagggggctgccaacttcatctataaaaggtctaagagccgtgagccagaggctctcttgcaatactcaacactgtcccacagcaccgacagaagccccatagacatgatgcaaatgagtggacatggctgtgatctaacaaggtgtcatttacaaaatcaggcagtaggctgggtttggcccctactgtagtttgtagtttgtccattcctgtatatcccaattcctttcacacatattaaatacacacacacacacataattcaaaaagctagcaagattaaacataaaatacacataatcatataagaatgatggcttgtggaggatgcagaggggaatggagtgatcaaacagagactaagcaatggtgtggtggggagtgatgaaaatgaacctagaaataaggattgtcctaactcaagattctgtacccagggccaatttcattttttctaagcaaaggcacacaagctatggtttcggatgaggagctataatttgctcctagttttttaagaactgagattctgtgcagagtgctgccaaattgcccacagtgagttagtatgaagcgcgggcctctgatttgatttgatgatgtacctaattgtggctgggaatcacagtactttttggactcattttgagtgccccttttttgtaaaataaatgataccaggtaaaaaatagcagttttttttttcttgatcaggatgtaatgatttaaaaaatgcccaagggaagaagacaattgtcaagctacatgcacaatggcttaaattgttcaagatattacctctgatgaagaagaaatggagctgtcacgcaatgaaagtctgtccctaggtgagaagggctaagggataagcatactacagtggttaaaagcaagggactggagtggattttcaatccacatcctggatcttcacttcacagctacatgatggactctggcagcatccgttatctcatgttacagtaagcatgatatttacctggaagaaatattttgagggttaaatgcccaatttcaaaaataagacgtgtacacagcgattacatgagatactcaggaataacatggtatagtttgtacgattagcaattcctaattattgttgctttccatatttccatgcaaagatagtacactcattatcccatactccttaacagagagatgtctgttgctacaaaagtataacgtatcatatggaatgctaccatgtgttgtcttgaaccccaaggcatctagaaagcatcccacttcccactgtaaacagtcacaaagcattttaaaataggttcatttttaaaagagccatttttagtgaatttgttaattagcaaattagtaaaataccaaagaaacacaccatgatagtcaaagcttacacagggtcacacaggatccctgtctcaaaagtcccgtaacagtctctcatctgcactgtccccaagccctggggaccatgttggcattacatagatgctgcttagcccatttccttgtcttctgcctgcaaggcatgcagtgagcacacaccttctgcaaaacctctaagtgaaacagtaggtggtctggataaatatagtagcatgcatctcgtgtctcaggttcctaaggttcctacatcatacctcaatctttcatatactttccttcacatgttacatgttttatttcttcattctactatcctgtttcagaaaattgcaggaatatataaatatgtataaattatgtataaggtacgaataatcacaaatacatatctatatgcctatgatctcaatttagggaaaataactgccagtatgtgggaatcattccatggatccctccttcctccacctttgcagatcgcatatcctgttgaattttgtgttattaatcctttgattttcttaagaaagttttaccatctacacttctatatttagttttgtgtgattttaaacttcatataaataaattgagttgacttttcaggcaatattattttcttgagttctgttgatactattgcatatagctatagtttattttaagtgctgaatgattttcctttggaataacatacaacagcttatttattttattggatatttgtgttgctttcagttttctgctctaacaagcagatccatcatgaatactttcacacatatcctagcacacatggggaggacacttgtttagagtatttacctagcaatgggatttcttggacatgaggtgtgtatatctttaactttattgaaattatcaaatcattgtccaaatatttgtaccaattcatattttacaaacaatacggcccggcgcagtggctcacgcatgtaatcccagcactttgggagcctgaggcgggcggatcacaaggtcaggagatcgagaccatcctggctaacgtggtgaaaccccgtctctactaaaaatacaaaaaattagccaggagtggtggcgggtgcctgtagtcccagctactcaggaggctgaggcaggagaatggcgtgaacccgggaagcggagcttgcagtgagctgagatcgcgccactgcactccagcctgggtgacagagactctgtctcaaaaaaaaaataataaaaataaaaataataataataataaaacaatacgtaggtattccatttgtattgactctcatcaaaacttcatattgaaagaaaccttggttattgtcaatatggggggtgtgaaatggcatttcatttccactttaatttttatctgtctaagtactaatcaggctttttaaagattgtgagccatttgagtttcttttttttaagtttgtcttcagatattttgaatatttttctactgggccatctgccttctttcaaatcgatttgtagaaattatttatatattctagatgctaatattttgtcagttatatggttgccaaaattatctttcaatctgtggcctagatttttactcccttcttatgtatatacatgtacctatatattacaatatacagaagcgcttagtttttttttcttttccgactttgattttagaatcaagcggtacatgtgcagctttttcatgagtatactgcgtgatgctgaggtttagggcatgattcagcctatcatcctggaagtgagcaaagtacccaataggtagtttttcaacacttaccctcctccctctctccccactctaggagttcccagcgtctattgttcccatctttttgtccacgtgtacccagaagttgttaatttttacataggggaattagtccattattttctgacattttaaattctctgtattttgcttaagaaatagttttttagcttaaagtcataaagacattgtcttacatattttttaggttttttttttcagttttcccttttacaattaaacctttagtctatctggcatgtattattttgtgtctggatgagaagtatgccagatttcttgccacatgatttcttttttttttttttccattaactgtaaattctattcctttcttactggaaaaaaccttgcaggaccaagtctatcataaaccaaattgccatatatcctggggctgtgtctggtagtcttattttgttttatagtggtaatattctatcccatgccaatattcacacggcaattactacagatttctataattccttatatgtaccaaggtatttcttctcattattttcttctttttcaggaatatcttgcatattcttgggtctttcctcttctaaataaactttactattagcttgtcattgttaaagggaagcaaagctggaaggagaaaatgaaaggacagaggaaaaggaattctgagatggggtgtggattgaatttcaatgaattcatagatctatttagggaacatcacaattgcaaactttatggtattgagtctttctaggaaaaaaattatttctatttatttagatcttctaaaaggtctttccagagtattttataattttttcatgtattttgttacatttattccaaggttctttttttttttttttttttgagacggagtttcactcttgttgcccaggctggagtgcaataacatgatctcagctcactgcaacttccgcttcccaggttcaagcgattctcctgcctcagcctcccgagtagctgggattacaggcatgtgccaccacacccagctaattttttatttgtagtagagacggggtttctccatgttggtcaggctggtcttgaactcctgacctcaggtgatgcacctgcctcatccttccaacgagctgggattacaggcatgagccacctcgcctggctggtattctaaagttcttaaagctaccatgaatttccctttttaaaatcaccttttcaattatttatagctggtgtatctaaacacaattaatttttgtacattgattttatgcatagtaacttgataaacacttttcttcattctcataatctctatgtagattgtttagggttttctaaatatacaatcatcacccatgaataatgagagttacacttcctgctttccaatcaacagaaattttctttctttttcttgaatactttgctggctcggacctcatttgcaatgtcaagtgaataatgttcatggtgggcatatctgtctttttcgtgattctaaaacaatctttgcagcatttcatcaataaggggaatgtttgctctagattggcatagacacccttccaatcctaatttgctaaaagtctttgtcaagaacagatgttaagatatttttgttggatactgactttacatctattgaactaatcatattagttatctccttttagctttcaatttggtaaataatattaaatagttttctaatccgaagccatgttttttcatattgaatattgctgaattctctttagaatttactctaaattactgaggtctcttattcatatatatttctttttgagacaccactcattgttatggttttctcaaaacatttcccttttatcttggttttcaaatttattgacataatcttgtttagactaacctcaataacttaaattcctcttcatcttaagtcacaccctattttacttcttctaatatgcttttattttgaattgtggtaaaaaaaaacacttaacatgagatttactcttttaacaaatttttaaatgcacaatacagtattcactaaagtcacaatgttatataaacagatctctaaaacttactcatattgtttcactgaaaaactttatatctgttaaatgataactcctaattctcaatctgtaacctgatttcgaagctgcaggcacttatgtcctgccacgtatttcttactccctacctgtatcctgaaatcccagtccagaggcacaaattgtccacactctggatgcttctccggttgctcatctaatacccaaatactgactgaaacctgggtttcctgcagttttccatcccctcttatagagcccccttgtttgtcttctgtagcagagccatcttcaggccaaatcacctctaagacccatatgtcctctggaggcagcccaagtgatgtcaatatttctctggggatctgtttcaccctaaggaaaaggaggcatcctgctacgtttcattttctctttttgctgggccacccatcacaagtgctaagagttgaagagcagggcttgtaaataagaatttaattactcctcatttctacaattcactcaaacatctggtaccaggcgtggagccctgaagcactgctcgacctgcaggtcacctaataggaactgagaaggacttctctctcagcctggaccactctcaggtacatgcactacttttaaacctagccaaaaagggagagaataaaattgagatgtaacaatgtttaatgattatggaaattgtatcaatcactcagtgagtcagaagacatttgatcttcattgacattcgaaaaagaaggagaagcagcagttacagaatctttacaataagccatatccgttatgtatgatcacatttaatcctcctcaacacaatcatgctaagaaagggtaattctgtcatcttatgtcaaagaaaacaaagcttaggaaaggtaaatagagtattcaagggtatacatctaaaaccctgcttcttttaacacttaacctctccccatggggctcaccattctggtgtacagagtaatgtataaactatcttgtgagaatcacagtatagttggagagacagtaactatcatgttaagcagtaagtgacaggtgcccctgttgtctggttctgaatttggaggagatgcaatcagggagctcaggaatgattaaagaaggaaagcagtatttgaaattgattcagaagatgaggattttgcatatataaatttgttctcaaaagtctatgatacaagcttagagcagcaatatttcaatacattttccacattccatagtaatggttcatcttagtatcaacattggcaaaagttatggactctgttcattagcctcaccattaatattgttttgcttttgctttgtcctcggcccctaagacagtgtttgcgtaatcaaaatctgagtcatatacatattatatgtatattttatacatatacttcataaatcatgtttcaagattattgttacaatgtaaatcagtctgatgctaatttaaatatcaggatatttatgctgtgccctaagttctggaaagcaaacatgaaaaatattagtataagcattttaaactatgtctaaaatcaaggtgaaagaatgtactctatcattttgttatggcccctatagttctgaagtaagtttctcccaatttcctattctcaatattattacttcagtgatcatttaaaatttctgttagaactacaaggaaaatgaattgtgggagtgtcatagcagccccaataaatgtgattcagtggccattctgagaaattttgaaggaaaactttggtttttaaaatgttaactttatcttgggatgtctttagtagtgtaatgttaatgaataaatccatcctgcaggtttgtgagtggtaaacaaccagtcaggttaggttggagagcaggacggggccaacttcaggagtgaagtctgcatacgagcattgtggtagtccgtttttatactgctatgaagaaatacctgcgactgcataatttataaagaaaaagaggtttaatggactcacagttacacatggctgggaagccatcacgatcatggcaaaatgcaaaagaggagtaaagacatgtcttacatggcctcaggcaagagagtgtttgcaggggaacagccctttattagaccattagattttgtgagacttattcactagcacaagaagagcatggaaaaaattcacccccatgattcaattacctcccactgggtccctcctataacacatgggaattatgggagctacaattcaagacgaaatttgagtgaggacacagccagaccacatcattccacccctggccccttccaaatctcatatcctcgcattttaaagccaatcataccttcccaacagtcgcccaaagtcttaactaatttcagcatgatctcaaaagtccacagtccaaagtctcatctgagacaaggcaagtcccttttgcctataaaatcagaagcaacttagttacttcctagatacaaggggaggacaggcattgtgtaaatacacccattgcaaatggaagacattggccaaaacgaaggggttacaggccccatgcaagtccaaaatccagcaggggaatcaaatcgtaaaacttcaaaatgatctcctttgactccatgtctcacatccaggtcatgccagtgaaagaggctgattcccttggtctttggcagctccaccccttgtgactttacagggtacagcaccccctcctggctgctttcatgggctggcattgagtgtttgtgacttttctgggctcatggtgcaagctgttggaggatctaccattctgaggtctggaggaaggtagccctttcctcacagatccactaggaagtgccccagtgggcactctgtgtgggagctccaaccccacattttccttcctcacttccctagcagaagttctccatgagggttctgcccctgcagcacacctctgcctggatatccaggcatttccatacatcctctgaaatctaggcagaggttcccaaacctcaaatcttgacctctgtgcacccacaggtacaacaccagatgtgagctgccaagacttggtgactgcaccctctgaagcaacgatatgagctttacgttggccctttttagccatggttgggatgcggagcaccaagtcctgagactgcacaaagcagcaaggccctgggcccagaccacaaaactattttttccttccaggcctccaggcctgtgatggaatgggctaccatgaagacctctgacatgccctgaagacattttccccattgtcttggccagtaacatttggcgccttgttacttatgcaaatttctgcagctggcttgaatttctcatcaaaaaatgtttttttgttttctatcgcattgtcaggcaggaaattttctgagcttttatgctctgcttccctcttaaacatgggttccaattccaaatcatatctttggaaatgaataaaatggaatgtttttaagagcaccctagtcatgtcttgaaggctttgctgcttagaaatttatcccaccagatgccctaaatcatctctctcaaactcagagttccacagatatctaggacaggggcaaaatgctaccagtctcttcgataagcataacaagattcaccttttctccagtttccaacaagttcctcatcttcatctgagaccacctcagcctggactttaatgtccatatcaccatcagcattttggtcaaagccattcaatgcatctctaggaagttccaaactttcccacattttcctatcttcttctgagccctccgaactgttccaacctctgccagttacccagttccacagttgctttcacatcattctggggtatctttatagcagagcccactacccagtaccaatttactgttttagtccattttcatactgctatgaagaaatactccagactgtgtaatttataaagaaaaagaggtttaatgcactcatagttacatatggctggaaaggcctcacaatcatggtaggaggcaaaggaggagcaaaggtacatcttacatggtggaaggcaagagagcatgtgcaggggaattgccctttataaaaccatcaaatctcatgagacttattcactatcatgagagcagcacaggaaaatcccacccccaccattcaaatacctcccacaggttcctgattatggggagctacaaatcaagatgagctatggggacacagccaaaccatatcaagcatctactgaggcaagaagacaggtagaatctgaaggtctatagccccattttctaggatattcattgaaagccaaagtaaactgctactgaggccaggaagttcactaaaatgtaagggcctagtgatatgtccagactaggaaagaaaattttaattttcaagaaagtcaaagccattagttgtagccctagaactagtgacagtagagtacacccaatcctaagttggaaactggtacggtgtgaccgtgtccccacccaaatatcattttgaattgtagtttccataatacccatgtgtcatggaagacacccagcaggaagtgattgggtcatgggggcggtttcccccatgctgttctcatgacaatgagtgagttctcatgagatctgatggttttataaacatctggcatttcccctgcttgcacttttctctcctgccaccaagtgaagaaggacatgtttgcttcctcttctatcataattgtcagtttcctgaggcctccccagcaatgtggaactgtgtcaattaaagttgttttcttttcttttcttttttttttttttggaaatggagtctcaccctgtctcccaggctggactgcaatggtgccgtctcagctcactgcaacctccgcctcctgggttcaagcgattctcctgcctcagcctcccaagtagctgggactacaggtgtgcaccaccatgcccagctaatttttgtatttttagtagagatggggtttcaccatgttggccagcttgtcttgtgatccgcccacctccacctcccaaaatgctgggattataggcgtaagccaccatacccggccaaaccttttttctttataaatgatccagtctccagtatttcttcagagtagcatgagaatggactaatacagagagaattctcttttttcctctgtgtgttttgctgcctcctttttttctcagcctgcgtgttttggtgtctctggtagatcctgaagatgtagtcatatgtacatgataattttttaacttcttatctaagatctccaaaaagggctcaaatgaagtttccatttggaagttctaaaagtgggcctttagtccctactcggtgatttaaagtttcgtttgagtatattctgatacacatcttgctttgcagagtatatgtagaaatcacttgtatttgtcctaaacattctgaaattgatcccaagattgagaacagatgaatagaatggatcaaccaagtgttctgggcccattctgctggatagtaactaagtgattaatgccaatgggccttgggcagagctagtgccaatcccagcactgtgaccttgagcaagttacttaaatgcactgaggctcagtttctttataaaaccaggtcaataacacctaaccctatgagttaatttatgtgaattgcctgtcccagtggcctattgtctggactcaataattggtatatggtattataatgatggtgatgacagcaacagtgcagatatggcttaccttgcaggacattttgtgatgcaaagggaaacccttgtcaacataatgcgtgtatgaataaccccttattttcctaacctaccatctcctttccctcaaccacagtgttggggcatgtttgccaagctctctttgtgtgctatcacaagggttaggttgattctggaggtctgagtgggccagtgggggcagttgcatgaagtagtaagatgagggatagctagagaagagagaccaccagtgctccaggctcttgatgatctacatgtggttcatgggccagcggcatcagaggcacctaggagcttgaacctaaattataatctacatttttgtaaaggtaattcatgctcacaataaagtttgagaagctctgtcccagggagtaccctagaaaatcaaaagctgtttcctgggtgagtaataggggacagaagcctgatacatgcaggaattacagggagatgaccaaggtaggaattccatcagggtccagttgttttgaaggcacaggttgcaggcagaaaaaaagcactatacagcccaaatattaatagatatgaaacataagcaaacaattgatttttttaacttttcacatatattctgttcaactctgtatggcaaatatgatgtttagtatcaaatggtagccattcacattttcttagtatgctgaatttattcccaagttaaaattccatttaaagaaacgagaatcccttcctaacacatgttacagactttaaagaactagactctgtgacccagttcatcaaaatgcacttgaaaaattctgtctggagctctcagaccaatgctacacattaaagattttattttcttcctcctgtcttttccaaggcttgactcctaaccacttgagatggagctaaagctgacagagaaagtgaaaatcctctgccttcttgcctggaggaaatgcttggcaggagatttccaagctgtgctgtcatcaaagctaaacttaaccttgttcaggaaaagaaccctcaactttcaaaccaactccttgtcagaccattcaatttgcaaagtacaatgttggggggatagaaaaggaaggaaaaatagcaatgaatgcactgatgtttgagattgagacttgaaatgatgactactcatgttttgcaatgacattaaagttaaatgtcttggttcacgggcacttaccactcccttcatcaccattaatctttgctcacagttttgaaatacaccactttgtgtcttcagcaatgaaacgaaattttcccagggttgtaattgctttccggtatgtcttttctcatgttatttgattgctaaaggttttcttcaaaatgggagatatttagtgaacacaatacaatgtattttcctgctatttttaatctgttcatgcataatttgaagggtttggtgagggaaaaatggaaattgaactcatctgaccgtgacagatttgcaaactctaaatacaacttaaactttatcgatgcttttaaattacagcactgaatacctggacatgtccatataacatttatagcattttatgtcttcatagctacagccaacatttgcttaagaatcacaattgtaattcaggatgagcaagaagagcattttacaaggaaaagtagagcatgctgaagtattttgcctggaacaagcttttatttttagcctgtccccaaaaaatcattatctagaggcctgaaatgtctcaaaaaatcattatatttgaatacctggtaggtcatttcatagagtcctgaagaatcctatttaatatcacgtgggtttgttatctggaccacagagcaattgaaggaatgattgtctattgggacctactcttttcctctgacttctgacatgcaaactttctccagtgtacagttttaacaaatggcacaccacactttggtccagcatgttatatccaggattcttattgagttattatgaaaggtggtatttccaaaattcatataaggaactctcaataatttatacttacctccatgtaatacattcaggtcttctttccaatgccttagcttggatacattttgtgagagtaatagcatgtgaaagaatgtcaaaaaccagaggcctgggcttgagatttagccctgagctctgcccatgcccttcccttccagtgagaaaatatctttctagaagagaataaatatagaaagcagagacatccatcatggatcaaagagactagatggtgactggggacaaaccatgccagtttattgtccattcctgacaaataaatagctctcatccccaaaatacaaaaatccagaccaagaggcctagtgataaaatcgggagggagtggtagctactgaaaactaaaaacattctcgtgttacaacaataggatttcaatttattcatgttctaaatatcatttccttactcaaaaatctttacagaggttcacaggatagttataattgcaaagctgtagctatcattaattaagcattttctttgtaccaaccacttttgtctttgttggtggttcatgacaaccctcatttgtcatgacctccccgtgggaaacaggcatcatcatcttcattttccatggaggaatactatatcacagagaaagaaatggatggccccaatttaccaaatcagtcagcagaacaactggatgcacaaggtactgagacccaccgctgtgatgtttccattctatctcacacattcacttctgccatagcttgctcactcatcagacttcaaggccctacacaaccaggctctcctccaaattactagatatatccccaacttgttcggagttttgacttctttacttgcaaaatgagagggtgttggaggctggaacaagtaagtcagagagaagatgcgttgcctacccagttaatactcttatgaccttcatacctgtgcctcctcatctgtcaaatggtcaccatcttggctgtccttcctggctgagatgatttttgcaaagctcaaataaagaaagcatttagaaatcacactcataggacaaatggtaatgacaaatctcatcgatattctctttaagtgctcacaatcttgaacgcacttccctgtgtgacttggaaacataagtcactttactgttgcccacacattttccattttagagacctgtccagtttctattccgatttcttagtcttcatttaagactgtcctccccttatctaaacctctacctaaccaacaagcaattgagcaattctctgtggtcatcactgtgaaatgcagtgaaagtaggaaagtgagtaagatggggcctcaaagagctcaaggacctgtgtgctacaacatcttcaaaataaacacctgtcaccgagctggtcctcctagtggaggtggagtattatacacaaaagaccccataaaggagaaaaggaatttcttgcctggagagatcaaggaaggctatggagtatttacatcccgtgcagtaagtgcattgttgatgagtgagcaagtggaaggtgatgtgcgggcattcaagacagagtcaaatataaacacagccaataaattggcaaatccaagcacagattgagaaataagcggtgccagaagattaaataatccagagtttgatcatgaagggatatatagaagcaaggaactaaaattttattctgaaggcatgggagactagtgaactcaggtcagtcatctttcttatttcctgaatatggaattcattgctcacctgtctttgggtaattaaaaaccatcaccttatgacatattatgacttgccatctgaatataaatatatggtttttagtcttgtgacactttttattatatttatctaaaagaaagacgagaagctttaaatatgatttggaagtcatctaaatgtgggaccatttatcacctcttttctgcatgatataaagatatgttaattttagaaattgatttgtgagcttcccagttcttcaggataacaaaatagattgtcaatagacctagaaatattgaactaattatttattcttaccttcctttttgtgcaccaggtcatgatgattccaatatggtatgtctaaagttacataactctgtccattccaattgtcattgttttagttcaggctaccattattatatatatattcttttactattctaaatcccctgattgggtcttgttagcacagtctcttaccctcaattctctatccccatctccacccaagacatttttccatatagaaattgaagcaaactttctaaaatactaattgctgtgactctcttgcccaaaacagtatttccttgtttttatttcattttgtttttaaactattttgattcctactgcctgtataagtgcagaatttccttctttttaagtttataatcttcaaaacatgagcttgggaggccctattttaacatattcgcattttaaaaataaattatatatatgaacttgaatgaaattcaaacattttctccagccagctgtcccaacctgcctcatcccttgaaaagttatatgaggtccatgctttctgttccctttaagagtcaccaggttatgtatcagatagcatgatacatgatgcctgggacactgtacttaaaaaatatttgttgaatataagaaaaatgtgataaaacctaaaaagtatactatgtttggtcttggagcataagtaatgcataaacaacacagctcttggtacagaattatcctacatattctgaacagatgataaagaaagtgctaaaaaccgtgtggatggaaatatgtagtagatagtcctgggaatatcatttttcaaggacagtagttggaactggagatgatccacttagaaagcagtagcagatgaaggtaacttaaattcatctatttatctgcctatcatcgatttagatattttacatgaattgtcactttttgttctcacaacaagcctgtgtatagttatcatccccattacatgtagagaaaactgagattaattaacttcccaaaggacacataattagtaagttgcagagtcaggatctgaattcagactggtctggtctctttgcaaatatactacagtctccaacacacacacaaacacacacacacacacacacataagcaaccacattatgatcttgtaggaccactccttctgtctctgggctgccattattttctcatctacatacaccagtaaaggtcaatgtttgttcaaattatcagtacacgtttaacccatccacttctaaatgtttggcattgaccccattggttgtgctattagccagctggccagtactcaactcaagcctatctttctaatcaggcattttcctaagttccagtgagcagaatgagaatacagagatgttcgttttattttagaatcattatgcctagacccatgcaagatgaaaaaggtttatgaatgtgtatggattgattgagctacactttaagatcatggtttcctgagaaacgaggattttcagtgtaatttagaaacactcaatgcaggatcatgattagctgttggaagtttagccccattgtattcaaaaaagagtagatatctagtgagaaagacaacgttctagaagagaaactctcaattctgataactactcaatgaacagaaatactgtctttacaaattctttagttgcctcctttccctcattttaatattcaatgcataatcatctggacaatgacctttttaaaatataaagacatcatctctacttttaattttaaaaaagttctaccttccatattttttctttctcccaatcttatcattcagtaccatccaattcattcatttatgtagcttttcttcagaaccaataaattctgagcataatttggcactactttgtaatgatgtgtgtgtgtgtgctgtgagaagtgttaatagatggggaggagggaaaaggggtttatagaagcagagtgaaatttgtggaaacttttcaagtaggaaacattatattttttcaaagatttgtgttttttcttatgagtctcctataaaacccaccaaactattccagccaccactcttagcttctcctattccagaaacttctaatttttttggtttatgaattttacctgttacactcaataatataaaaggttgaatagctttctaattaagctatgacacattattcataaccttaaaagtttaatagctttaccgtatttgattttaaacactgtcagagtgatgcctttggaggcacagtcctcgacttctgataaagccgatcctaacaacaggtcacttactcctgaacttggtcttacgttttgattctttgaccaactttcagtaccaccaatgatttccttaacttaggcttggctgggacctaccatgtgtagataaatctttttttttttttttttttttttttttgagatggagtcttgctctgtcacccaggctagcgtgcaatggcgctatctctgctcactgaaagctccgcctgccggattcatgccattctcctgcctcagcctcccgagtagctgggactacaggcgcctggcaccacgcccggctaattttttgtatttttagtagagaccgggtttcaccgtgttagccaggatggtctcgatctcccaacctcgtgatccgcctgccttggcctcccaaagtgctgggattacaggcgggagccaccgggcctggcctatgtgtagataattctgctctttcatcctcatgatgccacccctggaagccaagctcaaggctggcataccttgtaagtatttttgaaggcaacatattaaaaatggggtttttaaaaagatggcttaatgggactagagctgggtactacttggctctctcagtgagaaaactaatggaaaagaccattgcaaaaatcataacataatatttggatagtcagaactagaatcaaatcgtgagaaagagaaaataaataagtggaaaactgagagatcatcccaagagaaaacaacaattcaacaggatagaacttgtgtctttcatcctttcactcaacaaagaagtattgactaatttatgtagtctgaaatactaaataccagggcaaaaaaagaaatctgtccagcctgaccctttatatttgcacatcattagctcattatatttgtcacatatgaggggctcagttgtaaacaacatagctcttggtacagaattaccaacatttgttgcattagattaagtcactggtaaattagatttagagcatgaaagtgaaaagaataaagcaaaacagtctgttgtaaaaaaatatttctaacctgagaatcaaaacataacaaaaaaaaatcagtggcaacatcaaaaataacaaaaacactgctttcctctcaggtgtaatctgagaagaaatcaatttagggaagggtatttcagagctgttgagtttgggctcattgtggggcatccgtgtacagatgctcttgaaattcaagaaggaaagagctatattcctacaaaattgtcaaatagagagaggtctgccgtcatattagagtttagaagcaggtttcaactcaggttttgtgcagagtcactttgaccttggttcaaagcccagtttagatattgcagagactctgaaatggacaaaaaatgtatagagtcctcatccatggaataaggtgatggtctccccgttgcagctgttgcagtgactgtgagcaactcagaaagctgcaccaggaggctcccaaggagtcaggcctgctgctgctaccttgttatgcttatggggtttaggatgatgtcctcccaccaagccacttacaagcaggaaattagtaactccaaataaaatatgtcctaaaatcgtacatagaattgctttaaaagcctggaaggaatcccagagccctcttgttagccctggacagcactaaccccctcttctgggtgttcccgcagtctgctctggccccatcaccagtcactattgcagtgcagggagtggtgctgtgtttatctccaccacgtttgatgaatttgcgataattacttttactctctgcaaagcctgacagaaattttgacacctagtatgtgctcaattaaattgtgttgatgaaacaaatgaacaataacccgtgccgttataaagttgaggaatctgaaatacagggaagtgaaaaagagagcacattactagtgcaggcagaaggctcaggactcctggatcccagaccaatggtcttttgcatgtaattgctcatgaacataaggagcttatttcaaaaaatgtatggattatctttcagtccaaagtaaatgattgctttcttgagctcagggtctatgtatttgactttattctgtcttctcacagcaagaagcacaaccatgagtatttagcagctgatcaaaaagcaagttctgcatcaatctggaaatgagtgtcaggatagagaagactcggccttcctttcacgactgattttagaaagctgtatttttggtctactaattatgaagtaatgtatcttttagggtttcatcgtgaagaatgggggcagggtcagattcaagagtaatattatagtatttatttttgttattttctaagtgaaattataggtaacaaggggaaaaataattgaagcaaaaggcatgagttgtcatgtctaagcaccgttgtaggcactccacaaaatgtatgttttatatcttttagacaaagtaggctattaagtgtgcaatgctaagaggaattttatctcacctctaaatacaagtgaatcttttaagctccaaatccccacatacagacaatttaccgtggtaatcaagacgatgcacacaattgaacttcagtaccatctgtaactctattggtattttaataataatgaataaaaatatatgttggcaacaaaaaatgttactcgaagtagaatcattttaaagagtcaatgataatttctcaatagctgtgtagatatcatatttacttggaattctctgttgtgcctttaccttgtaattaatatgaaagaagaccttcagtatttaactgtatacatatactgaagaacatattatcccctcttctttgaattggaaatatgaaacaaaatgcttgtccatgcaaatattaataaggaaatgaatgtttcttttatttttctcttcttaccttttttcttttgccttttttctgtttgtttgacttctgccccctgggtgggtagggtttatctaggggagagtattgaagatgaatagaagaaaggcaaaaaaaaaaaaaaaaaaaaagaagagaaattcaaattatcctgaaagttataaactactcttcatcaatgtttttctgttgtccaggaaataaaataatgtctttcacttcgcagaaaaaagatcatccattataacagttgttataaataatactactactaatggttacctgccttctgcaaaggtgccagaaaactggactagggccacctacaaacagtaaggaaacctgaattttgcttccagctggtcaaataattaactgaataatcttgggcagtcctgtcatctccctaagctccccccaaacccttatatataaagtgaaaggcttggaacctgtaatttctgaagttcctcctggttcagaaatcctcttaaatctgtgaatgtaaagcaaagttacgcaaacaggactgggagtatttaaacagctactggatggaaagagctaaggtgcttttggttatacccacagaagtagatttttatctggggggatgatgggagctagtgatggcctttacattataaagaaaaggagtacagatgacagcaaagttatttgttgaagaaaaatggggaatcaaaaatatatatgaaaaaggatttgcattttaaaaatagacttttattgcatcagagtttttttttaagtttaaaaaattcttttttttaaaattattattatactttaagtttcagggtacatgtgcacaacgtgcgggtttgttacatatgtatacatgtgccatgttggtgtgctgcacccattaactcgtcatttagcattaggtatatctcctaatgctattcctcccacctcctcccaccccacaacagtccccggtgtgtgatattccccttcctttgtccatgtgttctcattgttcaattcccacctatgagtgagaacatgcggtgtttggttttttgtccttgcgataatttgctgagaatgatagtttccagcttcatccatgtccctacaaaggacatgaactcatcattttttatggctgcatagtattccatggtgtatatgtgccacattttcttaatccagtctatcattgatggacatttgagttggttccaagtctttgttattgtgaatagtgcctcaataaacatacgtgtgcatgtgtctttatagcagcatgatttataatcctttgggtatatacccagtaatgggatggctgggtcaaatggtatttctagttctagatccctgaggaatcgccacaccaacttccacaatggttaaactagtttacggtcccaccaacagtgtaaaagtgttcctatcagagttttgctataactcttttggagaaaagacccatgaaaaagcttttaaagatctcattttgaaaatactaggccaatgcatctgtgaaatttggttcattcttggaaagtgattcctgggaaatcaatatagtctatcccaagttgtgtgtcccattggaagtgagtatgagagaagccttttagtctctcattatattttttttcttaaaattcaaatacctatcttcagaccccagtttcttcaccccttcttcttttctacattaaacactaatgaatattcacatacacttttggaggaacagagtgatggattcagcattgttcagacacactgttagaagtctgagatgcatgtggagcctgaaattgaaggagagcacaggtttgcttattgaaggctgcaggagcactgagggagataacatgttctttccttgctccccagccatgtgcttggggtagtactgacccagtctccacaatgctgcagacctgcagaggagagaatgaaggcgcaatgtcatctttatgcaggctcgtgtcttcacccattttattacccctccacttcaccttatcctgttcatctggccagttgtaaacctttaatgtgaatgagctatttatgataccaatttgtgggcaagttttgtggaagagaaaaaagatcccagaaataaaatcattaaaatatttgctctcaaatgtagcagatattactgggcaattcatatactgcttcctattctcattacgggctttatacttaaaaggggacattttcccatctattcttattccatctttaaaatgactctatggctggatatgatgaaaatgactattttgcagacagtgaaaataaaacttagtatacctgaatgtattagctggaatcatccaatcaagagaagaaacaaatctaggaaaaaggaatctccaagctctaaccctcaatatgctttccactaatgcagcctatcacaaatcacaaaacaaaacaaacaagtttattgttctcatttatgctagatcattcttcctttgctttaagaatctgatacatattttaaaaaatatagacatttgaatttagaatggttctatcatcaaacccttaacctgtttatgcttgaggttgcaattttttgaatttttgcaatcagaccttggcgacaaccttgagcagtaggatatagataactcccacatgcttagcgttccaataatggaacattaggcaaaaataggcttccattcccgtttactaggctaatttcataagagacttgctctctcttcaacgtaagcgaggttgccaaagtggttcatgtgagacagaagtgacagaggaaaagatttatctgcttttgggggcagggagtgatttcttccttttagatttgagatttttccattcttattacttttagggacaggagatcaaaagttcagatatgtttcccaaaaagccactgttcaaatgcatagggtctatgaggaaagggctgctgaaaaatcttccttggatctttccattagcataaatctatggattgactaatttccaaagtggaacaactgtccctggaaactgagatacaaggcagacatctttcagaggagaaaacggacagtagggaatggcagttattgccacaagttaatgggctctggaagcttagttctcctggaggtcagcacctcatgatggaggggattgcacaggtctggaagaacaaaacttatcacttgcctgagagtctggactgatagataccaattttactggttcgctgtaatcatagtgaaagtctcctaaatttcctcatcagtttatttatttgtttacatctctatatttctcaatggcctcggagctccttgaggtctagactttattttacccaaagctatcctgattgcctctctgagaatatgcacaaaatgagactttataaatattggttggactgaattaatttgaaatgattaggttacttctactattccatgatcattttaacaatttatatatgaatgcgaagattaccaaaaaagaaaaagaagagaaaaataaattccagagttgtttcttgagcaatgtatggttgagttgacttgaaacatatacaggggtacagtcaattctgctacaacacaatatatgcatttgtaaaaatggcttgctaattgtacaataaaaattttataagaaaagatttaggggagaagtagggttaggagtacaatactcaaaaatttcatcagtcacacataagactataaaaacctaataaaatagtagcagagttgtatacatgctcagtgtctaataaatacataactactatatacaatagctataatactttatgttaaaaagagctacaactttccagtggaagtgggtgtcagaaaagctgtgatttcttgttaagtagtggagagagtgttacctgaaataggaggatggttatatctacacatctggatggatgaggcttagaaggcttctgtgaatgtagataccgtattgatgcttaagacctatatatgtgtttgtgtgtgtgtggtttgtatttttctatggggctcactttttttccacattcatctgatgcttcttgatgacaaaacaggcatacgtacatgcaagatctgcattacgttgaatataatttaataagtgattattatatgtttttttctaatatataaataatgcaacaaatatgtgactttaaacaagtgctttgaggtatgtatgcaccttctgtcacctgtatcttctgccagaggtaaaatggtagtgatctgctttctgttcaccaaatgaccataactgccgagaaaccatatctgcgatttttatgttattcttcttcagtgaggatctggctcggttttgtatttgtcaaatacctcaaaatatttttcaacatttgtatttgggaaaaactcaaaatacactttgccagttgattttttaatacacttaatgaacaataatttaatccttgtgtttctaattaattttcctgcagttagttaaaatactgctaagaatttgctgaataaataagcttaatactatgtaaatgttctttaaaaaaaaaaataaatcaaaccaattcttcctgagagcctttactaccatgaagtttaccttcaaactaaacggcacattttaaatttgttttgagtgaggtatgtctagatttcatgaagtcattgttcaatgtcctatgaaattaaatgtgtacaagacaaaaaataggaaaagaatattggtaatagtatactgactaattggctggtagattgactgatcgatcctgcctcccattctttcctttcttatttcattagctcacgatcccattctttcaacaaacctttatcaaaggcttgttatgtaccagattctctgctagggtcccacaaaatgtgtgtcacccaatggaaaatacaaacagataagtgaattattacaaaaaatttagatgaccaattgtcttagaccattttgtattgctataacagaatgcctgagactgagcaatttataaggaacagaaatttattggtttacagttctaaaggctgggaagttgaatatcaaggttctggtatctggtgagagctctcttgttgcatcatcatatggcagaagacgagaatgagagagagaacccactcctgaaagcttttttattaaagctgtaaacctaagccagtgagggtggagccctcacagcctaatcatctctgaaaggccccaacacttaatattgttacaatgacattagatctcatcatgagtttgggaaatgacaaaaattccaaccatggcaacaatatactaagagtgaagagcagttcctttccatgagattggatggtcaggatatcagtgtcaacccggaggggtatatctaccttctcaagacaagcatctttgctcatggccccaccctgtcccacatttgggcctcatcaaagaatccttagaaagaatactttccacatttaggataggttggaaggatagctgttgaagtaaataccagattcagaatatacaagatctaggactattcactactgcttcacggaatagaaataagttctcagaataagtaaattgttttctgaagactttcacacaactgggaataagatattttaagttatcctactcctctagacacaattattacgggagctcttaggaactgaagatgggagagtagtcaaacaatgtttcccccttttaatcatctcgcttcttatagaataatcttgatggcaataatttgagggtttgctcaagtggcttattgaagaaatgtagctagttgggtttttgagtcagacaaatctaggtgacaattctggctgcgctattttctagcattgagaccttggacaatctgcttgacatttttgaacttaattttcctcatctgtgaaagaaagctggacctgtccttcaggggtgctgtgaggagtagatgcagtaacacatggaaaccgggagtacctgaccttgttcagagcaggtggttaataaatgatggtagttaatttctcaacttctcttcttatggaatgtttcttgctaatagaatctggtctctctccctctgtcctcctatcattatagacaactgtgatgatccactagcatccctgctctctccaatggctttttccagttcctcagacctcactggcactcacagcccagctcaactcaactggagagttggtaagtaggctgactgaaatcctaatgccaagcactaaataattacgtggtgggtaggtgaaggagagtgagcactctcagacactgaaatcatgtccaatggccgtcttcaggaaaatatttacgaggagaggagtgaaaatctaatgtaagcatacttccatagcataatagtcattcaaagtatgctgacttgtgttcacccaaatcacagtatccttttttgattatcacgagaggtctttgtgaaaattactttataaaaagcacttgctttatttttatatttccatagctaacataaatagatataaaacatgttttataataaaatatttataatgaatgtttattaaattttctttcaataagtttaattttacttgaaaattaatattgctgatttttaaaatacaaaaatactattaattgaaagtaagaaaatataaataatctgttattctaccagctagaaataactgtagttaagtatatggtgtttatctttaacatctgtgtgaagtaagagcacctccttaactaatctctcatatgaaatgttgttaacaaatatgatgttggatatctaggcagatacgttttagtcagatttggatgttgacttttctaatgcatagatacataggtagataaatactgcaaaagagatttgaattatttcaatttttaaggacttttaggtatctgatagtatcttaatatctactaaatattataaacttttcctaggtcaagaaaagcgtgtatgcaatttaaagagagctacgggtctattagagtttatattatttaattttgagtatattttccattgatatcttaagtaggttacattagcaggtttttgcaatattgaaccatctttgcattctggaataagttctaattggtcgttgtgttttttttttttttacacgctaactaatttaatttgttaacacttgaatttataattttaatctccattattagtgagattgatttatagtttttgcttgtatgtttgtttcctgtttgtcttgtacttcatttcaccagttttctattaaaatgggattcataatttaaaagttagcaagtgtcactggtttgttgagaaagctgtttaagaataatattctaaaaacaaaagaatggccaaagattcaacaggaaaatttcaattaaaattttgtactaatgtcctttgctgaatattctgtgccaaaaatttgattaagcattttagttttattatgatatttagtcctcacaaagttgttgcaaacattattaccttttaccttcaggtagggttcctgaggcatcagtttcccaagacagaaaaactagtctggggaaatgcttgcattcaaacctaggttatctgaattcaaagttcgtgtttatattcatcccgttaacaaatcgcttcactagtacagattgaaaaggggtgtagcagcaagaaaataaaaactaatcaatcaaccacagttcaaatgcgagctatgccacttaaaaactctctgactgtgcacaagtcacttacctctgccaacctcagttttttatctgtaaagtggcccaggaatgtctgccttgcaacattatgtgcagattaagatcagacttgcatatccaaaatatctttcttacagcagggtagagaactgaactggagcaggaagcccactttccatttcaggaagaaacacaggttggcagaatttaacacggtttccaacagagcttccagagaaaggagttgtctcgatcccacccaaattgtgcagcagcagaaagcaattactactgcctaatagctcctgagcagtttctgggggaagctgtgggtctgatcacaggccggctctctccctgacagacagatattgagtgaggacaagtgtctttgctccaacttattataatttttcggctcaccggggaatttgagtgcctgaatccaaggctagcataaatgtacagagaggttcacttttcttccgtttcccaacaagagtctaaatcagaaaggccaagcagaagacatagtgatacagttgggatgcactgacctagaactcatcctctagtgcatattccaagactcccaagggggacagcctctcctttactcaccgaggcccaaccacggccctcagtgggaattaaacactggctcagggagatacggtatcagtggttctcatcccagggctgtgcatttgaatcacctggagagctttgcaaggagcattgcctgagcccatttttcctatgttctgaattaattgtcttggatgggacccaagcaaggatattgataaagtgaagaaacaaaagcttccaggtcattctaaaatggaacaagagttgcaaattgctacattggaggaattcatgagtaaaaaatccttctattaataattattgagtcccagtatttgtcaggcattgttctagatccttgacacacagttggcacaaataggcacaaacagtattcataaagagctgacatggataataccattaccatacaattacaaactgtgatactgatcaacagctaacatttgtcattagtaataatatcaacataattattttgttaagtatgtccagatatgtatttctactataataaaccatgtatatgtgatatatatgtgtatataatatatagagtaaaatgtatatatatatacacacacatatgtagttgaatatatacagtcagagtctgtcatatacaaagaggtggatatatacaggtttggttatataaatatattcatacatagtaggatgaatatatatgtttatatagttggacatagtaacatatacatgcatatacagtcatgtacaaatatatacatatgtggtatacagatatattaagataaaacttgaaagtcattatattaatgctattaagaacagattttgtttcatgagtggaaaaatataacatttagaaagttaagaagaaaacttataatttttgtttatattggaagtatcagtataaaatactgatttatttgcttccttttaagaccaaacttatgtcctgtctatgcactgacatggcttagaagcaattataacactgtctcaatgaacactcctttttaatgtgtcttcctttaaaacttatcttttgttttacaaagaaaaaacatgcaatatatccaaaagagcaaattgtaccacatggtttgaaatctcagatgctctcgaatatacatgcagatgtaaaggagcatctctccggatggtgagattgtgtgcctaagaattacaccctccctcttcccctggttgtaagctgatgcctggcagcgcacaactaaaaattataacaccactatattgagaacttcccatgagccctcaatgttctgagcccttaaggtacaccaattctatactcacaactaccctttatgtagatgtcattgtgatctctgattcataggtgacacagagaggaaagcaatggccatgcccggctttcacccaagtgatctgaatctgtgtagtgctattggccaaagcaccacaacactatcctgcccagagagccagaataacttcagtgttttagacagggaaagctgtgtgtcatttttattagttcacttacttccctccctcttatgtgattgaagtataattgacaaataaaactgtatacatttacagtgtatgaaatgatgatttgataggtatgcattttgaaataattaccacaatcaaattagctaacacatccatcacctcatgtagttatccttttctttgttttgtagtgagaacacaagacctactctcagcaaaagtcaagcatacaatagagtattattaactatagtcaccatgctgtacaattatattcagagaatgtattcatattagaagtgcaagtttgtaccttgatcaacatctctccattttcttcacaccccagtccctcgcaaccactgttccactctctgcttctctgagttcaacatttttcagattcctcatataagtgagataatgcagtatttgtctttctgtgcctggatatttcacttagtacaatgcccactaggctcatctatgatgttgcaagtggcaggttttcttttttatggatgaataatattccattgtataaatgccacaattttttatccctttattgatcaagaaacacttaggtcgcttccgtatcttggctgctatgactaatgctgcaatgaacattggattgcagatatctctttcagatactgatttcatttccttcagatatatacaaagtagttgtattactggattttatggtagtttcttttttttttttagaaacctccataccgtttcttataactatgctaatttacattcccaacaacagtgtaaaagagttctgttttctccacctcctcaccaacacctatctccttctttataaagagccatcctaacgggtgtgaggtgacgtctcattgtggttttgatttctattttcctgatgattagcagtgttgagcatctttctgtgtgcctgttggccatttgtatgccttgtttggaaaaacgtcaatttagtcttttgctcatttttaaattgggttatttgtttttttgctactgagttgtacttgttctttaaatgtttgggtattaaccccttatgagatattcggcttgcaaatattttctccaatttgatagtttgccttttaatttttttaattctttttcttttttgtacagaaggtttttagtttgatatagtcccacttgctcatttttgtctttgttgtctgtgctttagatatcttagcccatttcagtttcttatacaagaatagctaaaactgggtaatttacaaagaaaagaaatttatttcttacagtgatagaagttgagaagtccaaggtcaaggggggcagatttggtcagggtcctcttgcttatggggactctgcagagtctcgagacagcccagggcatcacatagcaaggtgcctgagtgctctaacatggtagctcaggtccctctccttcatcttataaagccaccagtcccattcccatgacaacccatcaatccattaaaccattaatccattaattagtaaatggattaatctattcatgaggtcagaatactcatgagctaatcaatcatctgttacgggctgcacctctcaatactgccacattggggattaagtttccacatgagtttcacaggacaaacgttcaagttatagcagtgtcatatccaaaaaagtatcatttactttggaaagcaatgagcaatcactctgagtgtgctgggcatttctccactctgccttgttcaatacactgagccatattttataatattctgcctcaacacttcaacttccagcatgttctcctccctaacagatttgctaataaatgcagtcacaatggtctgctttatatagcctcattctattctctcttccaagagggtatggtgaacctgcctccttcagatctactactcaacaccaaatccctgccccttctaaatgtccaaacaccagattttacacacacactccctctctccctcacatacacactcacaaacacaaacatgtgttcggaaaaagagtaggtactaagatacacatgcattattttaattcccagggaatagtttaaaataagtaagtaataaatacttgtcaaagtataattttcaataagttaaaaacatagctctcatgcaaatataaactcataggtcttatacaaatataaactcagcacatcgtgtgtatgtgtgtgtgtgtgtgtgtgtgtgtgtgtgtgtgtgtgtattaaacttattaaggcaggaaccagtaaaatggtaaagctaattcaaagagtattttttgggaactgtgtattcagagacatttggtgagggtggggggaggcggaagaaaataatattggaataaaattgctaggtagatacaaaattagttaatgtatgtattagtcaagattctccagagaaacagaaccaacgggatatatatatacacatacacatacacacacacgcacacacaaatacatatatacacgcacacacacacatatacacatatatatgaaatcatttattatgaaaatgggctcacatgattatggaggccaagaagtcccaggatatgctgtctgtaagctggagaagagggaggctggtggtgtaattcagtctgagtccaaagatctgagaactgggggaaccagtggtgtgaccctccatctgaggcccaaggtctgagaaattaacgaaccactggtatcagtcccagagcccaaggacccaagaacctggaattctgatgtccaggaagaaaagaagatgaatattccagccccaggagagagagagaaaattcagctttcctctgcctttttgttctatctggtccctcaatggattggatggtgcctgctcacattggtgagggtgaatatttctactgattcaaatgccaatattttccataaacaccctcacagatataaccaaaaataacactttaccagctgcctggatatcccttaacccagtcaacttgacacctaatagaaaccatcacaatgtcttacagggttataaaacttgggggttataccttctctattggacacacatttataagttagcatgtgacaacttcacagtatctaagctctgatcacccaggaactagccaaaccaaatgacatgtgcatttttctggaaaattaaataattgttaaatggatttgcttcaaattgttccaggaggatactgaaagatcatactatattttcttatgatttcaaagctttagatagtgttttcttaacacatttattcattggttcatttattacagtaattagtgaatttcttctactctacaccattcagccttccaacactcttgtcaaggaacatcctggtatcccactgggtatcccactcaagatgaaatttaaattgtaaaacccatgaccttcagagcatcaaatccccctcaaaaggatagaatgtcctcaataatatccttgtacctcatcactgctgaactatttcacactgatgagctcccctgcaagtttttgggcatcactgaaaattgctgagtcccttgatgattatataaaaccttggcaaacattgaacataaaggactagggaacactttacccctacgtgtgctcagaactcaggtagactcatgtctgccctatacccaggaagaaagtgtgcgtaactgatcagtttgccatagcagaaaagaccaactcaaacattgaaataaagactaaaggaaaaatgtgctgggcaaatgttaacctatgagctcccccaaccctaggtaaaccaagtttaatgagttccatcaataacaaactaatttttctgagagaaaacacacacttggaaacagctgttgggctgtaggtattgctgtgcccatcaaggtctgggcaatccggcacacgaggaggggattaatagttaaagctcaactataatagtctccatgctgctatctcatcgatagaagggatttgccaaatagaatttttgttctctcacttccacaaacacttcagccttcatctcatcacacacaaaaaaaatgaaaagcaaggaagagaactaattacttttggaaaaaagaaaaaacaaacacaacaaaatacattaaattggaggtcagatcaccattaacttaggttgccaactcaatctatataattgtggcttaggacggatcagtctttgtcaaatatgatttgttttgtggcaagaaagcttttgatctcggcattagagtcagctgggcttcagagaaagacttactgtccgcaggaagtgcaggggttggtggtatatagcatgaagccacggagttgtgggttaggccttcttgaaaatgaaggggaaggatttaagttactttagatgattaaaaggaaaatagaaatagacatctttggccccatgagaggagaggtttgtatttttctattgcatgttttttttttccaaatagagtttggaaaccattatgtttatcatttgttccttgaaattttaatccgtcttcctcactcaatgtattttttgagatgcttgcctgtgtaagttgagattgtgtgtttctagcatgacagttttgttgccatggagaatttgatttcttatgtcaaggcattttcagctccctgggctcatggatggataaaaagatttaaaatccttacctcccgctttggcacagattccatgcacacttaccaccccccataccacttccttgggcagtacttgttacaaattgctaaggaccctaaaggtgttctgaagttggttttcatcttgatgtcatcaggccatccatgaggagatgagggttggaagcaagcaaaaatcagggttcatttgcacaattagcatttcagctgtctagggactttttccagattacaagggaaaatcctgggaacccaatttcataaacaacactacaacgtctgctctctggaggcaacatgagtcttctctctggatttattaagccccatagaatatatatctaatctactctgttttattttttatttatttcttttgtgtgtgtgtgtgtgtgtgtatatatatatatataaattattattttttttttcttgagacagagtctcactctgtcacccaggctggggtgctgtggcatgatctcggctcactgcaacctctgcctcccaggttcaagcaattctcctgtctcagcctcctgagtagctgggactacaggtgcatgccactgtgcccagctaattttcatatttttagtagagacagggtttcaccatattggtcagactggtgttgaactcctgaccttaggtgatccacctgccctggcctcccaaagtgctgatattacaggcgtgagccactgcgcccagcctctaatgtgttttaaaagacagtaagctatacagaaatgggtcagtggattaccccctctccctgtgaaccacccttctctcttttcagcacctttcctttcttgtgtcctgtcctagctgtcccaggcatggtaagcatccaaatctatgctttcctctgtttcatcacactctcccttcccagtcgaattgtgtatggtgggtagaagctgggacatccaccaggagcttgttacaaatgcagaatcttggcttctacccagaactcctggatcagaacccgtgcattaacagctggtgcttctgcaaattgaaatttgagatgcagcattctagaggatcactgaaccttttgttatttcagttctcacctctatgacttatttactgtggatcttaggggtaggagagagtagaaagaatcaaagttggctaagttattaaaaagaaggaattgtgttgaaaacttttgttcttcatttctgtcatcacttcagtactctggtactcatttttctcattttttaagatggagaaacagagtcagagaggttaagtcagtggcccaaaactacacagctaattttggtagggcttgaatttgaatctaggtctgtctacttcacattaatcaatatctttattgatgttgatgtaagatcttagtctgaataaagatgctcttgacataattagctttcaggtaattttggtattcccttagggttctcagtattttaactaaaataatagattttcagacatcaaggaagaaagagaaacctatatatcttgccttttgaatgcccctaaaatcatactgtgtggcctaatatgcctgagggaaaaactaaccttgacctggatatttaaacaatgccttaggcctcttcttttactaggacagctatagatcattgaaagatacaggacagaaaccttctgctatttaacaggagccttgggaccctgtctcaaattgagacaaattcaatgtgatagccctctattcaggctggctaattgcaaaaccacatgatgaggaggaggagaaggaaagggattatagaaaatttgttactggctactaatcaaaagatttgaacatcaccatttggcacaaaaaaaaagttccaagaaagaagcgaatttcatgtacttcatcctttacttttttttttcctgattgtaagtcacttcctttgaaaggccaggttgcgatgacttctaagcagcactccatgaaatgcagtaaaccatcactttgatgtttctaacactttgcaaagagacaagagcttctttaattcattagttcattgaatttaacttaaagcattgcaacaaaactgtaagaatagaattaagagcatgattattagtgacatatttgtctagtgattggcagtttataacagcaatttacaatgtcagtttacaatgttttcaatgtgtgtcacatttaggaggaaataagctatgttcagctggaacattgtgtggtagatgtttttccttcgtctaactgggaatagttagaaggagtctactggatatgttgttggatactggagtcttcttctcgagaagcctttcatttaaacattgtggacatgtccttaaaaacatgagtttaggtttactgaattctccatgagaagtgaaaatggcaacatataacaaacgccaaagaaacagaaaatgggagttaatataatcctttagttcatctttctccagattttcaatttgaagactccttctttcatggtgaccccctcctcatttctccttttgagtatctcactccttgcttatttcagttatattcatctacgcaattggttgatcatgtctggactttaattttctagccaatgaaaatgtttcattaaaaatccagatttgatcaaagaacttttatcatttgttttgctaaggactggcttctaatgaatcttttctacaaaaaatatccatggcaatcagaaagcgttctggggtatctttattggtgtgcttctgtgtgtaaataacagaaaatccagctcacactggttgaaaaatattaaattattcagattaggcacataaagattgaaaggtgttcatatttctatttccagaacagggtggttacaagatcctttaccctataatactttattaagctgaacattcattttgtgagactttttgtatctgtgggtttttttttttttcattacaaaaggattaaaggtaaaaattaattattaaaaacaaaaggaaattctcaaaaagggcaggctccagggctgccagatttaattcaacaataccatcctcagtggcagcattgtcctggaactgataagcctgcccaacatctcagccagctttacaacattctgggaatcaatgagaccatgacctcctgtggcttgttttttaagctatcagagtgtgagccctggaatagcagcataatgaacatctcctaggaacttgataaaaatgtagattatctagactcacaccaacctactaaattagaaattctggcagtagaaacctatgttttcccaagttccttaagtgattctgatgctcacaaaactttgggaagcacttcttagagcactgaaactcttcaaggatccaagacccagaatcaccctttcctatttcaccagcttccacaatttggtcatctgcccagtcctgaaacaatcacagtcaaggaggatggaattaccatcgctgaatttacattcattatctgatagagaataatcaaccatgtctataaatcttcattctatccctttctctctccctttctctccttctctctctcctctccttctctctttcctctttctctcctttctctctctctctttcacagtaatacaattcaatacactcatatttaatcattttgtgtccatagttgtgatgcctgtgagtttatatatatatatatatattattttatccatggtatggtagacactaaccatactatttttatagaagtagggaaatcacttatccaaagtcacaaggtagaaagtgaccttttaaactcaaaaacaccagaattcgaccaggcactgtcttttaaaagaaaattgctccaagaatccaagttaaatgtaatatgctcaactgtgcataaagtatatactgctcatgagaaaaaaaatgtaagtggtaatgtcatcaatatgagatctgcagtttcaaatcacttccaattccagttctcccttttccctttgataatcttgggagagtaatttttttccatatgcctaaaaacaggaacagtgttttaccttgctgctgaatcttctatatatatataaaatcaggtatacataatccactagaatccactaacaatctcttagtcctgagcagcagatgggcagagttagagtgtattgatttgccaagttaaaattgaactgagcctctactcattttataagagaaattttacaacagcactggccgatagaaaattctgcaaggatggaaatatgtgtaagtgtgctatgcaaggtattcactagcaacacggctactaagtatttaaacgtggctactgtgactaagaaattcaatttttaatttattttaagtgaaatttaaatttaaatattcactaccatattgaacaattagttttaaagcctgtaagttttatatacatgacactcccatccaagttttttaaaatgcctgggtgtttttatgcacacatgaatcagcccttggtctgtaggggtcatgaatatggaatatccatcttgggtctgaactccaattcttcccagcccagactgccctcctgccaaaccccctcacttcttttataacttctgaactatgaaacaggcagacagacctcctttcctgctccatcagggccttgattgctccatttttccaaagggaagatatttattggaggacatcagcaaaactgtcttgagtactgagcgtctttcaaaataataacacagctttctcactatagacactgacagacacaccagtgtgaagccaggttcacacactgtctcagaggctgttcgtgctcatatgcctcagacttcaccatttcagccaaaagccagcatcttggaagctgagcagagacaggactttttgtggaagtaattattgaggcggtggtctctggagatagggcctgagggaagcagggtaagacagaggggaaagctagcaagagtatagtctccactgaagtcaaggttccttcagatgccacaaagatgttctagacctcagactacactgtaaagtctgtcatgccttgagacactgggaccagccttttgaactttgtatcaatctgacactcgctgagttgaggacatgggaagtgatagctcccaggcaagaaggcttctctttggccaaggacaaatctctggaaaaggggatagttctagttgtcatctagcactcacagctgaaggatgagttcacctgctagagaggatctggatagagacctgagaacatcctcaacaagaccactttcaaccctaagagctaagcttctcctctcggtgtttctctctgtgctttagatgccaccctgctcttcagaagctctcaattaatacctgaccaagttggtgtataaaaaccccagctccctcccactcaaatgagataaccctaaggtgcttcctatcccactgggatgaaactcactcacagggatgatgtcctgatgatgtcccatagatgggctttcctttctgctctgcctcatcttcctgggatcacttcccaaatgaactacttgcattcaaatccttgttttgtaactgacttccaggaaagccaaactaagtcatacacagaatcactctccctagacattactcttttggcagccatcaactataataaccgggtctgattattatccaaaatcaccactcccttaggtgaacctcctcttaaaagctcctttgttgttttctgcagactggtctcaatcagggtcattccagattttcttacaggtgtttatcatttttgcaacccacatggtgcatggtgtgttggcaagttcccacttatttatttatttatttatttatttatttatttatttatttagtgatgaagtcccactctgttgcccaggctggattgcagtgtcatgatcttggctcattgaaacctctgcttcccgggttcaagtgattctcctgcctcagcctcccgagtagctgggattacaggcacacatcaccatgccctgttaatttttgtattttgagtagagacggggtttcaccatgttggccacactggtcttgaattcctgacctcagatgatccgcccgccttggcctcccaaagtgctaggattacaggcgtgagccaagttcccactttattttcccctggttaactccttagtccctaattaatgtggaactggaagtgcaggaggcgtggcctggaccaggctgcaacaccttagccttcctgcacctgcccaggagcagaaagattacgcccagggttcttgccaacagctttcctcctcaaagattcttgcccagccacaggtcctattacacatgggtgatcccgttctacagggaggagcaggaagcccttctgagtgctacaagcatgtctgtgaatgttgttattactcttacacatactgcataatgttcgatatttatgggagagcctctttctgttattcattaccattaccaggtagctgtgtccctaaaacatctagaacttttacttacagaggcatcgaccatttaataattaaagatgtggctagtgattcaagttagcctcacagtaatttgtgagaatatgcttgtagtttcatagggccttctggaagacagcagaagtaactgcctgggaaacttgtttcctatagggtttattttaggctttaaaaaaaaaaatggtcaggctgtatttttaaaacagattaggtgtggccaggcatggtggctcatgcctataatcccagcattttgggaggacgaggcgggtggatcacctggaggtcaggagttcaagatcagcctggccaacatgatgaaaccccgtctctactaaaagtacaaaaaattagctgggtgtagtggcgggcatctgtaatcccagcttctcaggaggctgaggcaggagaatcccttgaacccaggaggcagaagttgcagtgagccgaaatcacgccattgcactccagcctgggtgacaggagcgagactctgtcaaaagaaaaaagaaagaaaacaaaaacacattaggcatgaaaatgctatgctgctatgtgtgtgtatgacgctttcaactccagttggtcttggactaaatgtactctctttttttgaaagacggttgtgaaatatcgttttgcagagactagtatataatccattttgtgcccatttccagtgtgtggcatcaatcacttctcatttccctttttgagttagaagtggaaataagtgtagaaactgaggaatttctgcattttctactggttattctgcttcatgcttacagcctaccctagtgtgtgcagtttggaatgcaggattagcaataagtgtcttggtatatagaagtgagcatggagtgactgggaggcaggagatctggttttgttttgttttgtttttcttacttaaaactgcagctgggcatggtggctcacacctgtaatcccagcactcagggaggctgagatggggggtggatcacctgagatcaggagttcgagagcagtctggccaacatggtgaaaccctgtttctactaaaaatacaaaaattagctggatgtggtggcacacgcctgtaatcccagctactcgggaggctaagttgggagaatcgcgtcaacccatgaggcagaggttgaagtgagccgagatcacaccattgcactccagcctgggcgacagagcaagactctgtctcaaaagaaaaaacaacaacagcaacaacaacaacaaaacacaattgcttagaattctccatacaagtctattcttgctttcttaagatgttggttcctattgaaacctcaggcagggacttgaaattagaactgggttggagtgcagtctttagccatacatctgggttagctgcctggcccattgaggctgctttgaaaaaatttaaaaagggctactgctgatttccatgagaatcaactgagatactggaaacaatgtcaaggtgaattatgtttctagtgagaattgctcttatgaggaagcaggaggacaaggacctgagggatttgttggtgcacttgagaggccgcttgtagcccagggaagacctgggtgctggatgcaggtttcctgggtctggagctcctgcattgctacttcctagtttatgatcttggaaatgctacccactatcctgtttgcatgatggagatcatttgagaatctctcatctagtgtgacatcaggaacagagctgggtcttgaaccagattgcctgacttttggtacagcatctctattccatctattcctccaaagtcaaataatatagtttgcagagtatgaggcttggagtatgctagaaataactaagacatagcctccaaatcattttggatcttttgtttgtcaaacatttaaacaattccagatgttctctaaggtgagattattttctctttaaatgcaagtgttccctttaagtgtaaacttctttaaatatcctttaaatttaaactgcagagtttataggaatttttgtagttaatagccattgatacatcagccaaaattacagacagcattgcctcagtcaacaccttcaacttgccaaatgcacttatttgtatgtatgttatacccccaatttagagaataattcagaaacaagaagctagtgtaggtgcagtgcgtttttatagtgactacaaatagtttcttcaggctactttcatcatttgtgaaagcacatttattgtttggtggaaagaatgaaatgtttgccatagcaaccatggcaaccctgggtgtcttccctattagctgtaatgcggggagcatcttcaacagcaggaaagagtcctcggcaattatcacccagatagcatccctccattttaaaagctttggctgaaactcttgggctcagaaaatttttaacatgatgtgttgatgaatggtaacaacagctattccattttggttaatttgggggagattaataagctaagtttttttactgtgggaaaaagggagctatgattttctttagacaaatttgcagaaactttaatgctaaatcattctctatttttttgttttggtttgtcttggtttggtttagctttgatcagtcttttgttattttattctttgcaagctaaatttcttgtcaatttatttccttgtttccattcttcatgtaagttcttatcatatgctaattagaatagatgaaggaaaaactttaaagcatgatgaggaagtctagttgtgaactattgagggtaaaagagaaacagttaaggcttaagaattttcattttaaaaataatgatggtcacagaaacagcaaaagtcctatattatagcatcagctcccaaattgctgtacatattctttacgcaataaatcacatatgagtaataaaattctcagcttataaaagaagaaaatgttgataagggaaactatgttatatgcaaaaatcagaagagtataaaatcactcatacattcaccacagacaaaatcgccatatacatttattttctatcatgttttaatattgctgagaggggaccatttcaacaacattttttttttttactgagaaagaatgcagcctcatgaactgggcagcagaagacattgaataaaataaagaatatgtttagaattattttggattttttgaaatataaaacctccctctctataagcctctctgtcaattttgagaagctagagaaaggcagaggggaatgggaattgtgaatatgttgaggaagacagagttgaatgacaaaaatgtactcctagatctggcatctcagaatctctgctcaaatacctacttccagtgattttcctccttactaattttctggagttttataaactgttttttttcctgttgaagaataattgcaaatagctggatttaccctatgttttaatcctgggtgccaaattttccaaacttgctggacttcagtttcctcaactttatgatggagataatgctatttacttaaaaggatattgtatatttattcaagtagacaaaattgcagtgtcaaatagagtccaatgcacaatgacttaaacacaataagtgtttagctctcattcatctactaggtgaacgtgttcaagtaggcaagtactttccttcatgtgatctttccatactgtgattctgccatcatctagatcttgttgtcagctgcatccatcagtggtggaaaaggaaagcaagtggagaaggagcacgctagcctggaagtggcacaaattattcccactcacattcttattggagagaacttgaccacatggccataaccatgaaagtatggaaagctgaaaactgccattaagccatgcactcactgcaattctactaccaaagaaggaagagagaatggatattagtgactatctgccataactgccactgtattcataaaaaacacttaaaaatcacattccacaatagatgctgagcacattcccttccccttctttcctgcatttgaatcttctcaggaatggtgagaaaaaaaaaaagaaaaaaatcaaaacttttctcaaacaaaatctgctaagggctagctgcttactgaagaaaatcaaccacaatttgcaagatgtgcctttaagtcctctatttttccatccttaaagacagaataggattggctttatgccctctatcactctgtctgcattgcagtcctgtactatgagagactctgcaggaggagctggggctctagaaaactctcagttaccaaggagatgtccaaatgacttcttccaaggtggcgagaaagtagactgaaacatcgctaaaatgattttcaatgacatagattgaaagaaaaaggttattgattaactcctctaaatgaaaacttcaattacctctccctacttgatgtcctgagttgcttctatgctatctctacccatggcataatacagtctgcgatagctcccacatgggcttcagaagatttgtgaaacttgggaacagtagaagtgaatattgtcttttttactcctatgtgaaataaaaacagaaaatttaggctacaagtctttcaactaagagagaactcacattgatcttctgcaaacctcaggtgtgatacatacaaaattctcgggccaaaacagtttttgtatgtgtgtcagaatgcccctacatgtcaggtatactgaatcacacgagatccaagaatgttagagactctgtcatgcctctgagattttgtgtatgttgttccctcttccctggctaatctccatcgaactttccaccttttttcctaggatatggctgcacttgcctcaggtttcacctctactattgctatctctagaaggcctctctgatcagctcctgaggcattctgtgctctgtgtacctgctgtttacctcttgtgatggtttctttcacatcacatgtttttgtcagcctctctctctctcttcagcacccagcatactcctggtgctcaacaaacatctgccgaataaatgaatgatactcttcaaaggcatagtcggtgtcctttcatctttgtatctgcagcacaatatcttgaccatgataggttcatagtaaatattcagagaccgaggagagagaaggtaatgaaagaacactaaaacaaggaagagaaggaagaaaagaaggaacgatatattagtcagagagagagagagagagcacatgtaagcctagttcatatatatctgcaatcaaaggctgaagttgtaagaagagaaataaataaaacaaatgtcactaggagtttgtaagatagaagtcataatgactaaggaaatagggatggaagcatggaagatacagcttctggcatgagtcttaaaccatgagagagattttgatggaggtggagaatggaaagtaccagggggttaagtacagaggcagggaagagtagggcccatttgggggtagagtcatcttagttgaacactgtttcatttccctttgatagttgaaaattgtagctatgtgagacattactacaactctctctcactctctctgatcctgttccaggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctgggtaggacatctttttccttccaatgaataaaactgagatgtgctaatggtaaccagagtatatttccgtcattttccaatatccagattgttggtagtttaataactggtgagtgcccattagaaataattagacaatttttaaggcccatgcccggcatggttctacttcctaggaaaattaggatgtctgtcgcaaatagtttagtatgttcccctttttgtagtaaactgggtaattcactgactgagcctcactttcttcatctataaaaattaattaaaaaacagataaatgtaccaaaaagtacgattattaatgtgattatactaatttactgagtgtttattgacttattagtttattatatgccaggcacttcacatattttgtaacaacacagctagctcaattacatcatttgatcaacattgcccaatgtatgaattgtgacttggtaatctttaaaatctggcctgactttaaagccacgaagcagcttctattgtagatttacaaataattgaaaactaaaactacaaaacaagtagaaaatttagaattattctgtcattggaaacaatcttcagcttcagagtgaaggacagtttgctccaagttacaaaacagaactttcctccccagtcccagccccacactcttgacctcactgtgtgggtgaaaggctgtcagcaaattattaatggaggaaaaggtggaggtgaagcagatagcaaaagtcacctggaggtagcttcagaacctcaggcactgaataaaataagttgtaagtttatattatttttcattgagaaaataagtcaccattttttaatccaaatgtgtgtaaaatgtgaagatacggaaattaatagcatattctttccttttcagattctgtcctcttaaatcaatgccaatttatactttacattagtgttgtcttcacattcacattcccatgttggccccatctccctgataaaaatgaaataacttctgttttatatactcattgttatttgttaattgcctacccatcacttggggttgtaattgaaaacagtcataaattgaggattaaaattagttatggcagactgaatcctgagaatagtattaatgtcatctttattctgggtcacttgtaatattaggttataatatttataaagggcgtaagttttcttcattttcaaaaatagtctaaacagtgagtatacatggaaacaaagaggggaaaatagacaccacagcctacttgaagggagaggttgggaggacggcgagagtccaaaatctacctattgggtactgtgttcaaaacctgggtgatgaaatcatttgtacactaagccccagggacaagcaatttacccatgtaacaaacctgcccatgtaccccttgaacctaaaataaaagttgaaaaagaaaaaaaattgtattttggggactattttattttttctcaattttgaggtccccataaattattacaggttttcattttgtttcacttttagtttgagataagaaataagcacaccttccattttgaggaacaattttaaggtttttatgttgactttagagggacaaatcgatgtgggattttttgttttctctggtacttgtcattgggactggttgtctttagattgagttgtagctttgagttattgtgcctaatttttttgtttttaatcatgagtttcatcttctttagaaccaaataatctactttcagcttagcccctgggttgggatgtatttcgagggatgacaattcctctgggctcatgagcagggggcacaaagcctctttcacttcctcacccttgtcactttccctgtgtttctaaatgattccaagctcctcaaaggcagggatctctttatatgtccatttagcccctgtgcccggtatcactagacacatggcaggaacttattttggggtgattattaagagaactgcagaattactagggctccctgaattgaagggtgggggcaggagactttccccattccctaccttgcatcccaaacagccttgacatggtagggcaggtagaagttgctggatgggcagagaaggaaaggcagggccctccgtctacagtgaggcaggaaattccagcaacagctccccagagatgcttgcagtggctgcagggcaattgggagagaggcagcttcaggagcagccttttactaagtaagtacagggagaagtgatttgaggagggaccattacaacttccaatttaaagagtaaaatagagtggcgttaggcaggaataccatgaccggtcatgtacagtaactaggctcaaccctggaaaaataggtgtccccttaattaatactgggataactaacagttactaaacacctattacacaagatatgtaagcaaatgtaattctttatgtatattaaattgtcattctataaactggtgattcaatgttaacatctccaggaacaagaggcttgaggctcacagagcccaatccaagctcacacaaccagaaactggtggcaaaatatttcacaactaagatttattcctaaatatagttggttgcaaaactgtagtttctgtttctcttttagtacactgatttattttttatttttattttttgattttcacagaattgatttacttttctcacctcaaatgtcaactttgtcaagccaactctttaagaataatatgaagccctattgtttaattcacatgttgctaaatataaaagtgtgaagataccaataatacctatttgtatttgtgtatgttgtaaatagtgcttggactctctaaaaccctctaggctttcagggtgttttacaaacacttcacagaaatctgtgaaatttgccttgtggctaactaatatttattggtgatttcatcagattacgctgctggattaaagagattatcttgagagcttttctttttactttttatttttaattttaaattagaattaagactctgggtccaccaaaactaagccttataactaagacaagaacaatagtcaaacaaaaggttttgcaaaactgtctaaattgttttgtttaacttttcagaaaaagtcaatgtctaaaacatcaagtactggcttaaaggtggtttatcaagaaaatagagaatatatacatatatatctgtgtgtgtgtgtgtgtgtaaatatatatatgcatgtgtgtgtatatatatgtgtgtgtttgtgtgtatgtatatatatacacacaaatatatatatacacacaaatatatatatacacacaaatatatatttatatacacaaatatatacatatatatatatttggagaaagggtcttactctgtcactcaggctggagtgcggtggcacttatcatagctgactgtagttttgatgtcctgggctcaagtaatcctcccacttcagccttcaaagtagctgggactacaggcatgcaccaccacatctggctaattcttttgaaatttttaaaactttcttcttagagatgggttctcactatgttgcccaggctggtctccaactcgtaggcccaagtgatcctcccaccatgacctcaggtttacaggcttgagccaccgcacctggccaatgaagcagagaagctcttgaatgcttatgttcacctggtcttctgcggaccctcaaattttagataatatatagtttgtagtgctctttaaaattgatttaccaaacaatacatagcacatcctgaggatgggacaatccattcaccagtactgaagagatttattacatttcacaaggttcgcttcagaaaaataatcctaaaaggatacctttgcaatgtacggtagcaatttttcatgccctaaaaatccaatttggagagtttctgatctggcactgagtggaatgctcatgaatgaggtcaccaaacagccacttagtgatgcaccatgatttatgcacaagccagagtccctcgcttcactaaataatcaggcatgaaggtgtgtcagggacaaaccctgcaacaatgttcagaatcttagcagctccaaaacctcttcctgattggtgtgtagacatgccaaatcattacaaatattaaaattccgactctgggcagcaacatgagccaatgcttggtaaagtgggtaaacttgtttggaacaaaggaacctcttaactaagtccactcagaccaggtcctgttaacagtccttttgaaagatatgccagaagaaacatgtactgttcatgttatatccatgaataaccacaatgttgagccctttccttcatgagcacaattcccacactgtcagtgagggtcttctgccctaattcaatgtccccacatcctcagctattcatcacatagctcatgtcagtccccttctctaccctatcatctcctgtgaatattctatattttattaatattaaacttgcagttttctcttattaaaattatgttgcctctccccaaacagacagccatatagtcctttattatagacgcttttggcctgtgcactctgatggtctgtgatttcctgtaactttctggaatctgtcttaacatgaaggacttgcatttgttacctggcagttttctcacacagaggtcaattcaagcaatggattatacattttggtcatcagttccccgatttcatccttgagtgacttccaaattctctgggagatgctctctgatcttcatgatttatacacatttattctgccacgttgggcctagaacatcctgagtattgatcactgtttgatatagtattttaaccctaccaatttcagaaaacaatttgagagtgagaatctcatcaccatcaatatatatcttttaagctctcattatatgccaagcactgtgcaaggtgctaggcttacaaaggggcttaagcaatggtttttcccatttctgggtgtgcagaaccattaaggagacaaatcaatggcatgcaacacagtatatgtgtatatggtagcacggcagcagttcacatgcacgaagcttgtcagagagggtgttcctggcaatatatgaatgtgaggggcttagactacttgaaccagaagagaccatatttaagttatgttggcttgtcagcaactacagagtactgtatgtgtaacaaaaattcaataaatatacaaaaaaatgggaagagaaaatggtgaaagtgaggtgcattcacagcaggagaaatgctataagcaaaatcttaaaggaagatgtattaaggacacaaaaaaataataaattagatataagatatagctggttagtgatagaaaatgaatttgaagagagagactggatagatattgtagactaagagcacactcgtatctttttaagctaatacattattatttattagccattgtaacaaagtttgttaacacttctctgttttaattttttgttaaataataaagactacatgtaggaacatggtctcaaatatatttgtcaggattttttaaatggttctctcctttgttctctcacgcacatatactaataagcttttaatacagatattaatttcagttttggcaattattaaaagctcaattaagaacttagcatgcccagaatcttgctgctgatttaatggagaccaccaatgcaaaagcaagttattacaatgtcacagactaacagaaataaagtatagagggaaatgcagaggcttttgattacgatctgattacagttgcaccactggttgcttgcatgaccttgaaaatgtcccttaacacctctatagcaggtctttctccctacccagggcagggatatatctagaatcttccaggcccattgcatccattcctccacatttccttgctcagacactggttcttggcttaccctgtgggttgcaatgtgaaatacatggagataaagcctggacttcactatgaagccagcttagaatagtcaactaaaggatctcaaagctcatcattcaacttgaataatcccagtggttctgtcctaagctcttttgctgattttagatgatcttataactggatagagctctgcagaaaaggaaacagggaaaaactggccaatcagcattgtgaaagcaacagctggtcttcaccccagcttcagcaggctccctccagccctctggctccacatttagcccatgaaagctcctcactgatgcccatctgttttctcttcttaacactagaatttgctgaaatgtttcagagaatttcccaacatggggcctaacctctttaaggagtaaatgcactcacacatttacacatgtggcatttaaacacatcacaaggacagggagtcaatgtgtagtcttcaggattaatattcatatggacacgttctaggggagaccagatgtttgcagtcccctacaaactggttgcatgtgtagtgggataggatccaacagctgatatcaaaataaggaggatgatctgcttaaaattaattctcctaaatccactgctattaaattaatcttattgttaaggtgcttaatgattcccagcaatctcaacttgtaattgtattttcaatatgtataaacctgttagtcctcactctgattcctcttaatctaaagtgaatgtctccaaaacctaagctctgattttttatcttgcccaaattcctacctaaggggtctgtggagtcatgccctacaaaccatcaattctcctcagatgggttttatttgaccctgtatatcatgacttactttccaatctgactctggcataacaaggaagaaaataaaaatgttttaccccaaaatatatttccttgccatacctgggaattactctgccgtctcttgtggggaaaatccacattctataaaaaatctcctttcccctttgttttccttccttctcagatccaggatttaatcaactaagagccaggcacccttttaagtctgataagaaacattttacaacctgcactctctgaagtctgctatctgagaacttcctctgcacaacttggtctccacaatcctttagcttaacctgaacattcctttccattaatcccaggacttcagataaactcaaccaattgttaaccagaaagtgtttaaatttatctatagcctagaagcccccatccgctttgggttgtcccgcctttatgaaccaaaccaatgtgtttcttaaatgtatttgattgatgtctcatgccttcctagaatatataaaaccaatctgcacctgaccaccttgggcacatgttctcaggacctctggagggctgtgtcattggccacaatcactcatatttggctcagaatcaacctgttaaaatcttttacagagtttgactcttttcatcgacaagagttaatatctcaactttaacatccagcaaagtattcggatttttaaaatgtaaatatagtcaatgatgctagctaggtgtaatgactgagttgaagagatttttaaactaatccttatttatttaatgtttagctaacaaggatgaattcttttgtgtgtgtgtgtgtgtgtgtgtgtgtgtgtatgtgtttctttgttgttgttttcttatatagattatctcagctttgaagtgtgacatggattctgtgaccatgataaatgactaaaaccctaaagcactgtttttcctctgtaaagtggatgtaatgagggtagtcacctcatatgatctgtaaaggagagatttctcaaaaacgagcatgcttcaaaatgtcccacagaacatgtcaaggcaaggcctactgggctccgcctgcagaaagcattcagtagacctagggtgggactgagaatttgcttttgtaatgaaatctcaggtgctgctggtgctcctggttggggacctcactttgagcaacagtgcgtaaactttaaatggactgaaccatacaaggatctttacatagcattatcaataataagggatgtcattgccatgaaaggtaggtgtatgtgatgtgcctgggggagaggcccagaggacactggctctcagggtctgctttcttttgagctttgtatacaaaaggaaaagcaaacagtaagtcagtctttctctcacttgataaactaaatactcagtggaaacaataagatcttgtggttgcagatgaagacagtttacccaagcaggctcattagggaccattcgcatagagtcctggcagcatacaggggagctggaggaggagcctgggggagttactgatgcccaaagaaaaggactctaggtcaaatttcgaggccccaggtgtctacctggctctagccaaatggaaatattccaggcctggcaggaacatcaacaaaaccaagaatctctcaagtattttttttttaagttgaaaaaaaaaaagcaggcttcattgaagttattattgcaatggtaacaatcaacattaagaaggaaagcataatacagtaaccacaagtttctactactcttaagtacggtttccagttttgtgggccttaatgttaattgcagataaaggtaactaattttagtcactgattatgtgaggctaataaaagtagagagtgcaaacaaaataagtgtgagcaggcgttgctcttgtgtttcacgtctctgaccaattgcaattgtccatatgagaggcacatttcctactgccttgtaaccaaaggaccgttctgctgctgtggctgctcttggaatcagagagagaagctgaatgatgcccctaagtttgtctaacaccctagacttgtcttgaaaataattctctaatttagtgactcaagaatttttcggaagttaattcaggagctcataggaaaaagaaacagttttcccccacccccccaagtattggaagtacagagaaggactcataaaaattgggctggagttatttaaccttgaatactgtgggtgatttttttttccttttgtaggaagggagtattggaagtacagagaaggagtcataaaaattgggctggagttatttcaacttgaacgctgtgggtgctttttttttttttttaccttttgtaggaaggaagatgtacttgcaaaaaatctccccaaagaatcatggacccctaacatcctgccttatctgactgtaatttagggtatcaagcatctgttaggcacattctgcaggtactaaattaaggaggattcaagagtagaatgtggaaatttcctgtcagaggtaagaagaatgcatggacaggtacaaaatggaggaatatgcacagatgggcacatagatgagagcatgaagtttctgacttgtcagtagaagaagtgctatgatttttttctcccagaaaatattttgattttgcaatgattcagccacatttttgtcctacctgcctgtatttatgaaacaataattgagagctagagttccacgaatggactgtaaaacagagtagaaagaactgatgaacagaagacacagcaggtaagcatgagcaagctagcccactacgtgtaaacagctcagctgactgggtgtggcacctcccttgaatatgaagcattctgcatgtagatgagagaaaggaaaatgcagtgcaggtgcaaatgacagtgacccaaagccatgttcctctgagaagtagacactttcatgcctgggcatcctccaggccttccctatctagtgcatatttttgcaaaggcttatgttgtgtttcagacactgtgtttatatgtgagggctataaatatgtgagaatttaagaatgtatgtgtgtgtatagaagaagaaccaagccacagcttgggcggggcatcctaaaccccttaataggcacgtaatttaaggaaagatcctgtgcttaccagagaagctttgtttagaggcccgttcctaagtccccttgcatcaagcttgctgctcctgcatccctcaaacccagaaatgccaaagctgcaatgctggcataggtgtatataggttagttcatgtccttgattcatgggtgatgacccaccaccctgcccagcagagtccaggccatcttttttctgagccctctctggggagaggtggcagctcaaaaagcccttgagtcttgtttctttttctttggtggggactctaatctgttgctaatgattccttcatacactcccccctcattccacgtaatgtgtttgagttctcttcttgaaatacatttgtcatttattgaataatttctgaaacaattaaatgacaactcaatgaatggctttgtcaattttgtgtaatggaaagtcaaattatcatgtaggaaaagcaaaatctttctttttataacattgctaaaagacttcaaaagtaactgcataattataaaaaaatttgaggtattaaagtttgcaaaatcaataagaatatctcataaacctatttatttttggaaattgaaaccatacacatggacttatttaaatgtaaatgtaaagatgtgaataaagaccaatatttgtagaaggcgatcttattatttaagacaaagttgaaactttaaacatatacatctgtatgtgtatatatacacatatataatagtacataaaatatatatttatttacatacttaaattatatgtttttatatttgtagatttaaatacagtaagttctcacttaacatcatccatgggttcctggaaactgtgactttaagcaaaatggtgggtaacaaaatcaatttttttctcattaatgttataatgaaaagatattgaagaaaacaatgttatttgaggactcattgtacattgttttgtttaaagtctgaatttccaagaacttgtaaaagacactaaggaattaccgtatatacttttgtatatatatttaaataagtttaaataaatatatgtgtggtataaatatatgtgtctatacatacatatctttaattctcagcttgtttcatcttgatttcttcttatctataaattttggttattcaaactttttaccttcctatagtaaatagaggatttagaagatttttgttccactacctccttggcaggtatgccagctgccttactttaaaaagcaacaattgcaattcttcgagacaattataattcattgctttccctaatcagcaggacctcagataaatggacatatgaagatttgttgagagtattgttctgtggttcaatgacttgtgtgatttccttatttaaacaagaacaaagaagccaaagaaaataatgtattttaaaaataattgggcactacttatcagagtggttggtggactggatactaatcaggatagtagactccaaattattttttttccagttacaagtacctttgtttattcaacagtagacacagtgctggcagcaacctgtaactgtactccatggatttagataagaagatgatggggaagggggatttttaagtcacactagatcaggattatattgtttcatttgagtctcttttaattcaagtgtatttaataacattctcctttatgaacggatttggagcatgaactttggatttaggcaaatctgagtttgaatccctgctacttactgatggtttcaccctgggcagcattttatatcctaagccttagagttcacatctgtaaaatttttataaaacctacattagagcagtataagaattcactgaggcaatctacatagactcccaatgtccctgacatataaaaagtactcaagttagaaatatttaaatccttatctaaagaaaacttgaatgctgaccaagactttagcagaatcccaaaagacacatttcttccctcaaatgtaagaaaatattccctcaaatgtaaatgtatcttcaaaatatcccagctcctgcccccagatgtattttcctaggcctgaggcatttgcaaattccagaggccatggcatgccagtgtctgttggctctgctggtaaggggggcagtctccctttcgtggctcctgcgcagtccagcctttctcctgttgggtgatgctgctaagcatgctcccaggatagaggaagcatctgccatgcttgtgggtagacatgggttactaagtaacatgacagaaaatgtaagtggatctggaaacaaggtaaaccaccaggagagccagaaatttaacaatgaccagattttaagccactggcattttgtttaagtcagttcccagtaaaatcatttgagcatggctttagaataaaagctggggacttggttgatgatgggatgctgtatggagtaacttgatggaggcccagaatctcaggaaccatttgtcaacatctcttcttgcaacactaagtaatagcagagccatcgtacattcatttcagaatgggctgcctagccattcaaaatgagtgagtcagaatactgacttttgactaatttctagaagcatgcagttgttttgcaacttgtcctaccgcagacacagattccttaacctccttccactagataagatattatctaacaaggattcccatataagcgaacattttgttacgcgaaagctcaaatagcagcagagtttgtacaaagctgtggaagaaagtcctaaagaaagaatgcaggttagcaaggagaggtcaggaaagtaacagattttgtactagaagagaataggaataagcagccaggtgtggtggcatgcacctgtaatctcagctactctgaaggctgaggcagaaggattgcttaagcccaggagtttacaatcaacctgtgcaacataatgagactccatctcaattaaaaaataaaatatttaggctgggcacagtagctcacacctgtaatcccagcactttgggaggccaaggcaggtggatcacaaggtcaggaaatcgagacaatcctggccaacatggtgaaactccatctttactaaaaatacaaaaatttagccgggtgtggtggtgttcacctgtagtcccagctactcaggaggctgaggcaggagaatcgcttgaaccaggtaggcagaggctgcagttagccgagatcacgccacggcactctagcctgggcaacagagcgagactctgtctcaaaaataaaataaaataaaataaaataaaataaaataaaataaaataaaataaaataaaataataatttttttttaaaaagtaaataaaagcaatgggaataagggatcaagaaaaatgtaggagtctttaaggcaccaaattcagaatcatccctatttggggaaacttaaaaaatcttttaagagaggtgccaagtacaattatcacaggatttgaagtaaggaatccatgccccattcctggctgtgtcccttattattgtgtgcattttcatagccacttaatccctctgagcttccaaggctgtatcttatccagatgcacgtatgcagcccaggcacatagtaggtactcaataaatgctggctttaaataattaaatgtgatgtcattttcaagaaacattagctaggtaggtattgtgacaagtcacaagattgtttgaaaaaaatacatataacatcttttaactgtgtagaaaataacagaaatgtcatcagtttggctgaaacacagggcttgtgctggggtcctaagagataaggcttgatagatatattggctgatgtatcttatgcgtttgctcaggaaaatatggtacattgcttacatctgttgttctagagtaattattaattgagccacttgtcaatataaaaaaaaccttcgttcggataatatattatattgtcaatgtctttctagctgccatcaattcagagtgagcaacttatacttaactcagaaataaagcaaactaaggatatgccgtacctttgaagtatgtgtgacaagaagctggatgatagtattagttgctattacatggtgcttataccagtgtaaattcaggagagggctggcattttttttttaagtttaaagtttaagcatgaggaaaggcctatcgatagataaaactttggttgtgagtctccaatggttttataagttcaccatctttaggaacatacatgaaattagagtgtacaataaggcagtactgtagaaaccctaactgctaaggaagttcctgcagctggctcgtgaaaataatcaaggaaggagcttacctgcctctgtcgatttttattaaaagcaaaatgagtttatttggagaaaagatgcccaatagaacatggattagcaaattaaagaaggatatacttagttttactaagtttcagaagaacaaagtcactcttctattctatggaagtgtatgtaagagctataagattaaactcacttctttgggttagttttaaacttgtgcacaaatagacttgatgtggtaggttgaagagtgctcccacaaaattcctgtgcacctggaacccagatgtgatgttatgtaggaataaggtgtttgctgattaagtacttaaggatctaaaggcaaaatcattctgaaattagggccagataaatctaatgactgatatctttatgaaaaacagaggggacacctaagacaggtcatttaaagaaaaaggcagatactagagcaatgcatatacaacccacgcagtcccaaagactaccaagagcctctagaagctaggagaagaaaagggaagattcttccctggggttttcagagatcatgtgtccctgttggaattatgcttctggacttctggcctccagaaatatgaaagaataattttcttttgcaaatcccccagtttgtggtaatttgttatggcaaccataggaaaacagtactctttaaatattcattattttgcaacctctgctattactcctcacttaactctgagctcctctgctagggtgtggccaccatgcactgaacacagcagcctgcacacaataatttgtattcctccagggcacctagcacaatgccactgctggttcaatacgtccatgactggttatgcattgccaatcttctggatcattaagcctttgctcatactaccatcttcacctggaattctccttcaaattccccatactctcttgacacatacgtctccaccttctgtaaattcttcctcatctttcaagatctagttcagctctaatcccaggtctacaacaacacttctcctgattcaattacttcaagtaaaagtgatcctttgcacatctgcactccctttctcctttctgggtcatctcttcggacttggaacaattcttctctagatttggttataatccacccccctccgcccccacccaacatgttgctccatgcgagttagtcttgtccatgaaactggatagagtgattttggaaaacaaagtctcgtctgatttttaccttcatctctctacttggtctggtatggagtaaacattcaatagtaacttgctgactatttgccctggctgtctcattccacagtgataaaaccgaaatgttctctaaaattacttttccatcattataaatttgacttgaaagccatgcaattgatgcatttgctggggattatctttcgcccgtcactcattaaatctgtcctcatatagcaacaatatttataggaacagctagacgttagcccccaagtgagaaaatgacccatgcaaatgccctggcatgacataaatacccacagcaatgcagattgtgtgatgactctgctgggtggctacagttctggggtatgggcgatggatgagctaacttggagaaggcagcctagagtcgtcaggggaaagaagagggtgcagtacctcattaatttgttcccagccaacagttttcaaagattagccacataataatgcccctagaatatgctctttgtacatgaccaaagatgatctgacaggcatttcaaaacagtaattgttggattgatgacgctgctgaggaaagaggactcattatacccaatttggaagattgtgaatatgtcgtataaatgggttatgaggatgcatttgggtaaaagagctggacaaatgcatgatgacattacagtaccccaatgggtgtctcagacatacagtacattctctcacccttcattatttgaagactggggaacaatactgcatgtttaagaaagtacaagttcaaattgtggccagatgtacgctatggtaagggaatgaagtggttctctagtgcatatgcaatcctctagggacataggcagttgtgactgtgctatcctgtgcctcacttaaaaagaatccactggacaaaaaacatttcagcaaagaagattttatgatgactgccttctatgactcacatgccttcctacaataggacatgtatgcatcattggacctttgacattaaacaatctcgaataattttaaaagcatgtattaatatccagtaatactttttttttttactttaagttttagggtacatgtgcacaacgtgcaggtttgttacatatgtatacatgtaccatgttggtgtgctgctcccattaactcctcaattaacattaggtgtatctcccaatgctatccctcccccctccccccaccctacaacaggccccggtgtgtgatgttccccaccctgtgtccaagtgttctcattgttgaattcccacctatgagtgagaacatgtgatgtttggttttttgtccttgcgatagtgtgctgagaatgatagtttccagcttcatccatgtccctacaaaggacatgaactcatccttttttaccgctgcatagtattccatggtgtatatgtgccacattttcttaatccaggctatcattgatggacatctggattggttccaagtctttgctattgtgagtagtgccgcaataaacatacatgtgcatgtgtctttatggcagcatgatttataatccattgggtatatacccagtaatgggatggctgtgtcaaatggtatttctagttctagatccctggggaattgccacactgacttccacaatggttgaagtagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgtcttttggctgcataaatatcttcttttgaaaagtgtctgttcatatcccttgcccactttttgatggggttgtttgtttacaccgataacagacaagcagagagccaaatcatcagtgaactcccattcacaattgcttcaaagagaataaaatacctaggaatccaacttgcaagggatgtgaaggacctcttcaaggagaactacaaaccactgctcaatgaaataaaagaagatacaaacaaatggaagcacattccatgctcatgtgtaggaagaatcaatatcgtgaaaatggccatactgcccaaggtaatttatagattcaatgccatccccatcaagctaccaatgactttcttcacggaattggaaaaaaactactttaaaattcatatggaaccaaaaaagagcccgcattgccaagtcaatcctaagccaaaagaacaaagctggaggcatcacactacctgacttcaaactatattacaaggctacagtaaccaaaacagcatggtactggtaccaaaacagagatatagacaaatggaacagaacagaaccctcagaaataatgccacatatctacaaatctctcactttgacaaaccggacaagaactagaaatggggaaaggattccctgtttaataaatggtgctgggaaaactgactaaccatatgtagaaagctgaaactggatcccttccttacaccttacacaaaaattaattcaagatggattaaagacttaaatgttagacctaaaaccataaaatccctagaagaaaacctgggcaataccattcaggacataggaatgggcaaggacttcatgtctaaaacacaaaaagcaatggcaacaaaagccaaaattgacaaatgggatctaattaaactaaagagcttctgcacagccaaagaaactgccatcagagtgaataggcaacctacagaaggggagaaaatttttgcaatctactcatttgacaaagggctaatatccagcatctacaatgaactcaaatatccggtaatactttcaaccagcatagcttaatatgcatcataaaacaaatggttttggatgagagaggtacattttttagctttaaaaggaaacattcattcattcacagagtaagagctgtacactgaaatgaaaataccatccaatgcaaaatatgtggaatcccttccccacagctctgactctagttagatataatacatgtcatacttatagacacacgtacacaaatggagtgcaattgtcacatcttaattttgaaaaatgactgtatttaccaaataattattcccttttaatatgtcattttaaaagcatcttgagagataattttatatttttattttttgtgggtggaaatacacctcaaattttataataaaattagaaatggcaaggagttctatgtatcagaaatttctttatggcaatttaagaaataaaattgtcattctgaaaagcgatacatatcaatatcaatgatagcccacataaatgaaggccatgttcatctgctaattcagtgaatcttattactaaagaggtagtggctattctgtgttgggactcatttaaatatagagatatctaaaaatataaatatcctccctacataaaactcttcaacaaaagcctcgctgcccaaactcccaacaatcttccctctcagcagaattcattgtctcaggagttttccccaactgtcccatgaagagaacacgtcgcactttattttataagctttttatttgtcttgctccccaaaagagagtgagatttgagagaaggcagaaactgtaacttacataaaaatatcaataacgattgatgataagaagcagcagcagcagtagcatcgatagcatttcccaatacccctactcctgccccaagcacaaatctgcctcattatgtcctgaattcccagcgtccaggtgggtggcagtgggagccctcctcctcaggagatgttccacctgcctgctacctgccgcagtgtttgccttgtaaccaggccattctgtactcaggagctacaggcaagttactatttctgcagtgacatttccttatttcttggctgtcaaaaacagaggctgttcaggtaccagtcctcctgctcttgagtaagagaagaaaatgctgtatttgtagtgaaaagggtgctggttcaacgctagcaggattttccaattgaaggggtcaaggaaacatgtgcagattaaacaagcacaatttttagtttcattatatttatatgatgattgtagctacttattagttatttataacccaccacagctggttcggtggctcatgcctttaatctcagcactttgagaggctgaggcaggaggatcagttaagcccacgagttggaaacctatgggcaacatagtgagatcttgtctctacgtttcttttttttttaattatccaggcatggtggcatgcacctgtagtctgagctactctggaggctgaggtgggagaatggcttaagcccaggaggtggaggttgccaccagtcaaaatcacaccactgtacttcaatttgggccacagactgggaccctgtctcaaaaaataataaatgaataacccaccccattctaagcaggactatgatgaaagatatataatagaaaagtatgatatgaatcaattagtgaatagtggaaaagaagaaatgattgtacacacaataaatccagtgtgaggctaatacctcaaattagattacatacatagtagagttttctatgacaagcgtcatctttgctaacattgctattgcttaagaaataccagcatcattctgtaaacttaataaattcagagagaaatattagcaatttatccccggttcaccttttacttctaaatgctagtcagattacaaaactgcctagatattttgcaggtcattgaaaagacactagagtttttgggtggaggacaaaatagaatttttccaacagcattctgtttttttttttttaatactttaagttctagggtacatgtgcacaacatgcaggtttgttacatatgtatatatgtgccatgttggtgtgctgcaccgattaacttgtcatttacattgggtatatctcctaatgctttccctctcccctccccccaccccacaacaggccccagtgtgtgatgttccccttcctgggtccaagtgttctcattgttcaattcccacctatgagtgagcacatgtggtgtttggttttttgtccttgtgatagtttgctgagaatgatggtttccagcttcatccatgtccctacaaaggacatgaactcatcattttttatggctacatagtattccatggtgtatatgtgccacattttcttaatccagtctatcattgatggacatctggattggttccaagtctttgctattgtgaatagtgccacaataaacatacgtgtgtgtgtgcctttataacagcatgatttataatcctttgggtatatacccagtaatgagatggctgggtcaaacggtatttctagtctagatccttgaggaatcgccacactgtcttccacaatggttgaactagtttacagtcccaccaacagtgtaaaagtgttcctatttctccacatcctctccagcacctgttgtttcctgactttttaatgatggccattctaactggtgtgagatggtagctcattgtggttttgatttgcatttctctgatggccagtgatgatgagcattttttcatgtgtcttttggctgcataaagacgtcttcttttgagaagtgtccgttcatatcctttgcccactttttgatgggattgttttttttcttgtaaatttgtttgagttctttgtagattctggatgttagccctttgtcagatgagtagactgcaaaaattttctccccttctgtaggttgcctgttcacgctgatggtagtttcttttgctgtgcagaagctctttagtttaattagatcccatttgtcaattttggcttttgttgccattgcttttggtgttttagacatgaagcccttgcctatgcctatgtcctgaatggtattgcccaggttttcttctagggattttatggttttaggtctaacatttaagtctttaatccatcttgaattaatttttgtgtaaggtgtaaggaagggatccagtttcagccttctacatatggcagccagttttcccagcaccatttattaaatagggaatcctttccccatttcttgtttttgtcaggtttgtcaaagatctgatggttgtagatgtgtggtattatttctgagggttctgttctgttccattggtctatatctctgttttagtaccagtaccatgctgtttttggttactgtaataatggtttacattattagctactggttatttttgctatatgtaggaagagaatgttttcaatccctacatgtcagagaaatggaaaccagactccccttaaaaactgtctggatgctcaaaccgtgggtgttcataagaaacttctgagttgattcacaaagtgagttcattttaaccttgtaaatgtttgatactatttttataagtaacaagaacaaatggccacttcctgtaacataacatagaaataatattccggttgagagtgttcgagtaaacaatgcagtacccaaatctatacccttcccccacacacacaggcacacacacacacatacacacacacacacacacacacacacacacacacacacacacaccaatcgccatggctaatatcaagattaggttcaaagacaccagaactcggacagttgatccttttgaggcaacataaatatggtcagcctgagagtcagtccagtcaaggttcctgggaaaactccagaatcatgtctgagggatgtactaacacagggcaaaaggttaggagcaagactgaaattaggttgtcagtggagagctcaggctcatgtggggtgggatggaatgagaccaactctggccaaggtaggagggtcctggctgattcccctcaaccatctgcagtggttttgtggctttgctcgcatgccagaggcagaacagacagacagccgacagcagctctggtcattcctgatattttatttgtgttcttcattggactggaatgctctgctactatgcgtgtctacttgtgtctgtgaagtgtgtgcatgggcacgtgtatctgagtctgtgtctgtgtgactgggtgtgtctttgggcatgcgacatttccttttcccaagttagtgtgctttgtgctgaaagccacatgaagcgtcagtaacacagacctcctaagagatgacagagtggctgttctcacccataaatggtgttgctagaggatgtggggagacttctcacttaaggtgctttggttaggaacatgtaaattcactgtttttgaaatgtaagtttcagacagggactggtaaaataatgtccagcctctctcacactgtcacttccccacctaggtgcacaaggatgtgaataaagctcccactgtgcactgctttgccatctggaatcccttaagcgagaactgtatcttttccagcgcagctcatccctgctcattcgcctcattccttggtgtcaatttcaccttctgccgccattaaggtccaaatgggcggcagggcacctctgcacactctaattatgctaataacggctcgctgactgcactaatggggtcattatcgcccctcatgaccatggggtgcaaatcgccactttaacatcatcattcctgtcctaatccatcactatccttcacactagccattcttagaacccaaaaaactctccctaaaaaggatgctttgtgcctgtgcttccaggaagcattcagagatgaaagcatgggggactgagggcaacatgcctggcagagattacagcaagttacggaagagagaaggccctctggcaaggttttgagatgcagggaatgaaactaattcatgggtaaaggattctgacatgaaattggaggtgcacactctggcttatctaggtgaccgagggccggcctgggagctagggacctgtcttctgctccagcagctctggttggactacacaaaattaatgggccttcacgtttccatttgcagcatgagaatggtaaaaaaaaacagagtcagtcaggttacgggtcagtgcaaagtcaaacctccaagcggataattcagtagccacaaggggacaaactgcaaagtcccaaatgtgtctagtgttgacaaccttctctcagctcgcactacataaccaaagcttatgaattcagcctccatgttcccaccaccaggctcccatccttattagctccgtggctttgagcaagttgcttaatcttgccaaagcttagtctcctcatctataaaaagaaaaattaaattattgggcccataagactgatgatatgttaagccctattcccaaaccttatacatggtaagggcccatccaatggccattgatattacttttatctacagacttggatctaagtttgaggcatcttgcactatgatatcccagcatcaccatgtatgctaaccagtcagaattttctagtctacaggactacacatgaccatttttaagaactaaatcaacatattatattaaactgagtggatgaaatcaaccacatggcatttatgaatatagtatcaatttctttacagactttagaaaccgatttgactctacttgtctctgggagagagctaaatttcgccttccaaaaaaaagctgaacagccctcagaatgatttatgaataggtctttgatgcataaaatctcattttctttagtgcatttgtcaaaagatttccccatgtgtgtcttgtgcaggacttggttgttgtaaccctctcagcctcccatgcaggaggagtatttttcctgatgctttctcttgataggtcttgggatgatcatatttgactgatgtgttagtgttcttactttaactcgtgcactatgaactttatatcatgttttacttcccagcatattaatgctctggtcttcagtgcagatggagtgaagccctaaaactcagccccgtcagccaattaggattcatctgacaagcgacactttgtcttttgtgtgctagcctgggaatggcaaaaagacagcatcttgtttgccttttcaaaaatacacccccatagaatagaaattacgtacgcttttgctggcttaagcataatatagatttattatgtgggaaagatagatgagagattttttttttttttacaatgctgggaaggctttaaaattatttactgtcctcattatcattaggaagcagacattatctgatctatctctccagttttttatggtaaaactctattttaagattcataatttttaaagactgcctgcccctgaatggaatatgcaggctgcacggggaggagtgatacctgatggggtgtcccactgccatctcaaaagcatacttgaaaagttgagaaaacattttctaacaggatgtgaaaactgagtcttgaacggagtggatactgctcagaagaatatttgcgaaggaatgactgctgaatttatgtagtgtgaacatttaaagtaaaaattcaaatcctcacctttggggtcatggtgattaatttccattccaaatgtaactcttcttataggcaagaaatccagtaaatattcccctgtgaccaacaaccccgtgagctgttggcagaattaataaagctgtcaggatttctttgggatattgcacgtctccctgtatgtcatttaattgtgaagtgtaaatatgcatatggcccatcaggaagactaaatatattagtctttagggcttcagctcctgtttctgtactcatttatcaattttgattaaattaggggagaacattttgatacaaaaatgtataaaatttatgtagctttctaggagaatgacttgcattgtttatacagcataagcatctggggagaaatatatatttttctaatatgcagctttggataatataaaatgttctgtatacaagattatgttcacagcttgggagaatttggggaaaatgctcctggcaagcaaactgtttttaagaagggaaagttgaaaaccaggagcagagggaaaacataatgcaacttctattttctcgaactttaaaatatgcagcttccgaggctgactcacaatccaagtgagacctctgtcagaagagtctgagtatgcagagggaggggtgcagatggagtgagaacacttatggtaatgtcaggatccagctcaatatttcaaagcaatgctttctgtacaagcgaagcacatttgcaaggggattggcctttactgtgtgaactcagggctatctttcgaccaatagataccggccaagctaggaatgagtcagtggtttgtgactgtctgcactggttttgctttgaaacagtcaaagaagagaactgccatttaaaagagtagcaagaaatgtgtgagcattgtaattggacattagtaaaatccaagtgtgagtttgttgttgtgttgttttgttgtgttttcccttccctttgagtgtcgatttgtaaattgatgtactgaccactttgtataagctctgtgttgtacagatattataaatttaaattcaagcaaaagataggtaagaatatcccccttttacagatggaaggatcgtgttcatagacattaagaaatctaccccaaccctacagtgatgtagtgctcttctgaccaagatgggtcctggggccaaatcgtaaatagaggcctacctaccatatgcttacttaggtaaatgttataaatgatgctaccaaacttaaataatttgtgttctctactcctttgttaacaagtatactttcacagcaatgtggaagtctagggtgaaatcagagcaatacatgatacacatcacccctgcccattcaatatctgactccatccttcaagtcactgggggccaagcttacatttccgggttgcccacactgccccagtgtctacaccttggtcccataggtgcccacactggtcttgtggcctggcctattttcactgggagagtccttcacaggcccacaagtgagcttagagccctttggtcaggaaattctgaagtttggatgcatgaaacatggtgtagaccagaatgagagggttgggtggaaaggcagggggagggaaggcttccaagttcgctcatagcctgccaggacccctaagtgctcgtggcatgggaaaacaacagcaacacccaaaggaggaccaaagcaggggccctttaaagcaggaagcccaggagagtaccccctgctccccaccacccatctaagggaaatactaccacctgggcattgtgattgaaaggaattaaattcaaatcaagatcatgggactccaagctgatattttatccactctactttgctgacttcctagtattttaaatgaaaacctaagaaaaaataaaaatgtgaatctggtcatctatttcaggaatccttttcatagtaacaaaataaaatattttaagagtcacatcccagtgcagaacctttgagtaccttgtgcccttgagaagtggccacaggtcccaaaccagggcccccattaagctgagctaggtttctttctttggggtcttgttgaattgagccttaggagcaccccaggactgcttatctgctagtaatgcctgcgataagatattcagggctctgttgatttcccagctgtgcttccagtgagcgacaggagttttgggacactttgtgcctgcaatcgctgggagagaacagccatgataagcaccagggagagggatttttttcgcctgtagtctgaacacggaaagtgataagagaggaaggcctctgcagactgacccgaaaagcaaatgcaggtggaacaaaaggcagccctgactataagaagataaggcagctgcacaattggtagctggctgcaggatctccatccattcaagtcacgaccttatcctacagcatgtgatggagcaaagaagtaaaaaatgtatgttttaaaaaagaagtctcaagattttctgtagtaaaataggtcaaaacatccagtcaaattgaaagaaagcaatgtaaaaatttgagtcaactggaaagctgggcattgtttggtcagatcgatatcccacttactcaaatcatgtctgcggatgttaatgaggacaaactagtgctagagtagcgaaagcataacagttcttatattttttaaaaaatatacaagtataaataagctatcatggggaccgggtgtggtggctcatgcctgtaatcccagcactttgggaggccgaggcgggtggatcacctgaggtcaagagttccagaccagcctggccaacatggtgaaaccccgtctctactaaaatacaaaaattacccgggcacgatggcctgtaatcccagctactcaggaggctgagattggagaatcgcttgaacctgggagacggtggttgcagggagccgagattgcaccactacactccagcctggatggctgagcaagactccatctcaaaaaaaaaaaggactttatgaaataatttttaaataatcagatgtcaaatctctcatagggagcttagcagtgattctgcataaaggccataggcccaggtcccagccacacacctcatttcagagatcacagtgaggatgaaatgacaaaaataaagctcctaggtcaggggctggcaggaggtgagtgtgtaggacagtccaacttcatttcatgcatgtttggagacgggccagggtcacgtctgtttgacaagcagaatatttgagttctctaagtttttaaggttctgtaagtttttaaggaggagagtgagaatgactactgagtatgtaatttggtcattttaagtttgtaaattaaatgccacatgtgcgcgtgcttgcgtgcatgtgtgtgtgtgtgtgttttaggccaagacaaaatgttaccacatcaaaattccttatccaaaaaagtcatgtcaaataatcacattccaaaatacatgtaaatggccatatcaaaatgacagagtcaaaatgtcagatctctttctcttccacctcaatcctcccactgttagaatatgtatgcttatcacactacgtgcccccatgttgggttcctaagttatggtcttcaatcccatcaagcgaagttttctgactgctggactgtggcaaggaataggatttttttatagagagatgtcgattctttcagcccttggagctgctggtctgggcccgtgtagaacccctgtccctgtggtcgtgagcaatctcctactgtgctatacctatataatcaatgaatgtttcgatgtgaaaaaggttggaaaccatggccaggcaactctagaaagggaaaagatgaaaatggtttgaataagtcagaaaaaaatgtatgaataggtagatttttaaatgcacagtcttgagagaagcacagaatttaaaaaaaaaaggaaaataaattccataagaggagaacagcaagagacaaaattaggagtgcaggattagaaggtgtgaaggaaacagtagtgtggctgacattctggaggggcatgtctgggccaggagactgcaaccgaagcccatttcatggtcagagaggcctggagatgggggttggctagaaggcaagagaaaaaggtggcctctgggtaacgatgtaacaggatgaatgtgtggtttgggaaaatgcactattaactgcatgcaggactgatggaaggaaaaggtaatggagtcaacaaaatctgatcagggtctctctgaagttatacttcttaggttttcatcagaaaaactttggcttggaaaagatacagctttaatttccttcatttagtttttttttaatctatctatctatctatctatctatctatctatctatctatcatctatctatctatctatctatctatttattgagacagagtcttgctctgttgcccaggctgtagtgcattggcacgatctcggctcaccgcaacctccacctcccaggttcaagtgattctcctgcctcagcctcttgagtacctgggattacaggagctcgccaccattcccagctaatttttgtgtttttagtagagatagggtttcactatgttggtcaggctggtctccaatacctgacctcaagtgatatgcctgcttcagcctcccaaagtgctgggattacaggcgggagccactgtgcctggcctaatttccttcattttaaatttactttatatatttctaaaacaaataaatacagttttctgcttgagaaattcctcttggtatggtttttaagctttaattgtgtatgcttgtgacataaacttatttttcttgtcctccacatttgagactttgctatagatagctaacatcaaaaattaagcagcaaagaagcttatttctgagatatttttagttttcccaattcctgatctggacttccagttttcatttattttcttaagttctgataagatggattgctttggcttatgaagtaggtactttttctggcaataaactttacttttaaatatgttatgaaagtggattgaaatgctctttaatagaaactagctgtggcatatatataccagacatttttatacagaatgtgcttacagaaagggaatctgaagcctgagaactttgcagaaaccatctgctctctcccccacctcttcagaggagggcagaaaagaaacagagagacaacatgttaaaccctagaattttaaagtcaagataatgtaattctggctttgtcattgcacagaagaggaagaaggagtgggtgaattaaataaatttgaatacagcttcctcaccattcattagctatatgctgatcagattgcttcagtgctctgagcctgtttcctataaaattagataacagtatctgcctgacagcactgttgaaatgattaaatgtgcaacaccagtaatgaggtaaaagttcattaaatcatatctatacaatattatttcattaatatttttatgaaaaataattcaaaacatcgtagaaaagattattaggttctgtttggtaaagtaaagaattcaatgcatgaatcttctaaaaactatgtctaactattggatgaacaaatgcatgaccctgtaggtcatttcctcaagaattctgcttagttcttgaccctcttctccaaaggatagtgctaaaatatagaaggcacggtgacggacttgattctgatactcactagctgtgcagccttaagaaagccattcagattttctggctaagagatctaggagtattaaataagataaagtgtgcaacatacccagtataatgcctgtcacatattaaatgctcaataagcattggtcctgtattcttagcacctcatctgtagtgctagaatgctaccagacttgcctatttctcaggttattttgagttcaaaagatatagtgggtgatatagtgagagacattatacatatgcaagctaaaattaaaagcaattatccaagatcagtgttctgatatggaacaatagatgagaaatggaaatcctgatagcttgaagagaaagatggacatccaggttccccttattgagtatctgctctcgtcctcatttaatttgtcagcttctggagctgacttaatgagtttttctcagctgctgtcattgtttccttctccatcttccccttacaattagagtttcagaccagaatccctacaatttccatttcccaaagacagaacatatacacggtgtgctttcaggatggatgccatgttgacctaccaaccctggaaaggaacaaagggagtgtcccccttaaccccgacctgctaagctgtaaaccctggttcacctgaatgtgattggagcatggtattgtggtctccccaacaaagtccagaaggagtcaagtgggggcacaacttgtaaaatttccttcataatgaaaatgtgtgttctttataaatgacttctctttgcagtaattctcttccctataactttatttataacaatatttttaatgttgaccttgaagctcaaaaactttaaataacttgaccaactacatatgtccagttagcaaaattgctggagaagaggtacaaatttgtgtgagtccacatttgtaggctggcattggcctggagaaatatctagcaagctgcatattcagcattaaatgttcaaatcacctcattaaaaaagctcaaagagttgacatcaacttagcaatatatttaagcaaatgtaccccagatattattatttcaatatatgataattcaaaattatcagttagcttgctgtttttgttttgctttgtttttgtattaagatctttaaaactcagtgtgtatgttataccaagagcacaccttaatttgcactagccataggtcaggtgctgaatagccacatactggacagccacctcactagccacctcccatttttaacatctttcacagacagcatctaagttataaggtacactttaattttctaacacttgtggaggcttgaaagtgaccaacagtgaaagaacaaaaagtcctatgtttattttcaccgctttttccctccctcaatattgtcactggtaaactgagatcttttcccattttgtgtggattgcacagaagaacctccagctggaaaagacaatcaggtttttttttccgctggccagggaatggagaaggcactctcttgctctaaatgcacctctccccaaacattagaaagcatagggtttttaaggactgggtacatggccagagaggaatgtttgcatgtgcagagtgggactccagacgtgcagacttaattcataagtatgtcttcatacaacccacgtaaacaaaatagcagaagttttcttttagaggtggaatttttgcattataataatatgttaatgatctaaaggccactagggattgtctgctccagtgttgctggtttggggttcttatctccctctggtaatctggacagaggtcaagaagctctggcaccatcccaggccatctgacttctttaagcagctgtgcccataaataaagggactgtattaacccattttcatgctactgataaagacataccagagactgggaagaaaaagaggtttaatggacctacagttccatatggctggggtggcctcacaatcatggtggaaggcaaggaggagcaagtcacattttacatggacagtgtcaggcaaagagagagaacttgtgcagggaaactcctctttataaaaccattagatctcatgagacatattcactatcatgagaacagcatgagaaagacccacccccatgattcaattacctgacactgggtccctcccatgacatgtgtcaattgtgagagttacaattcaagatgagatttgaggggagacatggacagaccatatcagggaataaagaaaaacagtaagaaaaagaacttttccagttgtttaatcagggctgtcctggtaatgaggttgagtttctaaatctcagtatcagaccattcattctaattccattaccctaaacctaaaccactctgtccaatcagctacagtcacgtgcctgcttatgaaccacaaatcccaggatgatcacctcattgcctaaatccatattttcaaatccagcacaaaaaaaatctactgcatgggcccaggtcctgacacattacctcattatctatgtgtctgcaccatcttctggctgttgatgcctcatattgacatctctgtgtctatttcaatttctgacccaatgttttatcctaatctctaatcccccttccaatggctgccttgcttcttgacccatggtttttcttacattctgccaagagtacctctttaccatggtttttctcacatggcataagacttgcttgagtaggatgactttttagttttgtctacaatctccagtattcttggcatttactgcatgcttactcaatttcagacttccacaaactacatgatctgaatttcattagatgcctcccaagtgacccaatgagaacaacagacttgtacctggtcatcagactttctcctgacttggattcctcatgtgacttttagttgccctgccaagtttgctgccaatggaactgtctaatgtctgccaagtgaaagggttttttgttgttgttttctttatttgtttgtttttttcccttaatttcaagtactatgagatttctcagaaataaacctagcatccttattcagcaaacttcacactgaaacactctgtactcctgggaaatattttaagagccacaaaagccaaaagtatatggaacagcttcttaaataagattttccccatgaacttagatttaccttgtgtgatataatacaagtctaaagttaacaatttcagaggaaataagaaataaagaggaaagaaaactaatatcccatgcctaagggcatatcaggcacacttcaaatatgaaatgatgtaaaaacaaaataccttaataggcaagattatatccctgcttttaacataaaggaagtattgacttatctaattaaagactgaatcaagaaaacaactgagtggaacagcttctcctagttggcatttttacaactatgtcccttgatttatttaaatgatacatgcacctagtagatttcaaaatattaattcatcaaaatctgtacatgtttggatgatgagcccaatccaaggagtggacatatttgggcccaacctttcaaacttccaagttcagagtctagatgaaaatgacttcccaagtctaaagctgatattagctaaacatgtgacagggcctttcccccacgattcatctataaatcctttaacactatcattctctgggctggtcagggaaaatcttcatttgggcgttatttttaagtattacacatttaaagactattatagacaaatgagtgtgcacccaggggacaaacaccagcagagtaaacatattaaaacccagtaacatgtaaaaggttggaaaacattacagatgctcagtctgaaggctgttattttggcaggattaagagaggagacatggattccatgacaagaacaagaagccacagaaaaatggggctcagcaaacatcagtgggtgggaccacctcctacctgaagtggtgcagatattagatgggggaggtgaatttaatgaccttgacaggcctctccagccctgagattctatcataaaatattcctttcccacaccacatgtaaaatataaatgttgctccctgaaacccaaccaagaacaggctgcttttaaataagtgagaaaagagaatgcctgctagtgaggactttatactttgacctggggtttgtttctctataaataaccagcaatgcacatcgccatgcaagatgggcttggcctcagcatatcctcctggtctcattttccttatacctgaagggtagaaagctcaggccctttttggccttgggcaagagagcttttattgattgcacttgtcatgagtaatctgcagccaaaggagagaaaccatatgagtcctataaacagcaagtcctggtattgcatttgccatattttcaaaatggatatgatatacaggagtgatgcagaaagctaaacagtctataggtttattcctgtctccatgaaaccccaacatgtatttctttaaaaagtgatggggtaaaattagtctttattaactttcatttccaagaggtttactaaatactaccattttacattaaaataaatattgggccaataattctttttcattatttttataattgccatttcaaccatctgtcaattaccttagcacatcatttgtgaataggttgatctgctagcaagaacagctctaatggaggcagggcatggatttgtcttttgccatcagaaatccaggcaattcaaggctgatagggcaaacatcaagaaactagtaagtgcaggagctatgattttaatctagattcatttgcagtcagggtccatgcattagcaatcaccaccatgcggatatgcagaaggggccagcctcaggaaacaggtcattccataactgcccttgttaccttcccatcaagtgcccctgttctcccagcagaggaaacagccacgtcattgtgttaagctatcagtgccagttcctcctccagtgggtatctgcaacatcttcactgggggagattactgttaaaaacgctgaaagaaattttaagacagagatggcagatttcacaaatacagatgaagcccattcttaagttatatgggataataagctcattggagttgcacaaaaaatccaagatcatcaaggcaatggacccaatgctatatttaaggagagacattaaaaataagttcataataagatataagcagattctactcatttaattaatttctaccaaaagaataacaaattaacttgaagataaaaaaataatgggaaagaagtgataattcgattaaaaagtaaggcatttgctcctatagagaaataacataaacagatttttgaaaacatttacctttgcctaattattcattacgctcagctttatatggaaatgaccaaatcttaatatcccagatggcccatcatgggttcactttctatccacaatcaaaacaaagccctagacagtcagtgagttcaacattttctgcaaattagtagacattttgagcaaacaagcctcatgtggatgatgcagtacttcaactgaatgatcaagagcttaagatgatgtggaatgctgtcatcaaacccaatctgctcattccaagctgtgatttctgactgaaaaacaggtgacctttagcaaatagcttgaactaaggtggaaagatatgcatacatattgagttacattggtttctagcctttgattttaccagtgttttaaattaatctcctcttctttcctccttttccaatccttattcttttctcatattttcttatttgtgtcctaagttcagtatgagtaaacacataccttcttaaagaacatttctaacataatttagtattgatcttgtttatacatcagtttaggatgtatgtagaatttgtttctattcactcatttaattttctgttcgatatttactgaacacttgccaagtgtcaacaggagacctgaacaagacaggttctagaggaccatgggctgccacatatcctagacagagctaacactagggtgacctaatagccaagtatttcctgggacagctctgattgacgccgctgtctgagcatgactatactgactttttcatcttcaagtgttctagtttggaggacaaagtctgtgatttatctatattcttagttaaaactgtaggaagtgtgtgtgtgtgtgtgtgtgtgtctgtgtgtgtgtgtgttttaaattggtgagcttggcagcctgtcttcctatgtgtagtttccactaggttaagaaacctcaagtcatatgattgacaagggagtgacataatttgcatatggaatgaagctctgacacctaccagaaaacagaggaaccacccagaattctgtgtagtatgagctcatataacagaggtaatgataggtaacattcactgactctacactatatgtaccagactctgtgctaaaggccctcaaacttcattcaaacctcaccaatatccatatggtagggaaggacatttatttctattttcttattgaagacacagattctgataagtaaagttagttttacttatcaggggatccaaccataacctctctggaacctaactagggaatgatgcatattgactcactgcatctaaaaagtgctaccaattacacagaatctcttctcacccggctgtaaatagggtagagagaaaggatgtgagaggagtcacaaccattgcatttgatgagcttgtgtggtttcccactttctggtgaaacctgttggattcagggattcatcccttaccacccatactccaatctccttaccttcaccctccccagtccctacatatacatattatacctttgtcacctaaaaaaaataaaaaatgtacatttaacctctgttccatgcctttcgtcctcctaatatttttctttactttatacttaaacatgtaacttaaatatccatccagcatttgcttctagaaatttagtgttctctcaactatatcagaaaattcctactgcatgtgtttcaagacctgattgtcatccttaacctcttatttctgtttaaacatctcagccaccttctctgtgattattttatatatatacatatatatacgtatatatatacatttttttttatttttgagacagagtcttgctctggagtgcagtagcacgatctcagctcactgaaacctctacctccctggttcaagcaattcctctgtctcagcctcctgagtagctgagattacaggcgcccatcaccatgcccagataatttttttgtatttttagtagaaacagggtttcaccatgtaggccagactggtctcgaactcctgacctcaggaaatccacccgccttggcctcccaaagtgctgggattacagtcatgagctaccacacccagtcactgtgattattttttttgccacaagttttctacaccaccagtggcacaaggctgttcgttgtatagagtgagattttgctgacattttggtgacaatggcgagtgatttcagcaccaaagggagacagcaaaacgttgagcattgggtgtcattctacctatggccatcagctattatttagctctagataattaagtggcctctagctttggaggccccagtcccttgcaactattatgtcttcaaatcaagacacttctcttatcccatcttgttacatgaccccagttctctaaaaaaaaaatacatttattttgtctagttattaaacaattctaaaaataacaaaaagtccccatgcagcagaataatcatttcccctgagaaaggaagccaccatttctgttattgtaccttgctttaactactttggtttagaccttcccataaccaaaatattcattaagctgtttctctaaataggataccaagatatttcttctactgccactctagaacaaagaaatactgaaattagcttttaaaccaaaaattttgtcctaatgatgtaaataaaatatatttaattaagcatgaaaaatgtatttattgaactcctgtaacactccagcaatgaggggaagaagattatggggctataaagcagcatagtatatgaatcctcaaagaattgtcaagtcagtttaagagagaaaatttttgaagaataaatacaaaggaaaaagaggataaaaaggctatgcttttcttttacacccccttctcctgcctcattagagaaaattggtatgaagattaaaagaagtctacgaaaataaacatattctttaaactttaagtaaattaattgaaattaattcagtgcttatttatttcccaaactcctatcccttgagaaagtgatggcactcggagattttgcaaaaagagtattctaaattgctgttcagtaaaatatctcattgagcatggtcaaagtagaaaacatagacttatgaaaaacattttaccatggaaagtttcaggtgagtaattcttttctcaaaaaagatattgtcttgttatgtttttacacatgaagatatttaaaagattaccatctttataaagctagtgtcatcctacagttaagcgacaagaagaagccaacaacttgaggaaacttggcaaatgtggttctcctgggaccaattaggtaagaacaggagaaatgagcttttgcttgcttttttctgcagtggtttcacaagcgggcttcagggttgttgctgaccgactacggaagccggatgggaccttttaagccagaaagcgagaggcatcttttagagctctacttcctcaggctcaggccgaacagcaatctctttctgtaactaacccaagctcttccctcacgtaatttctcccaggagcacataatttctcccaggattcccggcggcatttgtctgcaggcacgttacatcttcactctttttcagaaaccaccctccctgtcctttcctctttgcctgggatgaatccccagtcccccatatgttagatgcaaagatccaaggcaatgaggttttcagggtctcaagactagagctgctaaaaagtttagacataggtagagatcccaacaagcataggcacccaaaaagggcaaagcattactgatggtaaaacaaagggctttgaaatctgacacacttgtgtttgaatgccagattattagtatactaacggtgcaccttgtgtctaatgtttagctacaacaaacctcggtatacttatttctgaaatgggaatcatagtgagttttgaggtttagaactgatcagtataaagaactaggtgttcaataagcaaatgtcatgtctttgaaatgaaaatgataaacctacgtggatttattttccctttattcatctttggaattggttgtaacagataatttatgccctacatgccagagagtgttcacagccagtctgttctgactgatgcagatctctccagaatatgctcacagcaccaagcacctctctgtaattgacaacagctgaaagtttctatttattaatgtatgtagtttaaaatgtgttttctaatagactgtaaacttcttcaggtgaaggactttttttttttttgcatgaatgtttccaaggcatacaaagattcctagtgcaaaattagcacacaacagataaatacattaaatcaaattttaaaatgagccttcaaaaatggttttcccatttcacaggtgagaaagctggggctctgaaagaacagtttttctaaagtagcataggtagtacagagggtctgagattcagaccaagaagtgattctctagagtcaatattagtttctattatatatgaaatagataatatatcattactgtcatttttcaatcagtgaataaacagaagtccagagaatgttaaacagatgtttgcagagttggggctcaaacccaggcctccaattagatgtccattgctcttttttttttttttttgacctactttcgggtcaccatgaaaaccattctcaggatattcctaccttaactttgctcttggctggctgtccaggatttgcttgcctaggcaggagcaaatcttttttccactgtatgaatttgtggagtcagtagtcctgccagagtcttggtttggtcttggttgaggaggtagctttcagctatcacctgcttgcttgttctagttttgctggagagcattttcccctcaacatttttggcaggcagccaggcctttttattatgtggaactgctcctcaggacacaccacaatggaatgtcagagtgtgatgctgttgggaggttaagtaaaagaggtcacaagtcttgccagctcaggggcaaagaggtgagctatctgaccctagcatctgctgcagcactgctgtgagtgccacagttggagacatcctggcacatgtgtctttgggactcaggtgtgggctctgtgagttgtggactcttgtaagccaactctggttgcagagaggctggcttcaatcaagcacataggaataaattcaggagacaatggaaacctactctgtcttggcaatattaaatttttgctgagaagacttgccttgatcatggagaatgaaagagggactattagtctgtttgggctgctgtaataaaatactacatacgaggtgacttataagcaatatatttatttgcttctcacagttctagagatctggaagtctaagatcaaggtgctggcacagtttatatctggtgcgggctttctgtttcatagatggcacctcctagctgtgtcttcacatggtctctggagattttttataagggcactaatctcatttatgagagcctcaccctcatgaactagtcacattccaaattgtgcacctcccagtgttactgcattgttgattatgtttcaacatgtcagtactggggtagggaagacacaattattgagaccatagcaggggcttttcctcttagcccagtacttgtactttacctatgttctcattgttcagctcccacttataagtgagaatatgcggtgtttggttttctgttactggaacacaggatgttctaaatgccatgctgagggtgaggcctacaagagtaagccaagcagagctcttgcccttcagaagcttatagtttagcagaggaaccagataaatcaaaacaatgtataagttttgttaatagttccaaaaggaggaatggtggtttttcaaatataaaacaagtctttttccacaaggctactgcctggggaaccatttctagatgggtcagggaggcccccagatgtactttttagatgctcaatcatgagaagagttggggtttcctagggaggggctaggttggccagaagctatttggaagctatttgttcccaggaagggaacaacacacactgacacctctcaggaggatgggggaagggagagcatcaggataaatagctaatgcgtgtggggcttaattcctaggcgatgggttgataggtacagcaaaccaccatggctcacatttacctatgtaacaaacctgcacatcctgcacatgtatcctggaacttaagattaaattaaaattttaaaaaagaaaaaagaaccaaaaagagagcatcttgtgttctcaagaaactaaaaggcccgggcaggtcttaatagagactaaactcacagcattcagtgatgtactggaaaagaatgaatgtttgaaacagtgtcatcaagctttacacacctataaaattgttatgcctgcttctaaggtggagtgtgtgctgggcagaagcagtaggctatccccaagaacacatgagtcagtggggaatgagagaaatgacactcccaagggaaaggcctgtgtgaaccagggagttcacccagggtattctgagacagggtcttgctttgtcacccaggctggagtgcaatggcatgatcatagctcactgcagcctcaatctcctcggctcaagcagtcctcccacctcagccttctcagtacagtttgtgaatttgaaacaggttagttcttggagtgtgaatatgcattcaatagtttggatgtgtttctgttttccaccgggcaacttgagtagctttagtttgtaagatcccagatagcgttctcttcactgatagttattatccgaatacctttgtaatgcctgagtcagtgcagttttgcatgagttccctggagaataactttcatgagctaacaccactttgatagctttccctccctttctactcttgggaatatctgggacataggctgagctcccttttcatagagttatcttaagaagcgagattaactatatactatgtaatgcatacattaaacaggaggaaactagattatatggagtcatttaaattgctagccaattttatgtgttggctctcatctcatctacagttttagactttctgtctttctacgtgctcataaagaaaaccctggatgtggcctggtgtggtggctcacgcccgtaatctcaacaatttgggaagccgaagaggttggctagcttgaggctaagggttcaagaccagcctgggcaacatggaaaaaccccatcctctgcaagaaaaaaaaaaaaattagccaggtttggtggcgtgtacctgtagtcagagttacttgagaggctgaggtgggaggatcacttgagcccaggaggtagaggtgcagtgggctaggattgtgccactgcactccaatgtgggtgacagaatgagaccttgtcttgaaaaacaaacaaacaaacaaacgaaaaacaagaagaagaaaagagaagagagaaaaccctgggtatgtaaatcttgttgacactgtctcaaacattcattcttttcaaggacattattggatgatgtgagtttagtctctattaagatctcatttgggtacccttttattcaggtgataaaatattttgttattaataatattttcattgagtcaatacttattatttactgatctctcattatacagcatgtgttttaaataaatcacattttattttgataacagaacactaaactaggtatttgaatcctgatttttaactatgaagaaaccaaaagccggaaaggtaaaatgatctccagcaggccatagagctactgattggtggttctgggactcaattcgaatctgcctggctctggctcacaaaggcctttcccttgggaatgccatctctctcattccctgctgactcatgccttctcggcgacggcctacttcttctgcccagcatgaactgccccttggaagcaggcataacttctttacagttacattccagagcagcaatgctcaaatttggtggcaccttagaattacctggggagctctaggtcccacttctagctatcctaatttcgttgttctggactgggactgagcatctggatttatgaaagttttctgtcaatgtggatatgcagcaaagttacaacaattgttttagagcagtggccctcaagtagaatgtgaacacaaacctcctggggatgtgttacagaaaatcctgattcagcagaattgaggttggacctgagatactgaatttccaaaaagcccccagtgatgctattctgttggcctacagaccaagacattgctggcaaggccccagaatctccccattttctctgcatagcccgcccatctcctcttttccaggtcacccttctcctgggagaaattctccagttcagggtttgcactgtgttttcaatgtagctgttctctttcagcagctcccgttaatcattggaaagttccatctcaactaaaactctctgttagctgagtagaatagggggtggcatgtaaagaagtcgaggtcacaagatcaatacccaagtttaatacccacagggaccagttagcttttctgtgccctgaacccaagtctccaggccagccatggctcagatgtatgggattgtccctgagagatgaatgcttcatgtccatcacacatgcaatacttaccagaacagcagccacagtctgactcccactcgctcaaaggtcaatagcatatcttgataggaaataaagacacagcaatgttagctacaatcgggtgcttacctgtgccaggcactgcggtaaacattttagaatccttgcaacattctttgaggtaggtggtctcattatctccattggataaatgaggaaatggggttcatggttttcaccttctgacagcatgcaacctgtagataacccaaaatccaaggacttaggccagtatgccgggtgctaaccaatgtaaattagggttgataaaggatttgcagctctttggcgttggaaacttcaaaatatgtttttctaccatgtccctgtcaagcttcgttaatctcggcattgtcccctctctcaatttatactgatgatgactgccttgtttatttattgtgtttttagagaagctcaaattagaccatccgtatgtttaaaaagaaaaattgaagaactgcgtaatattgggagcattttagcttcatcgaatctgtgcagcaaatgtatccacagatttacctaccataatatgagtctggtccttccaatctacccctcttttgatttgtcatcagtgtacaaggtcataattctcatctaagagcctagagatttccccagtcaactttgttttattctaatgtacctgactagtggagtctgcaatatttctataggttaaagaaacactaatgttttatttttaagtgaaaaattcaaggaaagctacatcttttttgctttagtgttcagaaacacaaatttttgatatttataatgaatactgactaataaagactacggattgtataattttgatgtttgatgttagtttgtttatttgagacagggccttgcttgctctgttgcccaggctggagtgcaataacgcaaccttggctcactgcagccatgacctccctggctcaagtgatgctcccacctcagcctctcaagtagctggaactacaggcttctgtcaccatgcctggctaatttattcttttttcatatagacaaggactcaccatgtttcccagactagtcttgcatgcctaggctcaagtgatcctctagccttggtctcccaaaatgctgagattacagacatgagccactgcacctggccaggacagtatcttttagtactaaagacaaactgctaaaaattaagtaccagatagcaaaactttttagaagtattcaccattagctttctctgctcaattcaccaattatactctcactgtaaatcaagtcaatcaattagtcaacagatttttattgaaaactctatacatggggcactgtgttgagacccaggaattgaaagagcccaatctaaggcctcctcacaaggagatgtgaccctttcttgtaaatagaattttaaaaatttaattgtttgcttcctctataaattattttctcttggtgtcatggaagatctataaattctgataaatacttttattttgagttaacttccttcagcatgctttggataataataaaaaatggaactcatgattcttgctattttaattaaattaaacccttgaaacccccgtctctcaagtgattttccactcccttctatgggtttatttcctaataggcactttattactcttgaaagtcatttatttattcctttagatacactgcccgtttttcctgcaatgaatgtttaagttctatgctgctaaaagtttcttcctggtttggtgttcaaagccaagaacagtgactggaaagtcagagaaactcaaccaactttccttgaatgattgtgtgaataaatgaaaattggctatgaatgtagtagaagtgaattctagccctagatgacaagttaaacaaagatgcctttttaagtcctctgtcaaaccataagactttagaattttacaattcagttttctaattaacaatgataaccactacttgagcagaccaatatataatcagaggggttaggtggccagtgacccaaagatgctagtcatcaaaacagcactcagtattgacattttctctgttgtattgtgctgtgtttcagtcttcaaaggtgtctggtatatatattttactttttaatcttctaaagaccgtttcactaattagacacctatcatttttggcaaagagccaaagttaaccttcactgtattgctctaataaagattgtttttaatgaaataggtgactaagctattgttaacaatctagagtaataaatgtatggaggattttcagctgtctaaagaaagagttaagtgatatagatataaaatttgtttcacatggcttaaaagtgtagacaattacagaagaatgtttaagggatatgaaaatgtataaggttgtgaatacaaatttgtcatcagtctccataatattaaaataaaagtctatttcttgaagcataagaaaattgtttcagcattagaagaaacgtaataaaatgaaatctatacatttataaccaattaccacttacgaacattcattgcatagccagacagaggaccaggccttcaatgtatattttttaaatgttactgtaatcctgtgaaatagatatattgccatcattttacagctgaagaaaccgagagctggacagattaaagaattaatgtgaagctaaatctgggatttgaaccaggtatccttcctgtgccatgctctttgcctctacagcattgcctcttgtgggtctggctgaaattacacacagtataaacttgatatttgaagatgcttaggtgtgtgtacacttttacccagtagtgtggcttttgagaaactctacttgtgggattatgagtactttttaaattttctagtttatatttattattccaaatttattcaagaaatatgtcacattttaaaatgtgcatctaaaaatattcattgggttttggggagggtgtttataaatctttgaagacattgcaaagggtactatctgtgcttccctcgacttccccttggaactgctgtgagaaacaagctattaggccgggtagatcgctggtctgactcagcatggcatatctgaagatgaactattcactaagtcatattgaatgtgccttccagtcttatagccgttcctgaaactcgatagctaatagaatgccatattcaaaaggcattgagcactgttttccccagtgctttgagtttggaaatcatgatataagttattactacaattattttccaccttcatctgccaaagaaagtgaaatcaattcatccacatcttgactgcaacgctgttgtaaaagatcctctacctactctgaacatggatctttaaaattgaacctactgatgcaacataaattttagaaaagtcatcttcaactgccaggctggccgcagtactatttaaaacatgatttggggacctctatttcaatttccattactcacaggtcacaagtcttcacctttgtttaggcaagtcctagactaatgctctcaccgaacagaatagttctgctgtcatccacaggttacttgacctctctctactatagtttgttttcgtgtaaattgggaactgttccatctgcaattcactcagtaggcattttgtgatgctgtttgtcatggtggtcctatgaggaacccatgagtgtttcatggtcctgaactttattgaagttacagaatgggccctccttctgatttcaactcttactcaccacaggcattgcagaggccctgagccatgccaagtctcatcttccttcctttatttatttatttatttatttatttatttatttatttattttaagcagggataattgtagatgttcctcatagagttgttgtgaataggaaatgaaatagtatgtgtgaaaacttgccacagtgacagtcacagagtgagatcctcatgggcagtagatgcaactgagcagagatataaatgccaatcattttgaatgtgataatcttgtatttattttgtaattaataatcttgtagtaattattgtttgttttttgttgattcatataatttgatttgcgtatatagtcattgttgaaaaattggcaaagagaaaacggaggcagagatatctccacagatagattctatcactgctacctacaaccattttaaattactgttaaaattttggtgttttttgctttcatttttattaacacaatcaatattttcactgatataattatatatacttatacaagttttatgataccttcttcattctataatgaaagataaacacttaatattgctattacaaatactggcaactattaattaatattttcagtctgtatgtaattatttttatctatttagaaactatagatagtaaattaagaaaaaatcagtatttgtaattctgtacaccagagagagccacattttaagatattttcttctgtttttttttttatatgcgtagacctatgatttaatctaagttgccagtgattgtcagacctacaattatttcctaaggagaaaaaaatgctgccaaataaacactgacacactgctttgtacctcttagaacttctgttttgtatgccttgaaatggccttcaaattatataggcagaggtatttattgtagtatcagtctcggtcatacattaaaaatagatgcaaaattaattgggtaacatattcctcggacaaaaccacattcacagtctgtctctcttgactcctgtttggcttattcacatctgtgtccaacatggtgtggtcttctgtgctgctgtttctcccaagtaaacaatcttttttcaatgttgaatcacagcataatattttaaagccattttaaatagcaattaaacttaaaattgactcataaaataatgaagctgtgcccagctttgcccaagtctacacagttttcatgtggccaagcacaatcatatgaggaccaacagtgacctattgacaggagggtgcaccccagttttaggcatgctacagtgcaaaaaatatacacagctagaacaacttgaaaaattacatattttttcctttagggtgctttatttagttttatctctcttttttttattcccattcaatattgagaacatttcccagtatctttaagacccttagaaaaaatctctttcaaagagatttcaaatgctcttcaattaatgtagcaccaaaagccttcagcttttgaggcttttagaaaattacgattattgaaaacaaaccttacaaacaggaatatattgaagattattcctacaaaagcaaaggaggaacggagcaaattaaatgatggacactcagatatgtacaaaatttaattttaaaaacccataattacatgttggaatctcttgacttctgggaagaatattttgatagagctcctatttttaaatagataaattcatatcttatatcagaaagaaataaaattgagaaagtctatgatttcacataaacctcaatctgatcatagattgaagagaagcatagaggcttatttgacaagttttattgtataatatttttattaaagaaagatattataaaaggaggagaaaacacttcgcatataaaatatttgactgaaatatgttaaaaaccttatgcaaaaatattagaattaagaatatcctccacttatcaatgtttttctgaattttgcagagatctcagcatctaaagacagaataaataatatcgtggtctacaaagaagccgcaggtagttatgtcaacaatttccaacatataaattttaaactataattctgaagaaaactgtaagcagttttctataaaaattaccatattgaaagatatgtttttcagaaaaatgcaataatgaggtagtagagacagagctaaagtataaagtatatgaataagcaaaaagaataattgttattttagtttttaaaaataattttattggtgaaaattgttttatttcttaagtttaaaaatcccaccaatataataaagtcagtttgtgattcagcaaataaatatttttaaaaatttttaaatttttttatacttgaaaatcatctctcatatggtgtttaatatgatatttaaccctttccttactgtagatcatttaggatagttctacttcctctactgtactcaacagaaatgggtatctctccctttgcaattctgatcattttgttaggatagattccaagtactggaatttctaaatcttacaaaaatttcaaaactgaattgcattgaatagtattctctgaatatcaagaaataaaaatattaaaattccaatgcataatttaattctatgcataatccaatgtagttaataacaatccaatgcataattgaaacaaaaatattttgaaataggttttaaataactaaaagaatatcaatagcactttgtagtaacataatgttcagcaaattatatgaatagaacttgtgaaaattatttttaaatagttataattttcaatcaattatatttttaaatcaaaggcatttactaggtattggccgtgttctatgcattatgcatacttctctctgaaaggaaaagaaagaaaagatcttgttcttaagagattcttctggtagtgactgaaatgcatacaccgagataatcaccataatcctctacaattgtcctagtaaaacacccgaggacagcaaacacagagactgaccaatctcacctgcaggaaagtaggactgggaccaagcatgcttggggtagatttcaaaggaagcagtgagagtggagctgagtctggggggctgagaagtttgatagcagagatgagaaagaatgtagatatatagggacaacatggatgtagtcctcaaatagggaaaagcatggtgtatttgaggaacagagaccactgtgaagttgatcccaggatgcatggggctgggagaaagggtagggtggaaggaggctgggtgtcttgtattaaattgggatgtgtcttatttgtcccgacatggaagctctgattgcattaaattgcacttttctctggaggctggtaattatgctactatcccacatagcatatttattcaagaaatatttagtgataccttgttttctgcgtactagacactcttctgatcccaggaaaagagtcttgggcacaacagataaatgcaatagcaatacatgaaaaaaaataaggtaatattttaagtaatgagaagtattataaaataagtaaaacaggaattttttttttttaatcctcaggctggagttcaatgtaaacatattctgaattaacacagcaggggtctctcttaaaagatgatatgtggtctatagagtccagccatctttagtaccagaggagaagaaatctaggcagtggaaaccacaaaatgacaagtgcaaaagccctggggcaggatcaagcttggcagtttgaagaactggaggaaggccagtacctgaagttccagaacagaataaggatgagatgggtacaagaagggaatgtagaggtatttggaggcttataggtctttgtgaggagctcgaatttgatgctaaatgctatgcgcagctactggaagtttttagactaaagtaacattttccggcaacaaaaaattcgcactttcactttaatgtggaagtgagtacatgccacatatattactcagtataatgcatccatggctttatataatatttaaaaatatagctttgtataaaactagagaggagatggctgggagcgccgaggcgggcggatcacaaggtcaggagtttgaaaacagcctgaccaacttggtgaaaccccatctgtactaaaaatacaaaaactagctgggtgtggtggcgggattacaggcacccagctactccggaggctgaggcatgggaattgcttgaacctgggaggcggaggttgtagtgagcggagatcctgccactgcactccagcctgggagacagagcaagacttcatctcaaaaacaaaacaacaaccaccaccaaacaaacaaacaaacaaacaaacagacaaactagagaagaggagagcttgcacatggttctcaggttgatttctttttttttttttttctttttttgcataactgtgaagatcaatttggatcgctactaactctagttttgatcatttgggctcatgtttggcagaggtgggagagtcgtttatatggaatggattatgtggtgtacagaggcctaccaggtagatacctcagtttcagccttgtatgctcgaatatatagagaagactttctgacttttctttcagtacaatattatttgagaaatgagttaattttccttctgattgtccttatggcagtggttactgaggacagcgaaaatcacctggtgaccattgaataggtctgggagacaaaattgagtgtggatcttcttctgtctgtgtatttatagatgttgtttctgtgtgatacaaatgagttttcattaattgacttaaaaataattagtgcttacaacaaatattttgtcaggaaagtaaaggaacaaaagaacggctactccataggcaaagaagccccaagacctgctgtttgcctattttatgtttatttctaaacaaaaggtggattattcatgagttttccaggaatgaggtggacaattccagaactgagggttcctcccaattttagaccatatagggtaacttcctgacattgccatggcagttaccatcattctgactttgattgattttcactcaacctttttccaagaggtaatcatctgcaagaaataagtgattaaaggaattctttaggaaattaataataacaaaaagttttagataatcctcccctgagcagtatattatgtttgcatattcaatgaagaaagtcctaaaacctattatgtacatttatatagtacctttcccttctattcatattttggcctattcttttttatatgtatatcttactagatccattcatatcatgcaggctgctattcacttgattatagtgatagtgcacttttttttcatgcaatgtgtcaaggtaattaatattagctgctcacaacagaaaatcacccttgaaattccagtggtttaatgccacaaagatttatttctcaggtctgtgattgggtggccattcaccatcttgtagcatgctgcttagaacaagcaccctgcaaagttgcaaaggcaagtgaaacaaaacagaagatgcagagcggctcttaactgcccgcaaatggcccacagcacacacccttacagagtactgggcagatctggtttcatggctaagtgtaatggaggacatgaaatggatggtgaacactgtctttgtcaccaccagcctttctgtcaccaaatatctgctaccctcttatacatgtacactcccatcttttcctgtccctccactcattggtggtcatgatacaccacacttttgtcattcatgcttttgaaagtcattccaaagtgccatccaattaccttgtctacttccaagaccacgtgtgtggtagtgttttcataaagtcggcatgtggcctctcttagtatagagaccttgacttaaaaaagaaataaaattaaaaaaatgaatatcatcccttctcctcaataccccctctccccataaatgtatacacatatatatccaatgtgcaaaaatagaacaggaaaaggatagctgcagtaggcactgctattcattcagagggtgagactggagaagggctctctgccactcaacagtccccagcctgcagccgttctgcaatcctgttcagcaaacgttgcaacatcctcctgccttggaaaatggaagcttgatttgctctctggggcagctcctttgtctatcactatccaggctgttagactcctctctggaaggttattcttttcctattactttctctggcatcagcaaaaatggaaattaggggatatgccttttggggttatactttctcctctcacttcctatccacagaaagttagagccacaaggaatattttaagcaccaaatattaaaaagtccttttggtccaaactcatggtatgtttgataaaatatttgcctcaaaaactaagtgaactactggtcaatatgcctggttctccgtgccggtaaccacacccacagttctttcggaagttttgacttccgtcgcagcaccccctccctgagcctgtctctctcaatttgatttcaaataatctttctgggaaaatgcacaggaatgatacaccctttggatctttacactgaattgctttatctaactgagagattgtactgggtctttgctgctgaaaatctttataaaatcctatcatttcttttggttatctagaagcaccgttttttccaatcaaaaagttcccacatttctgcaatcttccaatgtctcctgctccctcatatatacaatcttttttctcttttttctaaatcttaccacacacagctgatatactcttctgatttgcagcttcttcccttaagacttaagtcctctgtgcatatagtctgccttcaaaggtcatgatttcaataaaggtttcaccatcaccagacgtagtctccatctttccaacttccattatcaggctccttgccacccatcggagaactactaagccaggcaatccacatccaattatttattattattattattattattattattattattattattattattattttgaaatggagtctcactctgttgcccaggctggagtgcagtggcgcaatcttggctcactgcaacctccgcctcccgggttcaagcgattctcctgcctcagcctcctgagtagctgagattacaggtgctcaccaccacgcctggctaatttttgttcttttagtagagatggggttttaccatgttggtcaggctgatctctaactcctgaccttgtgatctgcccatctcagcctcccacatatccaattatttactggcactcccttcttccttttttcttatttgtttcttttttaaaacttttattttaagttcagggatgtaaatgcttgtttgttacataggtaaacttgtgtcatggaggtttgttatacagattatttcatcacccagttattaagcctagcactgttcccagaccgaactgagggtcgggctgcttattttcatggcccaaaaatgagatgaagatgagctgggaaagaagggagtttatgtctgtaactgggtacagggagaaggcttggaaaatatcaccagaccaactcaaaattacgaagttttccagagcttatataccttctaagctatatatctatgtgtaagtgttcattcatcaaaagtcataagtgattaacttcctctaaactataactaaggtctgagtcctgaagaccttcctctggagcctcagtaaatttacttaatctaaatgggtccaagagctggggtgattgaccttatcttgtctcctgctaaatcatgaaggtttggggagttttttcagacccccaataaacttgttgtggaggccttgggagttccttcagaccccccaataaaacttgtttaatcctaagtgggtcctgttaagaattccttcattatcttgtcatacttcaagacccagggatggcctaggcaaaactcttggtgggcttttgttaccttccagcctttttgtaaggacactggctctatcagcttttaatgtttaacttaaccacttagtgctgaaacaattgttctagaggcctgactgctgactgttcagccattaggaagacctggcctgccacagtgtcataggactatctccttagtttagctaaacatgggggatccttgtcacacagccatgaaaaataagtctcgcagacaatttgaaggggaagaaaaatggaatttattggacaaaaaggaaagaaaagggaaacagggacacgtcacaaacccagagagagaatcctgctagtatatgcttcccacatcacagattaaatcccaggttccacgcaggaagaggaggggccaggctcttccccactgcaattggtgcatatttttgtggctcccccacagtgtgcattcctcccagtgcacaggctggttggagtttctcaggggacccctttttacccggctgtctcaacagtactcattagttatttttcctgatcctctccctcctcccaccctccaccctccaaaaggcctcagtgcatttttcccttctatgtatccatgtgttctcattgtttagctccctcttataagtgagaatatgctgtatttggttttctgttcctgcgttagtttgctaaggataatggcctccagctccatccatgtctctgcaaaggacatgatctcattcttttttatggctgcattgtattccatggtgtatatataccacattttctttatcgagtctatcattgatgagcatttaggtcgattccatgtctttgctgttgtgaatagtgctgcaatgaacatgtgcgtgcgtgtgtgtagaagcacttgatttcaagctaccaatttccatactagtctaagtaattaatactaactgttcatggaagacaaacttccaaactctcaatgttgaatgcagcaatgtatttctcacattataattggatgtggatgaggcatccttccttcatctaaagcttagccacctggaatgcctggtgtctgaggtcacaaagaccatggtgaagggaaggactaatggatgtgttaccctagcttttaaccatcttgtcccatagttaatacacaccactcttgcttgcgtctacttgctggaactagtctgatggctccaatctcaattcaagtatggctaggaagtttaggagaacacatgtaatatttggtgaggattaaatctctttctcacactattacaaatcagctttcctttgtaaaactgctttcacatccatgatttaatattaatttcaactgtttcttagaggtgagacagcaaagtcatgactcattccagctctgtggatgagaaaatctatgagtatccacctgtctttgattacactgacttccgtagcatttcctcttatcttaggtttactgcacacagaaatctgttttcttattctccaaacactatcactgaacccaaacatttccgtaatcacaaagacacataatcacaaggaaggcaaataagtctgataaactataacaagtgcagagtcacctcactgagtctataggaaggatctgctggaggaagggtggtttaagctgatgcatttgggatggataggaatgagtcacgtgaagataggagaggagtgtagttctaggcatggagcagagaatagagcaggctgggaggaagaagagcgtaagaatccttggtacgatggaggaaggtcatcaggtctgcaatgcctcctgtagaggggacagcagtggggctggaccacaggcgagtggcagggatagaagcactggcaggccacatggaagaggttagtttatgctgaagatggaagatttaagcaaagtagggccaggaactttttcattcccttgccttcctccattgctctgcaggctgcaaggacttagaacaggtttggcctgagggacaacagcagcttttcagcaggcagtttctccagatgattaaacaaaggtaaccagagggccaaagggcatgactctgctgcagctttcaccttgaaacactgaagggaaatctacttgcccacaggaaatacgaaatccaagcattctagatataatgtatttctgctttggagaaaaatatatcctcaaatacttcagtacaaaataccacagtgaaaagttttaaaacatggtatgcttttaaacaaaatgagctccctgaagaagctgcagtatctaagctcacacttgtttcttcttgaatttgtgatttagcagttttgggattaggcatcacgtgctttacaaagatgttgatctgtaattgctagtactgactcttttgctttcatgatggattatataccatttgcaattgatagtctctgaatctttattttctttgcaaaagtagcatgtcatctccaaaaaccggacagcagtgcttgctaaataaagtgtagtatcgatcaacgtgttaaactatcatgcctttcacaatttgcgaactaacattgcactattcgttttgctcttatccatcacacttaactcttgcctgcatttctgctccccaagcagggacataagaaggcaatcactagtgaaggatttatgcataatgtggtattcttggctatcctcatatagttaaatttcattgatgctgttttggaaaatgactttataatgaggtgaaattatgctgctcagcttggcttactacctatagtgctatgtgacactcatgtacattatactccacaaaagaaagcaggacacactcatatcccattcactgtgtacttcctaaaacctcattcccaaaagcttctattcaaaccatgtttcatcctctcccagatcttggcactgtatcaggcctatgatgatactcctgatgcaacagcaactgttgccattttgcctctgatctcttgggtgactaatttctggatccaccttaaaaactccacttcagattattgttggaggacactcaccacaggtgactccttacgggaaaatgtcactgaagtactgttatggactatattttattatccccaaattcatagattgaattcctaacttccaaagtgactatatttagagataggacctttaaggacataattaagattaaatgaggtcataaagtgaagctctaatccaataggactgatgtctttgtaagaagaggaaaagaccctaagatggcatacacagaggaaaggccttgtgagaatgcagtgagaaggcaactgtctgtaagccatgtagtgaggctgcaacagaaactaaaacagctagaactttgatctgagatttccagtctccagaactgagaaaacaaacttctattgtttaagccacatggtctatatttggttatagaaattctagacaactgttacacagactatatactgttaagaataaacaaataaataaataaataagtaaaagcatgctatccctatccctttgctctgtttcacatttatgtgccggtcttagcttagtttattctgctataacagaataacacagactgggtaattttaaataaacagaaatgcatttggcttatgggtctagaggctgggaaatccaagagcatgtctctggcatcttatgagagtctttgtgatgcatcatcccatggcagaatgtgaagggacacggagggtgagggcaagagagtgagagaggaaaagtactaaacctaccattttaccaggaacccactcctggagtaactaactcactccgcaaaatagcagcattgatcccttcatgagggcacagcccttgatgaccttaatcacctcttatcagtccccacctcccaacactcttgcactggggattaggtttccaacatgtgaactttgggagataccagcaagccacagtggtacccatttttgtcatctgtagatttggctctttaccctgaccaaagacttctgggcttgagtaagctgagtgtgttgcaaagagtacttagtttagaaagtagctagtccaatgtgaaactccttttttgcctttggtgaaatgaatcttgtcaccagattctggcctggatcttgcatgtttactgctcagagcttcttcctaggaattaaatcctttgttgctctttgttttttgtattctgactacgtagatttgctctttgcctacataaagggacaaacccaccttcctgttgttcctttcttagctgatctagctttttgtatttgactgcagtccccccttaaattgtgttttccaccagcttccactgtgttgtggaaacaccctcactccttctcatgaacatttgggaggtctatttttttcattttttctaagccctgctgaatcattaccagcatatggggaggagggaggcagaaaccaagtatcactcccctgaagctactcaaacaggacagtgtctgtttggacacatagccagagtgttatggaagaaattcttgtaaactatgtattcagtcatgatacacatttctaaatggtgagtttcaaaaatagatgattccaccttgcaaacttgtgcaaatgtatataacagacagagaagcagcagcctgtccatgtcaacagccatagaaaatgtctgacacttcctctgaggctagaaacagctgttgatggagctcacagcaaccaagacaggtgttcaagttagaatcaaacagttgtcaaaatttctacttctctctgtttctttaaaacatcgacacattgaagtgtaatgtagttttcagctattaatggaattaaatatatagattatctaaaagagtaaaaaaggtttaaaagagcaacttatttgggatcagttatttccacatgatgaggcatgacctaactcaccttctgaatcataatcatcataataataacaataataacagactgggcaccatggctcacatctgtaatctctgcattttgggaggccacagaggggcatcgcttgaggccaggagttcaagaccagcctaagcaacatagaaagaccctgtcattacaaaacattaaagaattagcccagcatgattttgcatgccagtagttccagatactcagaaggctgagagggaggatcacttgagcccaggagtccaaggttacagcaagctatgtttgggacattgcatttcagcctgggcaacagagtgagaccctgtctcaaaaagataaaaagtaaatacaaataatcataaattttattaatgccaggaactatgctaggtcctagggagatatgatgctcaagacaaaggctctaactgtatatattgtatactttagcaactttataagttgtatactttggcaacaaggataattgaataaataactaggcaaatcattagaaacataagtaattataatttctatgctaaggagaagtactttgcaaagggagaatttataaattgagcccttgacctagggctggggaccaagaaacacttctgtgaagcactaacatttgtgctaagatatgaaatatgagaggggataaccacagggagaaatggcaaagtagactctgcaagaaaacagatgatataaaaacactgaaccaagaattgttcattagaattgcagaaggttataggagccagataggaaggggccagatccttcaggtttctgatggcaatgataagtaattagttacttagagttctgaaagcactagacagctgtaaagaattcttaagtagggaataatatgaacagaacctcctttaaaaaaataacattctggctacaatgttgagagtcaattggaaagagacaagaacagtgatgagaaaacgaaggaggaaactagtagccatcaacaaggaacagtggcatctctcagttcatgccatatacaaatggccagaggcttcctaatttgcttcctaattttcaaaagtattctcaggacctaggtgtttctttgaagatgacctcattcattcattcaacctccattgtttgtgcactgaccctatgcgaggcacttgggttcgcggagggaatgcacagccctggcccccaaggagtcctctagggacaggtaattgagttatggtagattgggggttatcccaggagtaaacaaaagaggaatagtcacactgcaggccacatgtggtggcacacacctgtaatctcagcactctgagaggccaaggcaggtgagttgcttgagctcaggagtttaagaccagcctgggcaatatggtgaaactccatctgtacaaaaaatacaaaaaaaaaaaaaaaaaaaaagtggggtgtggtggcacacacttctagttccagctactcaggaggctgaggtgggaggattgcttgtgcccaaagtttgagactgtagtaagctgagattgcaccactgcactctaaccttgatgacagtctaaaaaaaaaaaacagacaaacaaaaaaggtgacactgcaaatggcacctaaccagaagctggggagttaggaagtgtttcacagaggtaatgctggtaatgcacataagcgaaggaagaatgaaaattatccaagtgtttctcatgagtattggctgttacctataagttattagtttgacatttaggaaagttgaaagcaagaccctaaaaactattttgcttagttatgtcattttttttaggagaaaaatagttaccatgtctgctatggcttgattgtgtccttaaagttcaagtgttggaaacttaatcccagtgcaacagtgttgaaaagagaattcctagtaagaggtgattaggtcattaggactttgtccattactgttatttcaagtgtgaccttgttataaaagtgagtttggccacttcttgcccttttgctctttcattctctcttgcctttctgctttacattatgggatgacacagcatgaaggctctcaccatgtgccaacatctttatattgaacttctcagcctccagaattgtgagatataaatttcttttaaaaaataaattacctaatatttttattcttttatagcaatacacaatggaagaagacaatgttgttttgcctgtgtcccttatggcacattttattatttgcctatatatgtctctgctcagttctcaaatattgtttttaatcaggtctcatctttcctactcaaactaatttccagttctttgcactcttcctgcttctggtgtataattccgtctccttagcatcttttattagtcagagatcgtgagattgcatttgacagaaccacaactgaaatggcttagtaaaaacaggaacatggttagtttatctagcttgtaattgaagactacaccagttcaaggcacctctggatacaggaatcaaataagatcccagctatgttgttcctctcttcctccccaaagtgctcccagtcgctcccaccctctcagtctcagccaccctttctgcctctcacttctgcttcactcccaggcagatctttccacctggaagtgagttagacacaagcagtcttaggatgacagcctaacagtgtgtcccaaacagaagaaagcagtctttcccccccaaataagtctatggaaattcagaactgagctccaaatggtcagagagttaatgactctggccaggaatatgacctatgttggttgcccagacatcagcccacacacacactcctgacaaagaagaagtgtggcacctgcttcacacagatggcatgagctaacagtgtgcactgcacaggttctctagagagtgttgaggtgctatcaccagaacgagaatgctatggaacaatctctaccccagaacacacctgcatggtcatcatggtcatgtatttgcaaacttggtttctctctctctctttctttttttttttttttttttttttttgaggtgaagttttgcttttgtcacccaggctggagttcagtggcataatcttggctcactgcaacctccgcctcccaggttccaatgattctcctgcctcagcctcctgagtagctgggattacaggtgcctgccaccacgcctggctaatttttgtatttttagtagagacggggtttcaccatgttggccaggatggtctcaaactcctgacctcaggtgatcctcttgcctcagccttccaaagtgctgggattataggaatgagccactgcagccagcctggtttcccatctaattctctttctcccgtggaggcagggatgaagaagattatcttagtccaggatgctattagcctggatggcttgaataacaaacatttgcctttcatgactctggagcctggaagtccaaaatcagggtgccagaatgattgggtttttgcttactgccttcttactagctatattgtcacatggcccttccttggtgagacagagagaaagagagagagagagatcttgtgtctcttcctctttcataaggacacaatcctatcatggtgctccattctcatgacctaatctgatcctaattagctcccaaggtcccatctccaagtaccattacactggggattagagcttcaacatacgatttggggaaggacgctaacctactgtctacaacaaagctctactcactgaaatcacctacatttgcttctcctagaactcatcttgctgggcattgcttccaccttcaatttttgttaccaaactggagcactgtatccaggacctgaaatctgtgaactcaagggtttttggctttagcctcagccattatttttctattggttgtattctgatataatgtgaccccagattcagaaagtaggaagacaagttcttgctttgggggctgaaatgcaaactgaaggtgaaggaaggacaatgaatgctcagttggcatttcttaggtttcaagcaaagaagaagagatacaggtggggaagcaagtgatgatgtagcaaccagattatgtagttgttgatactcactgctttatttcccccactggccctccatagctttaccagagtcttccctaaacctggctggcagctgattagaaatgccaaatttctaatgccactccaggcctgctggatcagaacctacaatatatgacaaagctggcgggtcattcacaacaactttacagttagagaaacaccgctctgaaagtctgagtgccaggtactctgtggttcagggtgtggggagagatttgagatcctacacttggctataatgttaatgggacataattatttactaagctcctcccacaagcaaagtgaatttcaaggaagaaatgttgggcttacatgaacgtctcttctctttatggaaagttacttttcattgctaatattggaagactttttttttgtaagaaagttatattttctttcctgtagaccaaggttagttgtgacctcacatacctaaactgccagtcttggtcattaattcacaccccaactctgcttacaaaccgtttatccatcccctgccctggtttctaacatgattctttattacctgctcagctagcagactaaatttattcaattttcttttcctttggcacaatcagccaatcccaatgttgcaaactaaaatcaaaccagatgtgctaagaattttattgactattttatgtaacaagctgaatgaccagaaggctcaaaccaaattaattgaaaattaaagcagagaagatttaagccagacactatttaaacaggcttaaaaggttagcaaaggaaaagcacataatcagtttgtttgagtgataaaataagaagttaagctgaattggggagagaaaacttgcctcttgaactgtagatttatcttctaaatgaagtatcaggtgttttaatgtttttgcaattaaaaatgaacaaatatataaataaatataaaagcactaactgggccaacttcttgcatgttacactgaaaaattatctggtagatttgtaaaattgaaaacagaagctttgggaagtagtaaaagaatctgtgtctgtgaaccagagtgcactggcttcaaattcccacagaccctgtgcgtgttacaactcaccagtcaagctgcacaaccctgagttatgctccttacctgtgaatggaaatagtccagtgccccaacttatccaaggggaatatgtgccaagacccccatggatgcatgaaaactcagatgagaccaaaccctatatatgtttttttcctagacatacacacctataataatgtttaacttctaaattaagcacatcaaaatattaacaataataactaataataaaataggacggttatgacaatatactgtaataaaagttatgcaatgtgttctctctctcttaaaacgtcttgctgtactgtactaacctatctttggactgcagatactgggggcaaactaaaacctaggaaaggaaaactggatgggagggatgactgtgacagcaactctaaaggaccattgtacagattaaatgtgagtattgatttacagagcctgacatatactacagatattcagtaaaggagaataagtaatattgagggtaaaattgatagaggaggcatgtcaggagtgagattgtttgatgccagtgaacatttatttgacaaatccacttaaactgaaaaaataaagtcacctctctattttcatatttgatcttcaaagccagcagttacagtaggataggtagataatttcccaacttaataaatatggagggaatacaaacagcaatggggtccaatgatgatgtaaggtccccagccattctgaggcagagctagggctgaatcccagcttcccaatgacaaaagtctggggcctttagccagagcggtgcctcccctgaggatatgctactacgcatgtgatgtcccttgcagctgtgtcccaaggcccctgctgatgaccatgtttcccatcaagatagttgagacatgaaagagaagggctctgcatagaatcaacaaaatatcgtctccacaaggcaggcgatcttttctattccacggatttatctgaaatacatatttatcctaagggcataacaggaacagtgtcttgcctgtactaggcatcgggaatatttgttgggttaatcagcaagcatgtgcttccgtatagcaatggaaggtggctagcttacacagtctgtctgctctgggcaattttcatcttcacgaggcctgaatctcttaccttttttttttttttatgagcattaagttcagggagatggagtggttctcaaatgttagtttatgcataagaatctcccagggtgtttattgtaactgcagatttctattcctagcatcagaaactaagtcagctgattgaggtggttcctggaaccctgtgttgacattaatgctggcatattggggcaatgcattgcggtccctgatgtagattgtaggtggaagtgtgggctgtgtgtctgtgtttttgtgagtggaaaaggagggaggaggaaggtgttaagtgagaaagaaaagatttgaatgagtggaacttcctacttagtgggttggtaaactctttcccctctattaataataacttttatctccacctcccttctgaaggaaaggtcgggattggctagaatcgtaacttcccattacagtttaatttccttccttcctctaatgccccctttcccgtgcccaagccctcccttaacaaaccctcggagagagcaagaaaagaaaacaggcctcctcaatttccctaatgattcttttgaaaagcctttttttttttaaatttgtatttttagatctcttcaaacaatgttcctattagaaggttgtcaaaggccccgtgggatttatggaaattttcattaagaaaaatagggaataatttcaaggacagtgtctaatgtcataaaaatggctatttttaaagttatggataagtagaagaagcttccttacctcatgaaccgcacttgcagtgggagcttgaggctggcaggtggcagagggagacccacataggtttaagcccagcgctcagcagccccagggccttgtgcaagtgcctaaccatgctgagtttaatgccagtcctcgacactttcatgactgtttttctttaaatttagatgaaaatgagacagtctctgtaaataaaactcagtatatattcctggtagtgagagaagcactccagtactattgggttccttactctgatactgcaagacaacttcaagtcttctcacgtcttcctaagaatcccttcagatgagcttctttgcttcatttttttcttagattgtatcttttttctagactatttctaataacctatcatttttttccctgcctgtattaatccactaggattgccataacagaataccatagactgggtggcttaaacaatagaaatttatattcttacaattctggaagctggaatgtccaagatcaaggtgatggctggtttggtttcgagtgaggcctctctttctagcttgcagacggccgccttctcatggagtcctcacatagcctttcctcagtgcatgtccttggatggaggaaggaaagaaaagaatagggggaaagagagggagagaggagtgtggggagaaagcgagaaagaaggaaagaaagattttttgtctttttacaaggacaccaatcctactaggtctccacccttaattacttcctaaaagtcctttctccaaatatgttcacattgggggctaaggtttccattcaatttgaagctcaaatttcctatgaattttgggtacacatgattcagtccatagcactgcctaactgcagtccttaggttctctaattttctaatgctcccataggaggaagtaaatcatttgtacaagtcacctgacggtcacgtgtattcactcagtgaaactttgctaatagctgtctatatgatgaactctatactaggctctggtttgcccaaattagtaaaacatgatctctgcccttctggaatctaactgggagaggcagacacttaaaaaaattagagcaatagcatattacagatatgatcatacaaactggctcatggtactgcagggtacaaaggaagggatcatcacttatgactggaaatgaagattccagggaatcgtgaaataatggtagaatgtgatgtggaaaggaaacagaaggcaagaaacagcctggaacagcaaaggtaataaacaaactccagacaactcaaaggctctagaagctgaatggaagtaggtgacccagtgtgagccataaaaccagcatttcatatgggggctccttagtggaagaactgatagcttgctgaagagcaaattctttgtccttcaaggcattaagtgtattttaacaataaagtaaagtgtttgaaataaatattaggttagagatatatgggattgagtcaaaagtgagttttgcaagtgagtaagtctttagcagaattcttagtgatgagttatttctttttttatttttattttttatttttctgagatggagtttcactcttgttgcccaggctggagtgcaatggcgtgatctcggctcactgcaacctccgcaccactccccacccgccccccggcttcaagtgattctcctgcctcagcctctagagtagctgggattacaggtgcatgccaccacacccaactaatttttgtgggggtttttttgtttgtttatttgtttgtttgtttgtttgtttgtttttgagacggagtctcgctctttcgcccaggccggactgcagtggcactacctcggctcactgcaagctccgcctcctgggttcgcaccattctcctgcctcagcctcccgagtagctgggactacaggcgctcgccacagcacccggctaattttttgtatttttagtagagacggggtttcaccatgttagccaggatggtctccatctcctgacctcgtgatccacccacctcggcctcccaaagtgctgggattacaggcgtgagccaccaggctcggccaatttttgtattcttagtagagacggggttttgccatattggccaggctggtctcgaactcctgacctcaggtaatctgcccgccttggcttcccaaaatgttgggattacaggcgtgagccaccacgcctggccagtgatcagttctttcatcggggctattgaatgaataggattcagctctgggctctgaatagactggaaattactgtgtgtgcattttaacaatgtatcgagaacatttatcatgtttctcacttaaccctgtgccatcatcgatatgtaacagtcactcaggcttgcacattcaattcgtaccaaaaatagtctatgaggtaactactctcgattattatacgattaatcaccagtcaggagtggttagatttgttttgttttgtttcgttttgttttgttttttctgttacatttaggcatccaatcattaaatgtatttgtaacagaaaaggcaaaacttctagaatctctgttactgcaataggaacttgttcaaggcatagtccctaaattttaggatcatttgacactgaactgttacatcagacccacccaagaaaggtgtgaacagtagccaacagaaaatcaagctgcaggcactatttttgttcacagaattgcctagaaactcaaaattcagcttctgctctcacatacctctttctttttctgtcttaacatacatttctatttgtctcttgacctaaaaacaagaaaggaaaaaaaatctagctgtggctgtgtcctcacaccccttccacccgtggtaactgtctagaatttagattgtgccattgtctggatcatgccatcatgtctttgtggctaattgaggatacagcatacaccctaggcaggccagcccatggagagtaatgtggaatccaataaaaccacagggcaggcagggggagtgatggtgcgagggataccagaaacctttaatccagatcattcctgttttccattcaattggtggtggtttgcctaggaccccaaaactgtacttgcagatgaacttactacttttcttcctaatggcatcttcagacttagaactaaatctcagacttcagttgcttcccttaataactgaaaatatactgcattatattccttgtccttcaaagtagcttttgatgtgttggcccaacgggtcttttcagaaataccgtgcgtggatgatttgtagtaaaactgagatgctgtatattttccaagtaccagattcacaaggaataatgcgataatgatgccttgttttctcaagctttcagacgtgccggcctagagctggcaacatgcaatctcgtactacttcatctgaattactgaaatgggagacttctgtctgcattctattactgatttccgtgtttcacaacctgcagtttcctagtcttcaggggtaaaggaaacatagctcaaattcaaaagtgccttgccaaagccagtaagaaaagctatttctccttgatttgcagcgactcatttgaatctccgtagtgggccctgagagacccatattttgtctttgggagcaggcgcaacacagagttgattcatgattttagctgaggggacacattgaggcaccaattgactaaattattttcatgtggataatggatttagggccttcacttgattatgtctgacttctcccagtctaagctcaggattcccatcttgattattttaaattaataatatttatgagtttgtttgttttcgtttagaaatataatgcatgcttattttatacaatacaaaatatatgaaaaagaaaataaaaatctctaataatctcatcatttttacccaggcatttcaaaagccacctatgtatgtatttatccaactatcagttcatctattcatccatccatccactcctgcatatcctactttacgaatgtatttgacagcttattttatattatgagcatgttcttatctaataaaatatcattaattacatggtcttagtgtcggttgcaatttttgtttcaaaatttcttttaatattaagggaaatttaactgaatgtgtatatagtatatgcataagtatataatgcatacatcaaacaaacaagccttttttttttttgatggggtgttgctctgttgctcaggctagagtgcagtggtataatcacagctcactgcacccttgaagtcctgggctcaagcctccctagtagctgagactccaggcacatgccaccatgcctggctaatctttttaactgttgtagagacagtctttctatgttactcagactggttctgaactcctagcctcaagtggtcctcctgtcaaggccttccaaagtgctgaggttacagggcatgagccaccacgctgagcccctaatacgcctttctgtctggtcagtcagttttggatactacttagcctatgctatccttcctccatcagaggaaaacttgattatataatatgtaaaatttgaaggctaaaagggagctcagagaccatctggccctgtggttttcaaatctcaagggttccaaggaggtgcctcagggtttgctttgggccaaggtagaagcaagcagaacaaggcttctgctcggctatcactggagctgctccacttctctgttttataaatagtgtcaggtttcataagatgatgtatttttaatgtaatttaatttaatgtttagtataaacgttttgctgcttttaaaaaaatacttgaaagctgttgatcttgttcaacttctttctcaaggtggtcgcccctcctacagcaagcctgacaggtggctctgagaagctactttatctcccccagggattcttggctccgcatgaaagtacaaaccctgagctgcaaggggatcctgcatagcttgaaaaaaatctacccctcatggcagtgattaccactttaggaatttaggtatatagtctcttttgggtctaatgcatatgcagcatgagaaaaaaaatttctaggagtttctgggaaagaaagttcttcattctcatcttgaacagaaaagatggctctccttcctacctgctgatgtaagtcctgatataactactgcaactcccgataccagcctgaggatggaccatatacagaggaagccagagctaagagaactacagagacatagatgcagactccaacagaacctcaactacttaccgcccttgaccccaccttcaactctcaactgagttggttttattgccataattatttgggccagcaggagttggggattctgctgtacatccactaatgaatgtaagatgtgatcttcaccatgcctgcagaccacactttcctggaaagggttagtagccctggagtgggttagtaacctgctgggtgttacaaaagagaactagcctggggtcggaggacctgaatatgattccaagcgaaaccagataaattttcttcctgtgaagttgcctaatatctctttaactcaattagcacatgagtgaattggtgataaatatctataatacataagtcacaggactgttaaaaggttcacactgaagcatgttatgtattatacaaaatgtaaggaggctgtctcatatttgtgatatctgcagtgtgctaagaatggctctcacagccgggcacggtggctcactcctgtaatcccagcactttgggaggccaaggcaggcagatcatgaggtcaggagattgagactatcctggctaacactgtgaaaacccgtctctactaaaaatacaaaaaattagccgggagtggtggcaggtgcctgtagtcccagctactctggacgctgaggcagaagaatggcaggaacccaggaggcagagcttgcagtgagcccagatcatgccactgcactccagcctgggtgacagagcgagactccatctcaaaaaaaaaaaaaaaaaaaaaaaagaaaaagaaaaaaaagaaaagaaaagaaagaatggatctcatagtgaaccttcctgtatgccaaggtctacactaaaaacttgactttcatggtcacacacaaaaaaaactgtatgaggtaggtacagctactcaattttatatctgaaactcagatgttctttagaatcccgaatgatctgggttttagaaaggttatgttgagcatgcagtgggtgctatgcagcaacatctgcttagtctgggcagcacgccattattcacacataaatatttctgctgaagaatatgtggctatttacaccgggtggcttcaactaagaccataaaaacctcacatgacttcagggcagacttacctttagattaagttcaggtcagatttgacaacccaatgaattaataataatactaatagtaatgatgataacagtaataattttcaaacatttttgaaaattggaactataaactgtgctgttttatccaatgttaccaatacaaaaactaaagcatgcaaagtttaagcaaattttcacgtcactcagcttttaagtagaaaagctaagactgaatgcaagctgtctcaggagcctgagacagaccactttgcttgccactttgctcgccagtgctcacaaaggctgcctgcccatctaggccctgtccaacccaacagttaatggagccatctacattatctttctcaaagggcatttagaacatcaaaccatgtattccaaatctcagaatttttttttttctggagggaaaacaaatacactttttctgctttaataattctgtataacatattatttggtctaaagagaagttactaataggcaattattaaagtctaagagccagttgagatatccaagtacagttgcccaattgcagatcactgaggacactgatttaaaatacacatacacatatattcaaattcacaaacagacacacaccatacacacgtaggtgcacccttaaagtaatggaacatgtgtgtgtgtgtgtgatacacattattatattccagaacttttgctagagatgtgaagccagcagtatgctagacacagataagcagagacagcacacactccttttttgtttctttaaaaattgcagtgtgagtgataagatctggggttgaagtgtttgtgaggcttcataggggaaatgtaaaggaagtaagtgcttcccaaaagatgcaaaagtgcagcaagactgggacgatgagctgagactgcactggaggcagtggaggagaggaaaggagttgcagtcagcggccacagcacacaccagtgggtcctggttcagtattgcttggccccaaaactacaggcagagcatttgacagggatgagatcacagggcgaagcaaacaggggcaagtcacgcaggcctcttttgctatgtagaagagctgaattttttaaaaacattaacatctaaaccttaagtagtgttaagctagaaactgctgttaaaatataccttcaattcaaacagaatatatattttaaccactcatttttataaggcctagtgttaaattatggcttgaataatcagtaattcttcaaagtatggatgaatctgtctcacatttcaggtacagtgcagagacttgtgatcaggaaataatgagataattatattactttttgctccacagtcaggctttatcatttttaaggaatgtctaaaattctattaagtgtaattgttgaagctattaataaaccaagggaagagtttgaaaaacagcacttagagtttccctttagtttcagatcatgtctgagaatagaaaaagaatctgtataaaatcctggggcagaatattttgcaatattttagctcaatccaatgttaatcctggctacacagcctctctgttccctaagccagaaaccccaaaatctccttccccctcctctcctacctcccacttccaatcagtcttccatctctatctcctaaatatgcctccctctatttctctccagtccccctgcccacaccatcattacagcacctactgggtccttgtgttgtcatcaaagctcaactctccaggcagtcttcctacatcctctcctctagttgggtagaactggtaactcccctcttttgcgaaatacccaaacctcctgggatagtttttagccttttccactgggtatctgtctcccttcctgctctagctctggcctaccctacctgttgagaggaaggatggtgctacactccgttttcctctctgcacttggcatgctgccaacacattcacttgttgagtgaatgacaagatacctataaaggttctcttgcccagttatttcattccttcatttctgtaagtggcttttcctattaattaacatgctcattaatacataagtccaaagcagatggcagttcttcacttttgggattttcagcacattgatatgataagtggcaaaaaaaaaatgtatgtaaacaactcattctccatgatattaatgaagggtctctcattccctgttaaaggtatcaaagactattttgtatcaggattctgccttctggtcacatgaagaaaagctaaacctcaaactggcacagttgaaaataagtacctgattttgtatttcagtgtagactggggtatatttgactcttttccagactaatgttattgattttgatcatgtgtttggtgtgtgtttgtgttgtcatagactccttttagaaattatgcagtcatttttattttccacattactcatctccattctcgaggtcagggtttctcagcctcagcatggttgacattttgagccagataattcttcgtgggggcaagctggtatattgcaggacatttcacagcatcactagcctctacccactagatgccagtagcacctttcccctatactgtgacaatcaaaaatattcagaaaggaagggggttgggaaggtggcaaaattgcctcaagtgaaaaccactgctctaggtggccagtgcaacgtgatggctatgtttttataactccttccacagctttataactatatattaaaaggcatgcatagaattttttgttattctttgtttataaattaagattgtatcccttctctacttcctccaagtcaatagatatgataccaactgattctgttttaatgtccacaaaatcttccacggtacaggtatgttacagtctttttagccaacgctccctgtgtgaacacccactctgattccatttacgtcgtaacatacaattccacaacaagcacctttacagttatatccatttatgctgcctcatttatttctatagcctaccttccctgcagtgagatttctacactgttaagcatgtggatatttaatggaaacagatgttgatagattgctttcctcaaaggctgtcacaatagaaattttctccagcaatgtatgagagcacctgcccaccagcactcattgtcaaggttctactttttaatagatctggagtgatatcccattgtcactgtaatttgcatttccctgactaatagtaatattgaagaacttgttgaataaagtgtctaactgaaatagtgtgacctcagacatctgcaaggccccaagtcccgcatttactgcccacttctgatttctggagcagctgccacagccactgacatgcaagctcagactcacctgacctcacatgctctaaaattacgctgtatgttgtaaacctttaaccccttcatcaaacaagctttctgtgcaccaaaagaaggaaaaaagcataaagattcaagaaccttatttggcagcattcaaggaaaaaaaaaatactttcctcataattaaattgtctgtatttaattatttaaagtattttcacattttatgtgaagtatttctcacattttatgtgtgtgggtatttgtgtgttgagcctgtgtgtgtgtgtgtgacccctccaaacagaaaatgtgagacatgttcactggtggaccgtgcatttctgatgccaaattaagtattctctgtttttaggaatgcgtcacaatgggaaaagagatcaattgtaaaatgaatagctgctgggttgagtttaagggaagatggaatgctctgtgagggagaatggagtcgctatgttccagggctatgataagcagtcattctggagatcttgtaaagtctttcaagcagcaactgcagcatagctccacagaggatgagctgaaggaaacaagcttaccccattgtaaggatgcagaggaaattcagtgctggagctaaaaataaagaaaaggattagaatggctgggcgcggtggcctgtaatcccagcactttgagaggccgaggcaggcggatcgcctgaggttgggagttcaagaccagcctgaccaaggtggagaaagcccccgtctctactaaaaatacaaaattagtcgggtgtggtggcacatatctgtaatcccacctactagggaggctgaggtaggagaatcacttgaacctgggaggcagaggttgcagtgagccaagattgtgccattgcattccagcctgggcaacaagagcgaaactctatctcaaaaaaaaaaaaagaaaaagaaaaagaaaaaaagaaaaggattagaatttcttttgccttgtgttttcatcatctaaaaaaggggaaaagtataaattccactatgaatttttttgaaaaataaatttcagcataaaggagtacctgctcattagagtaaattcaaaacaaaagcaaaaacaaaaatgttttaatagacatcttgcagtggtggtctagaaaatgtatttttcaaggaagtgtggttagaaattaatagaatgtctccaaggttgtagtattgggttgatagtcccaatttccattctgagtttttatgtactctggatcttttaaaatataaaaaaattaggaagttaaggcaggttctgttaagaggattctaattttaaggctctaaatttaaatttaaaatgcttatatcggccaggtgaggtggctcacgcctgtaatcccaacactttgggaagccaaggtgggtggatcacctgaggtcaggagttcgagaccagcctgaccaacatggtgaaaccctgtctctactaaaaaggcaaaaattagcagagcatattggcacccgcctataatcccagctacttgggagactgaggcaggagaatcgcttgaacttgggaggcggaggttgcagtgagccaagattgcaccactgcactccagcctgggtgacagagtgagactccatctccaaaataataataataaaataaaataaaataaaataaaataaaataaaataaaatgcttatattgcttttataaaccattttcttatagacttagttttcaaaacaaatctgtaaagaaaatatattattctcattcgacagatgacaaacaaaatttgtcagggcttggcacctgcagcacaggttagagattgcattcattcccagctctgccagaaaccaggcaagtcatttaccaccaagtgttagtttgttacatgtttgagagggcttatcatctgtagatactcaagttaacctaagaaattttactacagtcaaataccaggtaggacaggcatgtaatataaagggggtaagaggataaatgagtaaaagggtaaaaatggtatttgagaatctatattgcagcaaaatgaataatgaaaatcatgataataaatcagggtcatcggtatgtgtgcaaagtaattatttagtagagctgttctgtccttgttcgtatagtctcagctgaaaattgactaacagatatggcatattattagctgctttgcaatgactccttgggcagttagagttttctgaggaatacttgtccatggagcaggtcctcaggtgatgaaaccatcacttccttctggatcccacaacctcaccaggcagaactactgtctacttgcagtcctcatgctgcctctctaaaattcaaagaattcaaaattatcttttcaataaacattagctgagcatctaacatgtaactagcaatgtgctctgttctgtaatatagaaatattaagaaggattagactatgcttcttcagtgcatagtcttctaaagtagttggcttataaacaaaaaacatttatttctcacagttttggaggctggaaactccgagattaaggcaccagcaggtttgataacagatatggcatattataatcttataagtaatttggtaagtttatgatgttatagaagttaatgtgcaaggcatacaggagacccatgtgtgcccaagcgggtcaggaacactttcccagaggaggaatttgatcaggtgacagaagttctcatgcaactcagaaacttacaaaacagagatctcagatccttatctcatagcatctccagttgcctgacttgatcctaaggctgtaataggggagcaccaaaacagaatcccatagactcaagtcaagacctactcttataaacaaatggaaataaagcttagtacaagtgagagaatcttgtgtgccctatgagtcatacccttcagcaatgtgtctcttgcatcactgaagctgtgcaagggaatcaagtgcagcaaataagtcaggggcagaggttccatctacaggagaggacgacacctgtggacccgactctgggaggcagaagcacctagcctgaggtggagattcaagcctcatctatgtatagccctgacacagcttccacagcaccctcatatcacatgcaaaggacaggtgtgtcttccatttagcctgctaaatcaggcctgccaacccctgcctcctgaggaggctttcagaattaactagaccatgttggcagctaactagacagctaaggaaagaaagcattacctcatctttgcactggctcatttgatattccaccttcaattactccaactgaaagttgaaataaaaataaaaagttatggcctttgtgtgtgtgtatgtgggtgtgtgtggatgtgtttttgtgtgtgaaaggagaaatagagaaagagagcaatagagatttgaggttttagagacagagagaaaagaaggagaaagtatttgtgttaggttctgggagtgcaatttgggaaaagtagagagcattacgaaaaaaagagccaaaaatacattcattaatattcattaatttgcttgtctttttaaagacttgactatctattatgggttaagtactatgatggacagtgaggatgtagcgtgaaccagacagaaatagcccaattccatcacacctttagttcctagggaaccactgaattggtaaaaagttcatgtattcttggaattctggtggcagttctatttcaccctgaagacctgaaccaactttctaggcagcctgggagtccaggacacagacacagaaggagttcccagagccagagtgaatatgaggttgtactgacattgactgttgggcacagagcccttgtaatgaaatgtctaggccatagatgtatatgtcagatttaaataggtctgagagacatcaaagaaagtggaacttggagaatgataacgaaagggagtgagatttgcggtaaatggaatatgggactcaagaagaatgcctggagtgcttgagcctaacagccagctaattgggtcccttgagtttggagggacgggtaaaaagtgggaagccaaattagatgtgccaaccaaaggaagttcaaaggtgaatgggtttctttccttaaggactttgatagccttgtaaactgacaatgctgaaacaatgtggttagtgcaaggaggaggagacagcctgcatgctgtattactgatcagacagagaaggcaagcaggaggactttctgtaggactttctggaggagaactcagggaagagaaagaggaagttagcttttcgacaatggaaaaggggcattttataagacaagctttcatgaatctaaggtttttgtagttctatgagtttcaaggcaatcttgattgaagtattatgagtaggaaagacataagcacacggtttgtgaaatgctcttttattctagctctaagtagaagagtttcacacttaatgaaaataaaggagacagagttattcattcaggaacaggatgctatggcttgaatatttgtgttaccacaacattcatatgttgaaattctaacccataatgtgatggttttaagaggtagggcctttggaaggtgagggtgaagccttcatgaatgggattagtgcccttatgaaagaaacctcggagagctgcctaacgttttcagccatgaaagaacatagtcagaaggcaccaaccatgaacagggaagacagttctcactagatatcaaacctgctggtgtcttaatctcggagtttccagcctccaaaattgtgagaaatacatgtgttttgtttataagccaactactttacaatattttattatataaacttgaacagactaagacacagcgttttcatgatgaggtagtgaggaattaaactggtatcattaccactaatgtgaaagggagaagacaattcacaatcacatcacggaattctgtaaaagctttatctcatcaatgatgtttctctaatacagagtgtctccatgaagtgatttgtttttttatttcatttttggcataagataaactggtagaaaggcattcatcttggggtaaaaaaactttggctgtgagctccaactctggaactcattaacataatttaagacattgatcaagtcactttggctccctgagcctctatttctctacctctcaaatatgaaagggaggtgaggccatttcgaagcttccttcccagtagaatactgtacatttaactatatattgcaaatgagagtgaggattgataaataggaatctgtttgccttaactcatattcatttaaagaaattgaagaaattatgactatagacctccactagggggatgagccatgcttgctgggccccattctacttgcagccctctaaaatgagtgagatggctcagggctttgtacagggagtatgagcatgaaccacaccagctaaaggcttaagatttcagctcagccatgctggctgcaacaatgaagacatgaaatgagtataaggaggataaatgaagataacaaataagtaatacataggattaaatgtttgcaaaatgtgccagagtggagtgcagccacgggagacagccaaagtacattaagtggagacagaggagggaaggtgaggatgatgtttctttgtggaaggctcatcatcaagactgtatccccagggagcctgtgcatggggattaccattactcataagccatgtgcatggcctgtgcaaaataagcctccacaaagttgtgctgtaattatgaggatttcagcatgatttttaaagcactaaacttgtttttcagccaagatcttctggtgtgcatttgtgtgtgtgcctgtgccaacatgtgatagtcgtgggcagaaactccaaaagtaaagcataaagcttttctcatatgtacccccaactatgattaaaaagcctgtgcttgacagagaaaaaaacaaaataatattttattagaaagtaagtttattaaagcagctaagaacatgggctctggaggcagattccttcagagaggaaatctctgctgtcaaatttattagtagatgtgtgacctaaggcctacttcagtttcttcattcttaaaatgagcattataggccaggcatgatggcctatgcctgtaatctcagcactttgggaggccgaggcagcctgatcacttgagcccacgtgttcaagactagcctgggcaacatggcgaacccccatcttgacaaaataaataaatatacaactataaaaataaataaataaatacatacatacatacaaatattagttggggatggatgcacacccatagtcccagctacttgagaggctgaggtgaggagatcacttgatcctgggaagtagaggttacagtgagccaagattgagattgtaccactgcactacagcctgggcgacgaggttagatcctgacttttttttttttttttttttttttttgagatagagtctcactctgtcgcccaggctgcagtgcagtggtgcgatctcagctcactgcaagctccgcctcctgggttcaagcgattctcctgcctcagcctcccaagtagcggggactacaggagcctgccaccacacctggctaattttttgtatttttagtagagacagggtttcactgtgttagccaggatggtctcgatctcctgaccttgtgatctgcctgcctcggcctcccaaagtgctgggattacaggcatgagccactgcgcccggcagatcctgttttaaaaacaaaaactaaaactaaaaaactgaaaagaaacaagcattatacaaatacttgtaaacaaaattctaaccctctccccctacagccatctgaaaggacccctcttttcagctgagtgcattccaaggtcaacctgaaaaactagttcaggccatgatggaagtggggttttgacattataccctcctcagttttgtaattcaggaaaagccaaccagcattaacatcaacacagaccttaaatctgatgaaaagcatttactatctattctctctgaagtctgctagctggaggcttcatctgcataataaaaccttggtctccacaactccttattgtaacccagacattcctttctattgatgataactctttcaaccaattgccaatcagaaaattttaaaatctatctaagaactggaaggccccttcccctttgagttgtcctgcccttccagatcaaaccaatgtaaattttacatgtatttattgatgtctcatgtctccctcagctgtacaaaagcaagctgtaccccaaccacttgggcccatgtcttcaggaactcttcagactgtgttaaggacctatccttaaccttggcaaaataaactttccaaattggttgagaactgtctcagatacttttatgtcataagattgtcgtgaaaattaaatgagtatttttacgttacaaaagaaatagagcagggattgccatatagaatgtgctcaaaattgaaggcttttctgaaaagaatgttttaagaaaaaataaaaaaaagcagagctacagaaagaagaaaagttttttaaaaaagttatgtttaattcaggtcctacaacacatttttttttttgaaggacaatgtattgttcccatttttcatttatcatatataagataaatgagttctagcaagttggtactttagagtaaaaattccacaggggaaaagatggtttctacattgcagattttacattgatgttctctgttcttcaaaccagtagttttgtttttatccttagcttccatgcatgaggcagtgggttcgtagctaaccttgctcacattataggcatgatttaaagtatcttgcttcttactcagaattatttaagctcattcaattcttgaactcatcccagagctcaatccaaaatctccattttttgtcccctaaattagttccttctcccttctcacaccccaggagatggattaaagtttccttctttttatcactctatttaagtgcttataagcgttgtcttttagcaaggcttctcctcaaagaaatgcaaatgataaaggcgcctgtttgttcctgcagaggataaaaagaagagtgaagtatgcgatgtctctgggagaataagtttttttctgaacagttctaataggatggggtgagataagtagttctttaacagatatacaaaagaaaggcttgggaggtctaaagggggtagttttttatcctgatcaggtgaaaattaaaatctttagaaagaagatggttgtagaaactgctggggaaaagggtaagcttcctctttaccgccagaaggttcactgaaataaactgacaatagacaggttaaaaggagaaaaggcatccatgcttatgaacctgcataaccatgggagccatatgaaataggagactgaaagaagggccagatggctgaagcttaaataggacttcgtaggcaagaaggagacagggaatgtaggcaactttgaagggtaataaatgattgctaggggaagtaaatcggcccaaagagcaacattttgtaactggttctctgaaaactgaatagaaccaaagacaagacagtagcttgggataaagttcgtctgagctctggaggaagtgggaagtgaaacttcattgtgaacaaagattattttattacatagataaagtctcccaggtaatttatggaaaaaaaaatgtgtggtgtggtgacaacttttagttctttcttttctcaggtggttaatctttccaggttatttgataagactcttacgaagcaattttaagacttgcatttcttttgaaagacctttcctcagtcagataggggaacttccagagatagcccctcagagaaacaggtgaaggtgggggttgagaaataagagaaggttagaaagtccttggttctgaggctgcttctacagtcttccaactgcctttaattcaaaggtgctcagcatgccaaagctccataccttggtatattgtgctctgagccctaacatttccctgctcaaatatttctaaaagtttcatacatcaaaaactaagttggtggccgtgaagaaaaaaaacatatattttagtagctcggtggcaaaggataccattaaaccactctcctatctccgggtatttgtcagtccaattaaacagttggtttgtatttcagaaggtagtgtttggaggcttcccattaaagttaagcctctatatggctcaagcaaacaggtctttagcaagaggcatttttgtgggcacagaggaaaaacaatggttaatgtttggtgtagtctacaagctagttttttgtttgtttacagtttagaaggcagtcagttgagaagattcctagatttgggtttgaagtatcttcacttggaaatgaaccaggcagtggcaatctcacagatttttctgaattgtagtttatatcagatgttcctgtgaactcgccccaaaattgtacctgtaagatttgggtggattcttctcttcttgaggctcgaaatagcatgaggctctgggacctgtcaggaagtgacattttttacttataagactagaaactctgtgaggaaatcctttattcaaggtatgaggccaggtttccaggggcttctatagctttataatatcaacctcagttcctcaaagctgtctactcatattggaagatataatattccagtcaaagccttggtaatataatcagtgcttccaattgtcctgttacaaaaagagcagatacttaatgaacttatgcaaataactatattgccataataaaagcatactcacaaatagtgatatggttggtccccactcaaatctcatcttgaattgtaatccccataatccccacatgtcctggaagggaatggtgggaagtaatggagtcatgggggtggtttccccatgctgttcttgtgatagtgtgtgagttctcacgagatctgatggttttataaatggctcttcctgcttcacttagcacttctccttcctgctgccttgtaaaaaaggtgccttgcttcctcttcaccttccaccatgattgtaagtttcctgaggcctcctgagtaatgcaaaactgtgagtcaattaaacctcttctctttataaattacctagtcttagatatttcatcatagtagcatgagaacagaccaatacaaataatttccaaattttagagaaatcatgcaaaaaaaaatgcttcaattatgtttacaaaagtatatattaccaaattgctggaagtcatagaatgcttaaaaaatgtctttttgcatctggaaaacaaaacataaaaagaatcagcaacgtttcaaacaaaattcataaaaattataacctctcattagtttagttccttataattaattttgttctacttgatgttgagttagcaatttcatgagtccagtttttgcattagttttggaaattcttaccaggtccaataatatcagaaattaccagaaactcatacttgtcggagtccttttttttccatatatctttaaagacaacagtttataattaatttttcccatatgtccttaatgacaacactttataattccctataaaaaagcttcagacaaaacatcagaataaaacaattagctttaagcaacaagaattaaaatgaccatggttgaatatctgatggtagttcattataataatgtcgcaaatgacaaggaagtttgcttatatttgtagccgacaataatttaatagccaaaattatgactgataacatataccatgacatatcagatatttaggaaactcataaaatttggaacacatatgaatagtatatctatgcaagtgtaactcaaaagaggtcaaacctaattttttatttggcagtgctctctatgtattaaacatatcaaataaccttaattggtttgttatctctgttttgtacctttaggtgctattctggaacttccaaaactcagtttgaggtcaaaaagacttcatttgtattttggaattttttttttttaaataaaggtttaaaacacttcattaaaaataggatcacagattattacaaaataatagtcattcattccactaaccagaattagaattaaaaggctcaaaagaaaatacaagatgttaaatagatgttaaaaaaaattatttactctttcatagaaagtagactccatttttacagctaatcagaagacttagaaaagagagcacaagctcacagaatgtgtctctctcactcatcctctttttgtaattcactcaaaagattaacaatttttttaattttaatcttttatcaatattacatgaaaatcttaattcaaagaaaacattaatgtttacttttgtatcagtgtacttttgatattaaagctcatcttaagaaaagttcataaataatttccttttaatctttgtcaattgattacacataaaatttttatgattcatcctttataaaatttttataactttttaagacattttacaacttttttaaacagatatatatgttttactcatgtaactttctataaatctctctcttctacttactgatttctttctaccttgtttatttctgtactaaatccatatttttaaagaaccttttaaaaacctctacattggacaaaaattactttttctttaacaaaaatacattttcatgtctatttaaaataatttttctcaccaaaacacacttcttacttctcttgtatatcttgcacacagaattgtttccattaattttagtaattttaattacatatattaattaaaattttaattattagcaattgtaaaccagcattctgtagactaacacaattttatactttctataaatatgtgttacctcatagaataacatttcaatgtggaatagtacatatttactaactggcccaaatatattttgtctttttataaacttaagaaaccaaaaacaaataaacatatgtttaataagtaatgttttaatatttcatcttacttggaaatgacctagatattcaatgaacactcatttaatttaatttagtaaaactctaatgatgtagttaccaaagagatttagaaaaactttaagtaaacgtaatataaagcataattattattttaaaaagttcatttctaaacttttattccagttacatgtatttaattaacttgcatttaggtcaaattcatactgttatgattttaaacatctaatagtgataaaagttgtgtgtctgtattagatttaatgttgacagacatcctatttttaaatcaagtaatgttatttttatttaccaaagattataaatccacataaactttagaagcatttgagcttatttttttatttataaatgctcatttatcactaagtcaattcagtaccatgtagacagaatacaaacccaaagatatacacacgcatacataaaaatataggcagaccaaaataaagaatttatagctctgattttataattttaatcatgaggcaagtaaaactcactagtttaaaaggataattggagcctggcgctttggctcatgtctgtaatcccaacactttgggaggctgaggtgggagaaatgcttgagccttgggaagttgaagctatagtgagccgtgatcgcaccatggcactccaacctcggcaacaaagcaagaccctgtcttgaaaaccaaacaaaaaaatgaaaacacacacacaaacaaaaaaacaaaataaaaggacaattggatacaaactgtgtctttgtaaatggagcaagttaaagactgtctatctcacatggacaaagcccttattgaattttagaaaagacaaggtaggaaatttacatatcatcagcacagagaaagaacataagtttttccaagaaggtgtttgggtttgtcaggtggaacaaagaggaagatttaaaatatatgtcaatgtaatataaaataatagcaatccattacaggattttataagaaagtatacaaatgagagcctataagaaaagtttagaagcctgttttaaataactgattgaatataagaaggttgtagttcaaagaccaattttgttagatagatggtttttcaattcattttttgtttcttaactggattttgatttcaaggcagagcccggtaacaaataggaccaacaaagaatttgtggcttctggggcctaatacttatacatgtaaaagacaggtgtaactggaaggcaaagtactaagatctttaaaaattaaggacctaagcatgcaaagaaacaaaacaaatctgaatttgcccgctgcataatgaccagtactgtaattgctgccaattatctttaaaattgctggtcttgctggtgactcatgagttaataaacacccaaaggtcgagtgtcctcttacagtacaaagtagcccttggtactcctaaaaacccaaaagatcacacagctgactgtaaaacagtgcagagcttcagacctcagtggatgtagtccaggactctcggggctccatgaggaaggctgaggagcccaaaaatgcgttgtgtggtgccttttctgtgttccttaaggggtgtctggattgctaaaggcctatttttgatgtttttatgtaataaccagaagtgtgatgttttctattggtaattttttatccactgaccaccaaatggaggaggtagaagctttaagaaaaatatatcaagggaaccagatggaaggttgaggccatcagaaagaagtggaggcatcagtaaatgaaagaacaaatcatagaagagtcagcttgggagtttttcagaaaggcctatggagttttacactatccctggcaaaaatcatgtccacaagaaagaaagacagaggaaacagtgcatatggttaacaaggattcagaaagaggaagtttcagtccactgtgaagttttcatgggagaaacaggatcctatagagagattagaaagacctaaaaatgtggctgtttttaataaaacagttttttactttaaactgaactgaattggggaaggaaaagtctcagtcaggaatccagacatccaaatgatcttctggtcaaaaggattttacttttgttttaggtcagatttttgcttttcattttattagaagaatttctaaggcttgttgtgacactattatgtgtttttctttcaattcaatcttcccataaatgccaattgtgtaattgcataatatgagagttgtctaattttttttttcaaatatagaagactttccaacttaaagaatatattgtctggttatcgacaattaggatctccgatggtacatttattccaacagagactcaatccaatgaacccctttatggaatgactagatgctaaatctccaagttcagaataaactctttaagcaggaggtttccaaaaagggtgcagaagatgcagttgccattgcccccaaattttcatccacagaaacagactaagacggcaaaaagatatctgctaccacaggtggttaaagatggtgcttacaaatagtgtctctagtctccacccaaaatatggggtgctgctagtcacagacctgtcaatctatgacattgggtaggcacttctggtattagactttctcaacactaaccaggcaaccgaagttgaaataacaaaaggcccttagggatgggacttcttattaagagaaactcccctgagagctttgtacattcagacaaagagagtgctgctgaataacaatttgtgtcttgggtttccagtcttctcagactggccacttggcaggacccaaaaattgggctcccagctagcaaagaccaaaggaggaagattcccacctggtcacaaagccaggctgtcaggatataagatgaaaagagaactttatacaccaaagttctttttatgatgaatgacacaaaaagacagggacagagcaaaatgaagaccaattctgggaggaaaaggatgagacgacatgaatattcatactagatataaaccagagttgtaaagaccagtccatacaaatgtttttctcctattaatctaaatttgaaaaggaaggaaagacaggaagtgatgtttaccactcactcaactggattttgtagacagaaattaaggaggctgactggtaaaggtctcttacctttttgccagcttgtcagtcctaggttttctcaactgtagtttcaagtggatcacgatgattgtggtatactgccaactatgccggatttgcaggggtgaaaaacaaaacaaaacaaaacaccttctacctcaccctctgaagtttgctgaaataaacggataacataatgattaatacaagaaaggacatacatatttatttatgtggacaagcttaggagccgtacaaaacacgagacttcatgaatgactaggtggctgaagcttaaataactccctccttatagggatgagggagataaaaaaaaaacctaggcaattctgaagcgtagtaaatgttttttatgagaaatgaatgggcaaagagcagataacagattttaaatgatattctttggaaatgaaatgggaccatagtacagataatagcttggaccaaggaaggtgaggtacagaactctgctataaacaaaggttgccatattatacaaaaaaagtcttccctccctaaaggggtccaatttttgggtcctgccaagtggccagtctgaaaagactggaaactgaacacacaaattgttattcagtagcactctgtttgtccaaatgtataaagcagaggttttctttttttttcattatactttaagttttagggtacatgtgcataacgtgcaggtttgttacatatatatacatgtgccatgttggtgtgctgcacccattgactcgtcatttaacattaggtatatctcctaatgctatccctcccccctccccccaccccacaacagtctccggtgtgtgatgttccccttcctgtgtccatgtgctctcattgctcagttcccgcctatgagtgagaacacgcagtgtttggttttttgtccttgcgatagtttgctgagaatgatggtttccagcttcatccatgtccctgcaaaggacatgaactcatcattttttatggctgcatagtattccatggtatatatgtgccacattttcttaatccagtctatcattgttagacatttgggttggttccaagtctttgctattgtgaatagtgccgcaataaacatactggtgtgtgtgtctttacagcagcatgatttataatcctttgggtatatacccagtaatgggatggctgggtcaaatggtatttctagttctagttccctgaggaatcgccacactgatttccacagtggttgaagtagtttacagtcccaccaacagtgtaaaagtgttcctatttctccacatcctctctagcacctgttgtttcctgactttttaatgatggccattttaactggtgtgagatggtatctcattgtggttttgatttgcatttctctgatggccagtgatgatgagcattttttcatgtgtcttttggctgcataaatgtcttttgagaagtgtctgttcatatccttcgcccacttgttgatggggttgtttgttttttccttgtaaatttgtttgagttctttgtagattctagatattagccctttgtcagatgagtagattgcaaaaattttctcccatttttgtaggttgcctgttcactctgatggtactttcttttgctgcgcagaagctctttagtttaattagatcccatttgtcaattttggcttttgttgccattgcttttggtgttttagacatgaagtccttgcccatacctatgtccagaatggtattccctaggttttcttctagggtttttatggttttaggtctaacatttaagtctttaatccatcttgaattaatttttgtataaggtgtaaggaagggatccagtttcagctttgtacatgtggctagccagttttcccatcaccgtttattaaatagggaatcatttccccatttcctgtttttgtcaggcttgtcaaagatcagatagttgtagatatgcggcattatttctgagggttctgttctgttccattggtctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtgggaatggccctgaatctacaaattaccttgggcagtgtggccattttcatgatattgattcttcctacccatgagcatgaagtgttcttccatttgtttgtatcctcttttatttcattcagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggcattttctagataaacaatcatgtcatctgcaaagagggacaatttgatttcctcttttcctaatcgaataccctttatttctttctcctgcctgattgccctggccagaacttccaacactatgttgaataggagtggtgagagagggcatccctgtcttataaggagttcttctataagggccttttgttattttaacctcagttgcctggttagtgttgagaaagtctaatgccaggagctggcctcaaaaaatagataaaaagtctgaatgtgtgtggtgataatttttagtcttttctcctctctggtggttcatctctgctgattagtgagattcctagggagagggttttaatacaattgcaattttctttagaaaaaatttcctcagtcagataagggaacttcagagagagcccttctctgccattggaggttgcggaaaaaacaagaaaaagttaaaaagtccttagttctgaggcagcttctgagaccttcctgttccctttatttcaaagtgctccaaataccaaagtgccatactttgggatatttttcactgaggtccaacaaaaccaaaggttatggttgctcatttgaaaataaacattcaggtatggtgaatagtgaggtgaaatgtcatgaataatgtcaaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaagggaattgtttccttcccctctgaagttttgagtttgcaggaggaaatagacaatagattaactggagaaaaggaatacaaatttttaacatacaaatatgtgtaattgcctgatgggtttttcgtgctcactgtacagacaaaaccaattcactgagaccatgacattgtattaaagagtttaattgatgtgcgggcaacccacatggggaaactggagtcatctctcaaatctgtttccccaaaggcttggaaggttaggtttttgtagacattttggtgggcaggggtgagggaatgggtgatgccgattggttggagatgaaatcacaggggtgtggaaagtggttttcttcccctgagtctgcctctgtgtggggccatagaatcagttgagttatgagtcacaagtcttgctggcgtcagtctgaaaaacatcttaaaaaaaaaacttagaatttgcaatagagatgttatctacaggaacattgggaaggtcacaaatcttatgacctctgtccacattactcctgagcagtaaaggattataggaagtatgtccacaatttcagcagagttctgtcctctctcatattcataatcttgtagcctttcattatttttacaaagggagattagtctggggaagggctattatcagccttgttttaaggttaaactgtcaattaaattcctcccaaatttagcttggcctatgccaggaatgactaaggacagcttagaagtcagaagcaagatggagtcaactctatcagatttctcttactgttataattttgtgaagatggtttcatgtgcactggaaacatacaaaggataagactcaaaagaaagtgtcagatagctgagactcaaatattctctttatgggttggggagcggggtaggaaaatgggatatgtaggcagttttgaggagtaatcagtgattttcagggaaattgaatgtgcccaaataatataccatactctgaaacaaagcacctctgagctctggagttgtggcaacaagttgtgggaaggtaaagggtagaacttcactgtgaataaagattgtactattattcaaacaaagtcccagtaatctcttggaaataccctaagaagaacagataaagtccaggctcacaggtataatcccaagctgtttgggagcctgagatgggacgaccccttgagaccaagagttcaagatcatccagggcaacatagtgataatctgtctctaccaaaaacaaacaaacaactatatatatacacatacatatatatatgtatacatgtatatatatatatatatatgcgtgtgcgtgtgtatatatgtacacacacactatatgtatatacacatatatatatacatatatatatatagacacacacacatatatatatatatattaggtgggaagggtggtgtgcacctgtagtcccacctactcaggaggctaagatgggaagactgcttcagtccattgcagttccaggctgcagtgagctatgactgtgccactgcactccagtttaggtgacacggtgagaccctgtctcacacacacacaaaaagaatccataaaaagtctgtctggtgtgtctcacacacacacaaaaagaatccataaaaagtctgtctggttatttaaataaaacttctatggaggagttttaagacacttgcatttcttccaaaagaagtttgcccagtcagacaggggagcttacagagacaacccctccctgagttgggtggagtactcagaaacaagacatggttagaaagtcattggttctgaagctgctactaagtctctttcattttctttagttcaaagcaataggcaagccaaagtaccatactttggggtatgattttctgagccccaacatttgcctctctgaaatttccttagaagttttacacattaagagctgagttggtggctatggagagaaaaatgttagtaatggaatggcaaagaatctcattaaacaagccttccatttctgggactaggttggtccaattaaacaattgtgtcttatttcaggaagtggtgtttacagagctcccatcacagttaaggtgaacgagtctttaatatgtggcatttctaaatcagaagaaaaacaaaggttgaagtctgcggcaatctatacactagtttctctggattctggagggcagtcagttgagataatttctagatttgagtatgaagcatcttcagttggagcagaagcagtcagtagagatctgacagatttttctggattgtagtttgcgtgttatgagagaatgtctataaataagctgttgtggtgatttccctgaaggttatatcaagctgaccagttttgtcttgtagggcttcagaaaactgataattttaattttagttatctcaagtcagaaaattgggagaaaattggaaatgctgtaatagtttggagactcataaccaggtaccggaggagaccacaaggaatgaatatccagtccaaattacaagcaaaggataaaatctcaaacacgataagcagggttagaaccgaaaaatgggtatattatagttttcttctgaaacatgtgttttctctcttcagtcactctaatttttaccaaagataatcacaggaagtccaatttgtttgcaaaaatgagtttaaccatctaggttcttcttaagactgtgttgctgaaactttgtatgaagaatctcaaattaggcttttaaaaggcctcttacaggtgtgcagccaagccagagacacaacctcaaattctgcccataatacctgtagatttgggttaatcctgctcttctcagtaaagttctcaaactatctccaagttcttgggtttgtcagagagtgacattctttacttaccagcatggcagccccgtgaaccgtgtattcatagtactagaccagtttccagggggctttttattggcttcataaagtcaaattcatttccttaaaatggtcagattatatctgaaagttagactattcagccaaagctttggtaatataacagtgtttccaattgtgccttattagaagaagaataaattcgtattgaacttaggtaactacattgccataaaatgagaatactcaggaataattcacaaattttggagggatcaatcagggagaaaaaaggtaaatgtttcaattctgttcacaaaagtacacattatgaaattgaagcaagctatagaaagtttaaaagaaaaacaaagtcttgctaaatacggaagacaaaatataaaaagaatcagcaatgtttcaaacagaaagttgtaaaaaatcatggtttttcatgagttcagtcccaaataattaattcttgttctgcttaatgttgggttggcaattgtatcagtttagtattctttttcatttgagtcttggaaattatcaaagttttcagaaacctgtacttgtcaaagttctttttatttttcctatatacttccttgaagaaacaacaccttaggattataattgcctacaaaaagctttcagaaaaggcatcaacataaagcagttagttgtggacaacgagacaagacttaaaatggcaatggttaaagatctgagagagttcattataataaaaaagcaattgaaaagaaaatttgattatttctgcagtgtttatacaataattaaatgtaataaccgaaggttataaatgatagcattatcttaagacatatcagagatctagacattgcatacaatctttggacacatattaataacatacccatatgaatgtaacttaaagaaagttaaatattatttcttatttgacaatgttttcatataatttaacatattggataagcctcattggtttaatatctttttagggggaattttagagactttccttaattgtccaaaagttagtttgggggtcgaagtacttttattttgattcttagggggtttgtcaaatatcaaaggtttaaaacatttgatcaaaataaaatcacaggtcaccataatatgatattcatgtagccagagtgacaataaaaagatttcaaaagcaaaaacaggaagttacatagttgtagagaaacttttactctttggtaaagaggagactcagttttcctaagtaatcaaaagacctaacatgacagtataagatacaaagaacgtgtttctctctctcctctctcttttgagagtttttctcagtccattttgtgttgctatatcacaaaatatctaaggctagataatttataaagaatagaggcttatttaactcgcacttctgcaggctgggaagtttagccctggcttctggtgaaagctttcctgctgcatcgtaacatggtagagaatgtaaaagggaaagcagatatgtgcgaagaggccaaacctgtgagcagtctggctttatactaaccggttcttgttgaaactaatctatccccatgagaactcattcagttgtaccagaacaagaacccataaattattgacagaatggctccaagccaccacaagggcagagccctcatggtccaagcaccacccattagtccccacctcccaatgcaaacacattgaagatcgaatttcaaaaagagttttgattaagagaaataaaccatatgcagaccatagcaatttcacccctgccccccaaaactcatgtccttctcaaacaaaaaatgcaatcatatcatcccaatatttccaaaagttttaacttggtccagcaccaactcaaaagtccaaagtctaaagtctcacctgagactgaaggcaagtttcttccagttgtgagcctgtaaaatttaaaaaaaaaaagttatttatttccaagatacactgctggaacagacatttggtagacatcctccttccaaaaaagagaaataggccaaaagagaggaatgataggccccatgtaagtccaaaacctaggtcaggtgcagtggctcacccttgtaatcccaacactgtgggaggccgaggcaggaggatcagttcaggacaggaatttaagaccagcctgggcaacataattaacattatttaaaagttagctggatgtgatgatgtgcacttgtagttccagctcctcaggaggctaaggcaggaggatctcttgggcccagaagttggaggttacagtgagccatgatagcaccacttcactgcagcacgggtgacagagtgagaccctgcctcaaaacaaacaaacaaacaaaaatgtctaaaatccagcagagcagatgtaaatggtaaaacacaagaataatcttctttgatttcatgtctcacatgctgggcaaactggcatgactgttgggctcccaagcccttggaaacccctgaatccatggcttctctggatgcaacctacatggctaccagtctctgtacttggaagtggggagaagcaggaaaatgttacaaagttatcagttcggtgactgcttgtaagaccttttaattttctttgcttaagtgctcagcatgagaaagtgccaggtttagggtattagtttctgagctccagtggcatgaactagcttaatacacgtgggagaagaaagtagacaatgattgtgaaaaacatttcagtgttacagagtcctttgtatggaaagcaatccagtccttagactttaagccatagaacattttgtagaacgttccatggagtagtgttggaatgcacttttcttctaaggtattctaactatatcagaatattcatttttcatcacctctgtgatgggctaggcagtgcttcctagagcttctgaggcctagtttcctctcactcatattttcctctattactgtgacccaaataaaaactcagtggaaacaaatccaacatcacagcaagctcattatcagttgtgtggaggtggagacctgctgtcattagtatgggggaggaattacacagcaacttggagaagcagtttagaattaaatagaaatggaaagaagtgcttatgaaaatctcagctttcataaataaaataatgttgtgggtgggttaaagaggtagatataactctttcatatgtctgtctttatattttcatagtatccattatttttcaaaaaagttttaatcttggctgccaaatttgctcatcacaactaattggaatagagaagaagagaaaataaggacagagttgaagtgacattgccacaatgctgctaaatctctcatgatctcattttcttcccatattcagcaaaattatccgttcctctattattcccacccttctttccctccctcttgcttacatttacccaaagcaccaatcagcttgaactagttactaaaactgagaaataacaaaaagaaaaattccaagttgtttgaacttgcagttttctgaaaattacttaccataagacaagttacaaacatgtgaatctaatgctgttttttaatcaacagttggcaagaccagtgaggtgagattctaaaatgtgctgcagatattttgctatcataataaagtgttgaagtttgtgaatggtttactttaaaaaaataaactaaggtgtacttaagatgatcccagtggtattcctaaaataccacactcacttgcttacttaaattccaagacgttttctgggcagcagaaaaaaagcatgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatcatgatttccaattcatccatgtccctacaaaggacatgagctcatcattttttatggctgcatagtattccatggtgtatatgtgccacattttcttaatccagcctatcattgttagacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgctttgcatttctctgatggccagtgatgatgagcattttttcatgtgcttttggctgcataaatgtcttcttttgagaagtgtctgttcatgtccttcgcccactttttgatggggttgtttgtttttttcttgtaaatttgtttgagttcattgtagattctggatattaaccctttgccagacgagtaggttacgaaaattttctcccactttttaggttgcctgttcactctgatggtagtttattttgctgtgcagaagctctttactttaattagatcccatttgtcaattttgtcttttgttgccattgcttttggtgttgtggacatgaagtccttgcccatgcctatgtcctgaatggtaatgcctaggttttcttctagggtttttatggttttaggtctaacatttaagtctttaatccatcttgaattgatttttgtataaggtgtacggaagggatccagtttcagctttctacatatggctagccagttttcccagcaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggcaattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatggtttggctctctgtctgttgttggtgtataagaatgcttgtgatttttgtacattgattttgtatcgtgagactctgctgaagttacttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactacgttgaataggagtggtgagagagggcatccctgtcttgtgccagttttcaaagggaatgcttccagtttttgcccattcagtatgatgttggctgtgggtgtgtcatagatagctcttattattttgtaatatgtcccatcaatacctaatttattgagagtttttagcatgaagggttgttgaattttgtcaaaggctttttctgcatctattgagataatcatgtggtttttgtctttggctctgtttatatgatggattacatttactgatttgcatatattgaaccagccttgcatcccagggatgaagcccacttgatcatggtggataagctttttgatgtgctgctggattcattttcccagtattttattgaggatttttgcatcaatgttcatcaagtatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtccaggaatttatccatttcttctagattttctagtttatttgcatagaggtgtttgtagtattctctgatggtagtttgcatttctgtgggatcggcggtgatatcccctttatcattttttattgtgtctatttgatccttctctctttttttctttattagtcttgctagcggtctatcaattttgttgatcctttcaaaaaaccagctcctggattcattgattttttgaagggttttttgtgtctctatttccttcagttctgccctgattttagttatttcttgccttctgctagcttttgaatgtgtttgctcttgcttttctcgttcttttaattgtgatgttagggtgtcaattttggatctttcctgctttctcttgtgggcatttagtgctataaatttccctctacacacggctttgaatgcgtcacagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggttcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagccggttattatgctcgttagttgatgcagtttcttcctagtcttgatggtctttacattttggcttgattttgcagcggctggtaccggttgttcctttccatgtttagcacttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggccccctctctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttcccttctccccatcactttcaggtacaccaatcagatgtagatttggtcttttcacatagtcccatatttcttggaggctttgctcatttctttttattcttttttctctaaacttcccttctcgcttcatttcattcgtttcatcttccattgctgataccctttcttccagttgatcgcatcggctcctgaggcttctgcattcttcatgtagttctcgagccttgggtttcagctccatcagctcctttaagcacttctctgtattggttattctagttatacattcttctaaatttttttcaaagttttcaacttctttgcctttggtttgaatgtcctcccatagctcagagtaatttgatcatctgaagcctccttctctcagctcatcaaagtcattctccatccagctttgttccgttgctggtgaggaactgcattcctttggaggaggagaggagctctgcattttagagtttccagattttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctgggggatgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactactgtctttttgtttgtctgtgccctgcccccagaggtggagcctacagaggcaggcaggcctccttgagctgtggtgagctccacccagttcgagcttcccagctgctttgtttacctaagcaagcctgggcaatggcgggcgcccctcccccagcctcgctgccgccttgcagtttgatctcagactgctgtgctagcaatcagcgagacttcgtgggcgtaggaccctctgagccaggtgcgggatataatcttgtggtgcgccgttttttaagccggtccgaaaagcgcaatattcgggtgggagtgacccgattttcccggtgctgtccgtcacccctttctttgactcggaaagggaactccctgaccccttgcgcttcccaagtgaggcaatgcctcgccctgcttcggctggcgcatggtgcgcgaacccgctgacctgcgcccactgtctggcactccctagtgagatgaacccggtacgtcacatggaaatgcagaaatcacccgtcttctgcgtcgctcacgctgggagctgtagaccggagctattcctattcgaccatcttggctcctcccagaatctcaacatcttaaatatcattaacaagatagtcctgaaagcgataaagaggatatatcgactaagtattgttgactttcagaatcctatctcactgtctagcatcttatcatacattagacaaatggttctacttatttttatattactatcattttaaaacctagactcctacctttattttttaaatcactgtttacctcagtaacttcgagcatgtctttcagcttctctatcatggatgtcagtacataaagttagaaaaagaaaactgttatttatggggctgtgaaggaataatcattgtagtactgcctggataactctccctgtacctttctgtcaattttaattattctcagtttgcaaggctcagcctcagatttgaccttcttgagattgccatctgtacctttgaagagttcagttcccttagctcaacgtacacccaactgcttaacaatggattttacgcctcatgagcacacaccacactctcaataagtaatcgactacattctatttttttgttcagtgttctatcactgctcaataaatattcaattactgctcaataaatatgcagtcattgttctttaaatatttttgaccatacctactatgagtcagtctcctttggcaactcaagatacagcaaaaaagcatcaatggatgtggcttataataaggtggagaaaacatattaagcaagcaacacacaagtaagtttcacttgtgacagttgtggtgagtgatatgaaggcactatgatgtttgtaatgcctcatattaattgccctgttgctggctgttaattagcacatatccaaccccaattccactgaaaatcttatttgatcacttcttcagttacttcttggacacttcattgtttggattttccttccactttggtgatagtctgctgtcaaatttgtttgtaggaccagattcttttccctgacttgatttcatctattctcatgttcccaaatgtgagtctccaaacagactcccctcctgaactctacacctgcagaccagccctccttcttaacatctccctgtgtcaaactcaacacacccaaaataacatcactttttctccatacttgcctttgaaatcccagtggattgcacttccattcttccaatagttcccaaatcttagaaatattacttttttctctttttctcatatctcacaataatttatcagctctatctccaaaaaatataaacagaattatttatgcaagatgagtgagttttatagatctgttgtacagcatagttcctatatctaataatactgtattgtgcacttacatttttgttaaaaggatagatctcatgttaagtattcttaccacatacacacaaaaggggcaagaacaaaaccttcggaagtaggtggatatgtctattaccttgactgtggtgatactttctagatgtacgcatatgtccaaactcattaaactgtaaacattaaatatgtgtagttctgtgtgtagcaattatatcttaataaagatatatgcatatacagaatcccattaatttttgccactgtgtcccctgctccaagccagtgttgcctttcccatgacaatgtcctgcttctaccacgtatctccttggagactattgtcacttcagaagccagaggcatgcttttaaattttgaatcagatgatggctctcctctactcagtcttgaagagtagctcccatttcaactcagagtagtaagaggcaaaatccttactgtggctacaaagttatacaggatgcatgaaacttcctgagacctcacacttctcctttcttgttgctctttcactctctccagccacattggctgacttgttttttctctaacacactagggtctttgctctagctacttcctaattctggatggctccagggataactacatggctcactctttactcctttaaccccccttttatttccagacctcacactctgcaaatgcgtttgcaatgaacctctttaacgttgcaacctgcctcacttctgtcacctcagcaattgagctttcctaaccctgctcacctttttattttttccacatcacccaaacccttctatcacacgatatcattatcttacttattttgtctctgcctaaacttctgctagtcatataagctccaggagggcataaatcttttcccaatgtatacactgaggttttccaagtgtctcaaagaatgtctggcacagattaggtactcaaggaaccctcagtaaataaataaatagatgaaagaatgaacacatttagtgattctttatttctaaagcaagaaagagatatcatgatgccagttaatttcctgagatagaattccttacaatacattggattcagacattaactgcattaagtataataccagaaagaaaataaaaagtaccagaggagaaaaaggaaattaatggaggataatacagtagagctttacttctaagagttgtgagacagagcagagcagtgtgcttatcttcctagggcattcctcattatgccctaacttcttgcttggcacatagcacatagctggcacaccatcaatgtgtgctgaactaaactgaaattctaagagacataagttaatcactaaaaaactattggccatagagttgatagaactcttcttcatggttcttgaatgaatttttccaagaaatattagaaatcctaatagccgataagaaaaggagggatgaggcatttgagaccaacctggaaagggtagtaagacctcatctctacaaaaataaaatgaaataaattagccgagcatggtgatgtgcaattgtggtcgcagctactcatgggactgagatgggaggtccgcttgagcctagcaggttaaggctgcagtgaaccatgattatgccactgcacctcagcctttgcaagagagcaagactctgtcccaaaaaaaggaaaaaaaaaaaaaaaggatggatgtcaatggggaagaatacttgcgggaatctttgcatatactttgccatttctcagaaatgcacaattcacattaacatgttaggatttggggagatatttctttcttgaaataaggaaacaaatttaacaaagttcagcttagaatttccaaatacttcacaaactattggtgctacagagaacatggcattggaaacactgaaacagttggccctgcatgtccctttccaatagtaacaccattgggaagcagagcaaaagatttgctgtaattccttagacctgaatttgagatccagctttactacctcttataaaagtttcctgggaaagttcttcctactttgtgaaactcccctttatgcattcctaatatgagactgacaattaacttaaagattatataggtcaatgcacatgaaagatctaaaagacacccgtttcataacagtatgttaataagtgtatgctgaatctgaagatcccattcttaaatcttagatctttcatctttaccaggagctcttgcatcaaatagtcaattatgagtaagtactggagctaagtgattatatttcttatattcttaatttacaagtggtgcctgggatgcatttttaaggtcatgtaacttttttcttattcaattgcttgtttatcctataacccctgttacattacaggtatttttaacattggtttttctttggagagatagtctatacagtggggactagcacaggtagggtgagaccacacattcaaatcctggttcttctctttactaagtacttgatttcagtccaattaattagcattagtcatctcagtctcttaatgtaaaaccagaatcacagggctcattccaggaggttactgcaagactcaaatgcagcactgcatataaagcacataccagggtacccagcaccttatgaagcacaaaataacggtacgtactttcttttttactgatattgatagtctttctcttcttccttcttgtttttaatcttcattttctgtagtcaaaatataacacattaaaaaatacaatgaaaaataattatacccaattccaattgacattgaaattcctagcccaagactagcagtggccaccaaggggcttccataagagaaagaatggcattccaagtgcagtgtcctttaaactaccaagtctgtgtcctcaggaaaagaaaatcaacctcaggctgaagccctggatctgaagggaactttctttaaagagaagcagtagcgtgacttttgcccaattctacccctccaggtgttattttaatgacaaaccacagcaacatatttccaaccatttcttcctctgattgacttgtaattggagtcatacctaagacctcaatcatctcatgggaagctttggggctgggagagcccttcaaatttgtccaaattgagaaaagagggctgagtcttatcccagcctcgctcctacacatgggccagtcttaggtaggccccaggaaggaggcataacattggccaaagaggttctcttctgctgagagagcaatgtccagagagaggctcagcagaaggctggtagctgataagacacccctcagctgagcctcagtctggaggggaatctgggccacacaatatggcaccaccccaggggacattgtaactgggtttatgtcatgtctatgtacatgtttgatgcaaagtcagagaaaagaaaaaaggtaactataagttcagagtgacccttagtctgcagttaatgctgaaggataattattagtttcagtttgggactgttgcttgacgaacagagacaagcatttgaaatggtaaaaacagagagaacagtaaccattggactggtggcaggaggcctattagtccattctcatggtgctgtgaagaatacttgagtctgggtaattaataaaggaaagacgtttaattgactcaaagttctgcagggctggggaggcctcaggaaacttacaattatggtggaaggggaagcaaacatttccttcttcacatggaagcagtaaggagaagtgcaaactgtcagatctcatgagaactcactcactatcacgagagcaacatgtaggtaaccacccccatgattcaattacctcccactgggtccctcccatgacacatgggattatgggaaatacaattcaagatgagatttgggtggggacacagccaaaccatatcacctggtttttgctcctattgggctacctccagtgtgacaccatgtaagttactagcccctctggcttccatttcacatctgaatgcagtctgttggcataaattaatctttgagggccttgaggtttaaagtgtactccatctgaaccttagaaaggacctggctccctgacgtgaaggaaaattacaaaattcacaaaaccttctaaaatgctaactcttttattatggctgcttaatgacctttgttcaaggtacaattacttatagaaagaaatcagttcttggaagaggactagcaggtaatttctgaatgtacttgctgttcagtactatgctgtgaatctgaacagatatttacttcccatcaaatatgttgcacatgtgtgatgtggagcacagagagtgtcacgctggacatcgcatgcctttcaaatgtgtctataattcagttatatggaactataggtgatttttttcccatataagtaaggttgcaaatgctggttagattcccacactagcccatgcgttagcctcgtaagcttaggttgaaacaaacaattgcaataataaatagcaagtttgattagtgcaatcctgatattatgtaataaaatatagtataagaaaaacacaggagaaaatggttttagaaattagtttgtaaagcttgattctgtaaggagatacacaaaaatgaaactatgctgaaatgccatttccattcatctgattgacatacagatcaaaacttctgtaatacgcagcgtttttgaggctatgaggagagtcagatattcagatgtgctgctcggaataaaaatcagtacaactgctacagaagccattttggcaatatctaccaaaattacaaatatgacccaggaagttcatttacagaaatctatcttagaaatatacttcacatggacaaactcatgaaatacattagtttagaagttagtctataataataaaataattgggaaaaaaccaaatacctatcagtagaagggtggaatatcattgaacaaggacataagaaagaatgaggaggcacctatatactggtatggaaaactattcaaaattcattaatccatgaaaaaacaagatgtaaaacagatctgaactggtgaacacagagagtggtaaactttgtgctgggggtgggaggcctggtttgcattcctactgcatatactgtgttattatttgtagaaaataagaacaaaaaatatttatttatataggcataagatatctctgaaaagacacagaagacactggacttaggcagctctgacgagagaagctaagtggctgggaactcaaggttggaagagaaatctactgaatacccattttatcttttacaatgtttagccatataaaattgtggcttgtttaaaacaaataattttttaaaaaatagttggatagctgagagtatcaagacaagccaatttaattagaaaaggggaagagagagacaagagaaatggggttgtggaaagcttggtggacccctggctgtcttacagctctgggtagtgttaccagagatgattcttggggcaagggaacaagagagctatctctacccatccaattgtttcaggagagccaggggcttataattgcagagtctttgaatgcctttgtatattttcatagaaagaaaccttggaggccactgagcctaatggaaagagaacttgggtagcaaccaggagactatagatctaattacaaacagtcaattatgtggttttagctgaatcatctaatctcgtggttctcgattctggctacatgttagatttaacaaagaagcgttaaaaaactatagtcaaagttggttttgatggtgggggtgggatcttactcagaccaattaaaacagaatctgtaaggaagagacataggcattggtatgttctagaagttcctgcggtgattctaaatcagagatagggttgaaaaccttttctttccttttgtagttttattttagtgttataacctgtcaaattgtgatttataagcatcaaatgacacaatttaaccttataaagtgttcttaaaataaagacaaggtttgtaagagcttgctacggtgttcactacatgaaaatcactcaaaaaatggtatgtatgcatatgtcacatgtctgttcaaaaatcttcatcggacaaatgcaaggaggtcttgactatatctattgtgcacatcaaaacccaggaaaggcagttccctcaggcttatcagaaagagcacagaaatttataatcagagcaatctggggtcagtttcactagtaccctgctgtgtggtcatggagcagtttcactcagcatgcttcctctggtacaaagtggtcataacaatacttggtaaggttgttggaaaaaaacagacaatgcaattaccacacaatatttttacataatcactactgtatccactataattaaagacaatgtataacaaatatgtagattattctagagatgcaaaataaattctctgatgagaaaacagcatctcaagaattgagaggaaaagggattcaaacaattatcaagtgagaaaatacttcacaaagaaaaactgcaaaactaaagctacgtacgtgaacactgttttgcagagaccacatctagaccctcagcagtaaaggttgtgctttttggaaaacgaagacaaagcagcaggaagaagagaaagggttgcaatggctagagggaagatgagggcttccaggtaggttgtgtgatgctctgaggaaaagccggtcatatacttgggtattccaggtcactctgctggaaccctgcttttaggacttctcaaatgaagtgactactagcctcttctcagagtcacatggaagacaaagaatactgatggaagaaacagctctggacagcaactttggagaccatgatgtccttgagagaaaactgaactcttgcagatgcaagatgttttaatctaccttccactccagatcaaggaacggtaaattagggaaataatgaatacgaagtacaaactgctggttattgatttgagatttgatatcacaatttgatttaccagatccactgtttagatgtccatagcactgactcttggctggagattgagtgtgctgcatgggggacataagggaggaaaatatctttccttcttctgatcttaggttcatggttgaagcctctataacaaaagacagattaacaagagaaaaacatgcacatttatttcataaaacttttatgtgacacaagagttgtcagaatgaagacctgaaataacagttaaacctgagttttgttttgttttagagtaagtttgaagagtttatagtcatgcagaaatattacacagcaaaaaaaatgatctgattgtaataaactggaaagcttagcggagactgtttgtgcagaattttccctgtgttcctgcatcttcagagataaggatgctactgtcctccagatataaggagggtacctctcacataagtgtctatgacctgcttcaggggaaggtcagaaaatctttcttaggttttacgacctgcttcagagaagaagggtgagggaaagtgagagtaacccttttgcttttgctgttttctcaaaattgctttagcttaaaatatcgtggggtaatgtgtcccgaacctcattaggtatgggaagagtacacttgctttgacatctgcagtctcatcataggttcttagtctaccaaagtatgtaacaagggatggaaattctgattgaaataattattatatacgatatggtagattttctcaaagtattcccctagaaaaccttgtaagattcaaaaagacaacatgcaacatgggagttccataatccattaggtttggaaaatgaggagttaaatatctcaaaagaaacattttcaactgcaggatttcttatagagtttagtgtgctaataggctttatgagtcttctccaaacagatctaatacatggcacttcctaaattttggggactcttgcaactgaagcactcttagagaaatgttgtagtagctggtaagataaagctgggtaacagtaaatgtggagggagatatggaaagatacaggaaatcatacatgtaatcttaacatactatacataaattcttagccaatgggtagggaaggaagagaatgtttgtctacaccacttccactttcattgatggatccaacaatacagagactctgctgcactgggtagaactaagtgttctaaattttcaaatcaactgcaaagaagatgtaatagttaatattagatgtcatcttgactcgattgagggatggctaggcagctggtgaagcattatatctggtgtgtctgtgagggtgtttccagaggagattgacatgtgtgagtcagtagacagggagaggaggaatcaccctaaacctggatgggcatcgtccaattggctgccagcctggctaacagaaagcaagtagaagaagggggatattcagttttgcagcgcttcctctctatcttccttccccagtgagatgaattttcatctcctgcccttggacatcagactccaggttctttgatctttggactctgtgacttattccagcagcctatcaggggctcttagtccttcagcctcatactggggactgtgctattggctcccctggcttttaggcatttggacttgggctgagcatgctaccagctttttttgttctccagcttgcagaccgcctatggtgggactttgcttttgtaatcatgtgagccaattctccctaataaactcctttttacatatacatatattgtatttcttctgtatctctagagaaacctgactaatacggaaggatttatatcttactgttgaaggtatataattgtttcctaattcacaagacctaggaaccaacttgccaggcagtgatttgtagccaacttctgacaacgaagtgaatcaaccttaggatgaagctggacctatggatggtagcagagttgcaaagaagttaagttcctgaagctatcatagaattactcaatcaatcagcccttaagctttttttacttctatgcttacgaatgtgtggagtatttaattcctttttatttaaaccaaattgactcagggttcctgttattatagacagaattgtgctaactggtacatgtaccaagaattaataatgcaacacccattaacacaggacgaagcactaactatgtgcaaagcaatgagaatcttgaagaaaaaggaagatagtatcaaatatgcatgtgaggaagatatgctatgacctggaattccttcaacctgatggttgaagcacacttgaggaacttgacatagatataaaagacaaagatgacaaaaattatatccttgagggaatagactaccattcaaactgaagatgagaatttggcagtccaaagacagatatcagaacagccacagatgaaaaataccactgtgatagaggagcagtgccgttcttgacattagcttggagtctcagcagggagaggaacattcgataaattttttatttgccttacaggcaacttcaaactcttggaagacataagaaatgatgacgagaactattatttctaatctaaaagtaggtgttgctgtataaattggaaacaacagaggactcaggaaagcactgattctcatccattgaaaggatcctggcatactcattcaaaattgaccacaatcaggatttccctaaaggggaattataaaagaaacagatcaaggaatggagagacagcccacaaggaaattgtggtttaataaatgaccagcaatgacaaagacaaatgaataaaaaggaactaaagtggtgccacgaggagttcactgataaattgagatttttagcaacatattttccagttttattaaaaaaaagacatgtaacaatagagaaattcaaacggacagcatataattataaaaacactatctagaagactaaggttcagaataattgaggttttcaaaaaagtaaaataaaaataaaacaaaaacccactttcaattatattaaatgtattttcagttatattatgagcaatgtgattaggagggctgggtggtgattataaatgtacacaaaaatttctgtatgaagttatttattacagtgttacttaaaaggatacaatatttgaagaaaagacctgataacaaatacttagttaaaaattttaataggcatatagaatgatgtactaagctattaataaaattatatttatgaataattttacatgtaacattcattttatgatatgttaagtgaagatcacaagacaatatatttgcagtgtgatatcacttttgtgtgtacatgtatatatgtgtgcatgtgtgcatagaagagataatatttatctatggtggtgatattttgagatacttaattctacagtgatcctatattactttgtaataaagagactggtactatatttaagtaaaaataaattcttagattttaagtacaaattaagttaaattcaatacattaaaaacaattatattagagaaatgtcaattatattatggttaattatttctttcactagttacaatatagggttacataaatagaacatgttctgacaaaaaccagatagaaagtcaaagttctgtagttttctatcaaatataatttttgtcaaattggaaagggttgaaccaagttgatcaataggaaaatgaactcccaatagtagggagaacatcaaagattctagttgctctaaatgagttcacatttcctggtcctgctctctagactgttacatctgtgagtactaagagaagaagtcaatcatactctgttcaaaatttgagcagatgctctgaaatactgaaaatagttcaaactaattatcacttttaggaaagtagagaaaacagagttgataaagtattctaggcaaaggtttaagatgacttaatcgatgatctgtgagtgcctagcaggcgacatgctcatcactacaagttagtaagaggacatgtcacataagtcagaccaactctattaggaatgaccacacctagtggcaaaatcttggtttctaaacagcattctccaatgcacacaaccagggattcttggagaagtgattgacagtggagctggggcagggagaatataagatgggcctggaacgtcctatgactcacaaaagtaaggcaatactgaagaaaggttgaaggcctatctcaaggacacagaagtcaagctaataagagctcccaaacttagaacaatgagagagagaaaataaatcatggctatatcaaattataactcataaattacactaaaattctatgaatctaacttgatataaataaatagttgaataaataattaaagggaaaaggagcagctctttcttacagaggaattctaatgaacagaagtagaatgggcaagatagaaaatcaccatgagcacaccacagtaataatggtcgcaatacatggatcatctatgcatggtaaaattagtgggtgaaaatttcaggagagacaagatgtttgcatggcctgaaagtatctctccaaagatatttattaattacaaagaaaaaaaaacagtaaatttcttttatacaattaaagaaacctgctgaccccagcataactggtaagattaacatcaccaatgaaaaagcatacttgcatcatgattctcttaaatgatgctcaaacaaaggcaaaatgtcacttctgtggccttcttgccaagaatgtataacttcaatctaatttgtaaaaataaaaacagacagactcaaactgaggggcattctataaaacaacctgaaagacaaagaaagactgacaagactgtcacagattggaggccacatggtaattaatgcaatatgagattatggattggaagctaaaattgaaaagggacagcaatggagaaactgataaaatgaaaataaagattgtagttgagttaatagtatgacatcagtgtaatttcctggtttgggggactgtgctatgatgatgcaagtttttcacattggcgaaactgaccgagtggcgtacagattctctctgtacagtttttgcagtatttttgtgtgtctaaaattatttccaaaaaaaagttaaaaaactacatcattccagattaatatgttaatggatatctaggcagacaaaatgaagaaatatactacatagtaacactgttaaactcaaaactacttaccacagaatattccaaatgctttgatgagaacatcaccttgaaaagtgtcctcaaaatggaaccaaaggtcattccaggctttggcctgctgttctgcactggaatcaggtttggatgagtaccaaacttgtatatttttcataagaactgaaactggggagaagaaataatatagtagatgaaagcacctagtacccaagttaactggaagaaaaacatattctaagagaaataagcaataattgccttttgtttcaaagcaaccgtctataccaatatagaaaatgaaagatgctgcttatcatgaattcaggcgaaataaaatatgtgagtgacagctgccatttatttaacataattaagctctctttattgaaaatctataatgaggaaaatggaactttttgtattattcccaaaggcagaagcaggagcaagcatagacattactaggaagcaattactggttcagaacaagaaaacccttgcagtggttatttacaaagcacagagtttcatttgggtaagtggaggtattcaggaagaatagaaggtctctgagatcacggaactgagatttgctctgctaagataaaagtttttcatgatctttatgagtgcctctaaactaaaataccaggatgcttgacattactatatgtaccgtgtgtgtgtgagtgtgtgtgtaaaacaaagttgaatgtgctagctattttattatcataagtttatcatttgggaggtggaaatttgtgattgaatagctgtgtgatcatgccattccatgctaatatccaattttgtgtgagcatgtcattccatgctaatatccaatttcttttatttttcaaaagatatttactgtcctgtgagcatccacagagagttcggatggccctacctttttttcttttaagcttaagaaagtaatgagaaatgaattagagttcttccatgagtcaggtttcacgcaccagagaagtactggggaatgcactattgatctattttcttcaactcatttcctgtgtttaaatggaaatattgatacctatgcataggcttcttctgaggttttggggatgtgagcctgtgtcttgtgtttgaatcaaagtaagatttagatttcgtggtattaaaataagaagtgtgagggacaaaataaaagtctccaaggagaaagaagttggaaaaaatctttaatagccttaaggttcctctcacgtagttaccactaaggttttggatgagaatgcagtagacagaactcaggctcaccaaggagttaactaagatggtggttatttacattgggaacactgtcttccactgaatacattatttttgctttaatagaaggatttattcttcaaaaaaggtctcttcccatgtatttaaaggttagctaatgggtcactctttgcctaagagaaagaataaggagtgtaaaaggtgtagaaacaaaacaaaagaaattgtagataaaagttttattaggagctaccagtaatttctgcaatcaaaaatgggcctgtgggtggctgaggtgggcagatcacctgaggtcaggagttcgagaccagacctgaccaatatgatgaaaccctatctctactaaaaatataaaaattagccagtcgtggtggcatgcgcctgtaatcctagctactcaggaggctgagacaggagaatctcttgaacccggaaggtggaggttgcagtgagccaaggtctcgccattgtactccagcctaagcaacaagagcaaaactccatctcaaaaaggaaaaaaaaaagaaaaaaaaataaatgcaccttttttttttatggataataatgcaaatccctgggggaaaaaaaataaattttaggaaatgttatggctaccagagaatgtcgtacctaaaaattaagtttcaaaaaaattctaggaaatacaagagcttttgagctacatatgtgaacaatgaaggaaaaactttcacatccaccctgtaaatcttaagaacaattttgattcaagggggcctcttggctgagtctagacagcctacctttgaattcaagctctttgctacttgtgtttctaggagccaatgctaatttctgggaatgttgtttaagaacttctacttactgtgtactcattttggcaccattgcactccacatactcacaggattttgttaatagggactgatgcttacttaaaagctttattagattatctgagtggattgcactggtccaggtatatatatccatcacaaaacctcttcatcctttaaattaagtacttcatgaggacaacaaaaagactggagaaagtctgaatttactctatggaatcaaccgtatgtaatttacacaattaaaaaaaaaacatgcttttttaaaagcagacattagagaaaaatgtaaggataaaagtaaagttctctatttcttcctccacctaccccactctctctctaactcccactggtaggattatgaaggcgaccatttttagtatttttgcatgtatttttgcagatttttctttaaatataaaagcataattacatattatcaatgtaaaacagtacatattttttaaaactttcctattatcacatgtacatatgtctgatttttttcaacagctgcttaaaattacattgtatggtcttacccgtacttcttcaacaaaagtccttgacttctgtacaattatgttgctgtcagttaggctttcgtgttttaaaaatagtgcagacatggtcgtaaacttatcttgacatacttttatgagaatatttatgggatgtcttcttgggtatgaaactgttgaggttcagagtgtgtatatttatatatctattcttgttggatgatgctcgtatcgaggtattgctgacttcatttattagtgacataggtggatactcgttactctctgtttacatcttgagaaagggaaacaactttctatgtgagaacaacatggaacaagttcactttgcatatgaattaccttacatgtgaggattgctttctccaatgccctatgaaatatggctactgctatctttttttctaatattttctaattttttttctaattattttttagagcagttttaagttcagagcaaaattgagcagaaagtacaaaaatttcccacatacccctggccccacacatgcataacctcctttgttattctctaccagactgaggtacctttttttttgttttttttttacaactgtgcaattgatgaacctgcattgacacatcattatcacgcagagttcacagtttatataagggtgtactcttggtgctgtacatgctagtggtttggacacatgtataatggcatgtgcccaccatgacagtatcagacagtgtatctgcactaccctaaacagcctctatgctctggctattcatctctccctcccctgacccccagcagctgctgacctttttgctgtttccatagttttgtctttttcatacaatatgtatcccattttagtctggcccctttcacttgtcaatatacatttacatttcctccatgtcttttcatggcctgatagcttattccttttaagtgctgagtgatattccattgtctggacataccacagtttatctatttacccactgaaggacatcttggttgtttccaagtttggtcaactaggaataaagcttctataaataactgtgtgcaagttttttgtgtggacatgagttttccactccttgggttgctgctaacattttattaacttgggcatggcctcccttgtgaggtctggcagcgccctcacaagggagttttgtaaccagccctgggattttgctcctgtcagtggtaactgcagctgcctgagaggagtcagtgatgaaattgttgcgcagaggtgtagatggtagcataacctatcttttggaatactgtaagtttattcaaggagaggagagggtgaagagggttacaagttagacccattgttcctgatactttggttgtggaaaccccttgccttacaactacacagaaatcagaattagaattcagatctggattaccatgtttgtttatgttttattatttttcttaaaaatgattctctgtgattctaaacacagtttatttgcatatctaaaactattttcctagttattaatttactgttataattaatcagattttatataaattgtaatagttgaagacattatttcagatatcaatagtttattaagcttattaatagcttaatagtgtattaagattaaccatgtggcaagaaccgcattttgtacaccatcccatttatttttaaaagccatcttatagaataagaaaactgagaatttccatgagagataaggaaaattgccagagctggtacatgactgggctagattcaaagacaggttcctcttcctgcaatgctcgtagtttttcacaataccgaccagtttttattgaatttgtccttggggaaattgtggagcataatgcatttgtactctggtgaagagagagacagataattgctgtaattctctggaaatcacaggagcctagcctaagtccattctgtctccatcaaataagcatattccttacagcacttgccatacatatcatgtactttagcacatatcatgtactttagcagtaaattacagactcttgtactgctcactgttttcctttccatgggtttatatcatctctttcgaaatttgtaataaagtctgtatccaataaatctccctcccctacctccactctcttttgaagcagtttaaagatgacagccagtcagtgaatattctctgggtgtgtgctatgcgcaaggcactgttttagactctggggatagagcagcaatcaaaacagcctgtgccttcagaaaatttacgttccactggaaagaaaacaaggaaacaagcatgctctaaagaaacaattttagataatgatatgtgtcacgcaaaaaagtaagctactagttaatataatagagaatagattggaatatgaaggacctgatatttccctggggaagagagggctggaatctctgagaaggtggcattggagctgaaacttgtcccttcagaacaggacgccatgggtggggacctgggagaagtgagctctgctcagaaggaaaaagaagtgcagggaacttgacgtgggaactagctgggtgtgtttaaggacagatgaaagtctgatgtagctgggtggctgggggcaagtgcacatggcaaagagaatagtggagtaaagtagccacaagtcatgtggacctgagtttgaacttcattcaaatcagaacaggataccaacacaatactttacatgggggagtgatgtgatcttttttattctacctattagaaccagtacaccagttctgggaggatggacagcaggcagaacaagtgcaggagtgacaccagttaagaagtcattgctgtggctcaagaaagaaatgataggtcttagacaagcatgcaacagtaaagaaattaaaagtaatcacattgggatagagacagtgggaaagactgatgggtgatttctgaggcattaggggaaatggtgataggatcacccccccctccaagactgcacactgtgggaagatcctcgtagagaggtgccatttgctgagatgtgtaagtgctgggcaagagctgacttttcagggtcggggtaaagtggggaaatgaaaggctttgcttgactactacaaagtttgagtcacctatgagcctgggagaggtcgagcgggacctacaagtgtatttgctccagggttagacatgtgaatatgggaggtgttgagcctatcagtggtagttacagccatggttttaatgaggccacttagggaaagatcttcctgtggttgatgaagagaatgggacacacgacagagccctggagcctctagcaattaaaaacaagaagggaagaggcgtgaagcaaactgagagagacagtgaaggaggaaggaaatgacaaaagcgtggtgtcagggaagcaacgaaggtaagcaggagcaacaaggggaagtgaaatctaggtcatttttattgtttgcttgctttgtgtttgttatttgatttgtgagatgtattaaggcatacttgcatgcccaaataaataacctagtagaaaaagaacactcatgatagaaggggtaactcaggaagggaagaatgggcaggagggttgagataagccatcaatgtggctaggctggcccttcctgctagaatgagcacttggcttggctctctgcactggaaagaaggtagtctatgcgctcagatgcaggcacagagagaggtggctttgtggatgggtagatgaggtagttctagtctgtttctgttatgttctaaaaatatgaggaagtcatcagctaagtgtgggggtgaggaagaaatattggagatgtgaagagagaagattgcatgaaatcatcttggagagtgggagagtgaattttcctagggaagcatcactgggtggttttaaaaatctgaacaatacatttgagtctcaatgtactcctctttccagcttcatgatgttggaaaaagcagcttaaatactttaaacttgctttcccatcagtacaatcattgtgggtttttgcataacatctatgagatgttgggtaccttcatatacactctccaatttattctgtaaaattgggataatgacacctactagaagagagattatttgcaagaactaaatatctatatgaaaggctttgcaaacagtaaaaaacaaggcacttaaaatattttcctgccgttattcttatccacaaatcctagctcaaactatttagttcttgatcgatttttagaatcccttctagtttgattcctatatctgaagtttggaaattgagcttgtgtttctctaaaggaaaaacaagatgtttaacacagaaaaagatttttttttcttttaaagtgttcttaacattcctcggattctggcattttcttgaaataaaattaggtatgtgttttgaaatgtcaagttttcaaataaactcctacaaacccgctgcgaagttgctccctttgctttgctaccttctgcatatacaccttcagtttcctccaggtgtcccagctccagccccacattcctgtgccaagaatcacaatgacccgtacatttccacatcacctttcttgcaagaagtttaacacatttggcgaacattattgctggagtaataatagttcctcaggtttgtagagctccagctttccctggagcttacaatctgcatgcatattacctgatttagtctcccatcaccgtcttggagcaaacattagtattagacttgcagacgggaaaaccgaggtcttgaaagtttacaggcccagctatatcatttgctttttatgtccttcttcctaactttccagcttctagtagtcttttgaggcccattgcagcctgtctgcaccatgaaacctttcctgttaaccgcagtaataattgattctgctcccaaactacttacatcattgtgcttacagacagccccatacactctggtactgcagtccagtgggaggtaatgtggtactgtagcttggaaagaagacacatcagaacaaaacttgaactacaagtaaactctgccatatgctagctgttatttaaaatctctgaacctctatttctttactagcaaaaattgcaaggctattatgaaggagaaggctgatttatgcaaagtgccttactagcagagttcctaccatgattggcactccatgaatcataactctcgggttacagcaaaagtgtattttatcatttactaattgtttcacatgaatatactttttactctttaataataataaagtcctgcaggaaacaaccaatatcatattatggaatggaattcttaggttttgcttctcttcatgcaattttaatcaatgcagccaagttacacatttttctctaaataattctttagttttgctgtggagtttttcacatttcattcatctttaaatgtattgtcatttcttttatttctcttattattgccccattaatccgtggtttaatatctgtgtgttattgagtttgcagatgtataattttaaacatacattattatattatatattttaattggattagattgtagtcaaacctgtatgtccctatgtggttatctctttgaaagttaaagaggtctctcttgtgacataatgaaggtcagatttttataaatactccaagtgtgctgcagaagcgtgaggatccttggctatgtccagttcacacggtcacattgcacaacatttttcctatgcataaaatgtatcactttgcctttcttctctttcccatatggaaaaatatatacatttatatgttattgtagtaggaaatttggaatttcacctgagtttctttagagaggttttttaaaaaagctcctatgtaggatagagcatagagaaaggaggtgtattttggacataaagaaaggggaagatgcttatcaagtaactattgtatacatggttctttagatatgctccattttaactcccatttggaaaaggcacattaccttcattttaaagataaggaaactgagacttagaaaaagtaagttagatttttgaagccataaatctatttaattagaacactgaaatttcaatccaagttcatcagagttcaaaatctgtatccttcctctgaggaagaagaaaaataactaagtaggcaaacgtgaaataaactgtggatttcttgtccctccgctttgttcttcctctgttatctgatttccccagcgttctaacccgcaaagtgaaaagggccagggatgatctcagagacaggtgccaagccctttcttttgtgatcaccacgctgtgcctacctttcccatccacaattccactcctgacaagtgagagtgcagacaggttgaacaatccagaagaagacagagatgccatatggactcaaaggtgagacaggagcctcactggcttgtgtattcccacagcagcagcaggcacttagcaagtgatgggaggtcactttgcaaatggcaggcacccaacccttgagcaagaggtcctctaccatacctcagtttttgtcataaaagacatttcatttgaacatgaattaaaggtatgaatttggtttgtatgtggatgaggaaagtttagcatgaaaatcagaaagaaaaaaagacattggtgggtaaggatgatggttgtgtttgtttttacggcaggcattaatgggagagaaaacgtatcattattatgaacataatctaatagtgaatatgtgcctattattcactgtgccatccaccctgctaagaattttgcatgcatcatttctctttaccccacttcaatcttatgagatatacatgcctattatctctggcacccatgaccaaactaagtcccctgctcctcccacttatcacaattgtgcaatataagaatttaagtagtttaatctgcaattaataactacctcccccataagactatattctctgggggcaagatccatatcttccttttttataactctatcttcaatgccttgcacaatgcttgctgcataagtaggcacagaaacatattttttggataaatgaatctgcttttacagatgttgaagtagtaagtaagtggcagaatcagtatataattccagacttgcctgagcctcttaagtgctgcaataaataaatgttcacttccttcttgggcaaaaataatcatatatattcttagaggcaagaaaactgtcccatccccaagaagtgccccctgagtactctatccctggaggggttcacattatcctaccaatgtccacttccttttttatcgtgttctgagataatacattcattctttttttgtttgtttgtttgttttcggccgtttggctatggattccttcagagtacatcattcactatgtatctccataatgttgagcacgtagacaacatcgatgtttgttgaatgaattaatgagtgagtgagtaagtgaactgcccaggctcagtgcaccaagagatgtacagtcagttaaccttgttcattgagctgcatttcctgtggagtgatggggggtacctcactgtccttctctttcacatggtctactggaaccaaatgcctgcctttgtatgatagctgcgcagaatcacctaaggctgaagaaacaatgttgtttaaatttcttttccattgtgtgaaggtcattggccagtaaagagatactattcatgcccttaagaagcttgcaatacaggtttcctataaatgaggtactaaccttgtttgaaactcagaatcacagactctacattataagtaaccttggcaatagtttaatctagttctcacccttggccagaatcccctttcctgtaacatacctgcagagacttgaaaatatgcagggatagtgatgttgctacctcatcaagcagtctcttccatagttgaacggcatttctgccaagaaatgttttaattgttttgagctaaatctttcttacaataacttcatccaatttgctgtagtttacagctgtacaaaagaagttgcagccttcttcaataactatctgatggtaattctgaccttccctttcaccttttccccctacacactttgacagtctatttccatatggcacacctcagtgccttcagtgttcctcttgtgattatttcaaatgtctccccagttttgttcacttttctgatcatgctctgtaggttctccccaaaaattgccactcctctgcaatggagtggatgtttgtgtccccccagaatttttatgttgaaaccctaatcccaatgtgattgtatttagaggtggaacctttgaaaggaaggtcattaagtcataagagtggagccctaatcatgggattaatgctcttataatcagaagccagagggctaacttgcttttttcttaccatgtgaggatagagcaagaagatggttatctctaaatggtgaagaggacccttacaaagaaccccaccatattggcaccctgatctcagattgccaatgtccaaaactatgggaaataaatgtgtattgttatgtttaagcaacctaatttatggtatttggttatagcaatcagaggtaagaacccctgcctcccactaaaccctagttgtggcctgataaagatgagtacagagtccgactagaatgtcatcttttctgctggggatagcaaagccatgcttaggctattttggctaagatgccccaccaataattttcttcaaatctattatttctatttctgttttttgtctctgagcttatactctgagatcaaagtttcatgcgcgtccatgtgaagagactaccaaacaggctttgtgtgagcaataaagctgtttatttcacctgggtgtaggtgggctgaatccgaaaagagagtcagcgaagggagatggattatcattagttcttataggttttgggttaggcggtgaagttaagagcaatgttttgcgggcagggtggatctcacaaagtacattctcaagggtggggagaattacaaagaaccttcttaagggtgggggagattacaaagtaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacaggggatgcgatggcttggcttgggctcagaggcctgacacaaagcaagtagaatgaggaccaatttcaagctccttccacagccctcctatcttagccacagtgtcctgaaaaatacactctgagtccaaagcttttgctggggaatgcaatcctagagaatcaggagtgagggaaaatgggatggagacaggaaaacagggaaagtcattctaaaggggtgacatttcaaactagccacctctcctcataggcttcagagtggccttaggaagagattacactttataacagtgtgtctagaggatgaaaagaaaagaatttgtcctccaactctgtcattgatacgttaactccccatgctttcagatgaacatttgtgagcacagactacctcctaaaggcatcatgtctcaggggcaggactccagagatgtgaggcttaggcatgagccaaggtgctgtcagatggtggctaggccagctgaagcctgggggagcagtggcttcagagggactcctggtctgcagtggcagcagtcattgaagctaccaccagaaccctgtgttgcaaagcactgctgatgccactccagaaaggcaagcatgcggttctgcagggatctctgagtgcagcccatctcacctcctgcgggctctagccttcccatatttagcaaaagccttggcttttaagaagcttagggagccagccttaacttatgcatcaattccctgggaaggcattttctgaaccttcattctaggcccagtgccagggttatacactctcagagcatttatatgttcccgctccttgtctttcataatcgtgcgttcacttgtgtgaatatttgctaatgtccatccctggtctgacttcaagcaccaagcacggggccttttttttcttttcttttcttttgtttttgagatggagtcctgctctgtcgcccggagtgagactccactggcttcaatctccgccttccggattcaagtgattctcctgcctctgcctcccgagtagctgggattgtgggtgcccattgtcatgcccggctaatttttgtatttttaggagaggcaacgtttcaccatgttgaccaggctgcacggggtccatttttgtgctcaccgttattcctacagcctcacagaatcctggacacaaagaaagacttaacagggttcattcattcctgaaccaaagcggctgaacgatgtcaacaggaccagagaggctacaggaacgccatattttcttctacatctctttttttaaaaatcttatttcaatggagtcaaactcaataaggtgaattaaaggaaaaagagctgacccaaacaaacaagcaaacagaaaccttttctgtcctgtaatgtttaggcgcagataagaagtgcaaatagagagtttaaaaagctaataaagtgttttgtttgaaaaaaaatatgtgttgctacaacttggagaaaagactgtctgctgcaaatattaatataattcactgtccttttttccaaattctactcgaaataaaatattcagtttttttaaatgattgtcagtaataagaatgtaatgcttagtgtctgtgacattcttttgacatttttcatgtagttcctgctatagctagttagcccataggttttgtcccttgccttctaaaatatgtttttcccttttgtttttcacagttagaccagttttatttttgtcagacaaaaaaattcatctatgtttaacaaatgagttaattattcacatagtggagattctggtctcaattgctttgacacaataaacaaggcatgtctgccttccacaagtagtagagatgcaagtaaataaaagaagaatctgcacacctttttaaaaaataataataataatttaggctgggtgcagtggctcatgcctgtaatcctagcacttagggaggcttagtgggaggattgctttaggctagaagattgagacagtcttggcaatatagcaagaccctgtctctacaaaagaatatgaaaattagctggatgtggttgtacctgcctcttgtcccagctacttgggaggctgaagctggaggttctcttgagcctgagaggtcaaggctgcagcgagccacgattgtacctctgcaatccagcctgggcaacaggagaccacatctccaaaataataatagtaataatagtaataacaataataataataatttaaacagcaacaacaacagaaacttgggatgtttgtcagctcagagtctctttcagctaaaaaatctgaagtatgagtgtccccaaagcacgatcaatgataacaaaagggagatgagcatgaatcaatctttccattgatgatcaaagggctagaccctctccctggctctagataatccaacagctgacagtcaactcctagatctttctctgccttcctttttaaatttttctttgtgattttgatttctcatctgcatcttccgattaacttctcacctgtcaaccaaatagcttagcagctaatcctgatgagtggcttctgactctaaatttagttacatctcttccatgatacagaaagggttaccttccagcacagaattatctactaaaaagccatgacagcccacctgtccctgcttctttcagtgggacgtcactggctagccccaatctgataaatattattatgagaaataacaccacgaggacaaagtaaatagaaacatactggaagcatgtgtagagtacacaaagcagagtgtagtagggtgcagttaatcaagtagactaaaacacctgggaaatacttctttttctagtagctgaggcaaaaatggcaacatgtcagtttgtactaacagaaaatgcccatttagctgtgcagtaaattcattatttttttctataattacactcaaggaaaaattatttggccaaacccttatacaaaaacactgggtgttataatgtacaatattttgaatagtggttttataggtggtgcatacactgtgtgatacaatatataaaaaccaggctcaacaatatttttgtacaacattcaggaagaggtacctactttccataaaggcagaagactggaattgagaaatttctatgaaagtatttctgtaagggagataaaaagtatttgcgttagacatgggttcagagaactgctggttccagtattattctgcatggtccagttagaaaagttaaattctgaagccaaaccagcggcggtttaaatctgcttctgcatattaactaagatgtggccttggacaagtcgtttgaactccatggatctatatcttcatctatgagatgggtataataaaatatacctcacagagactgtctaggaaattaactaaaataatatatttctcgtgtccattttaaaaatacctgttacataacagatacaccatttgttaagaagaatgtataaacagtaggatattttagatctttgagaaattttagattttaatatattaaagtatttagatatgctaattagaatataaaatttagaaaatttaaaatggaaagaagacacaatgtgatcacaaaaatgggtggacatgataaagtcgtctttgtgatgttttgacctgttcatatcactttttacctgatgtaactcaggtaataaaaagaagaaagcagccgcctctcctcatcgtcttctctaaattgccacttgcattgggcaaatggctatttgtcagtccacctcattgcttttctttgcagcctctgagtcttttgttttaactcttgtggaagaaataaaaaacaaaaaggaccagtgacagtcttgtgaatccagagcacttgctgttcttaccgcaaaaaaagaaagggaggccgggcgtgctggctcacgcctgtaatcccagcactttgggaggccgaggcgggcggatcacgaggtcaggagatcgagaccatcctggctaacacggtgagaccccgtctctactaaaaaatacaaaaaattagccgggcgcggtggcgggcgcctgtagtcccagctactcgggaggctgaggcaggagaatggagtgaactcgggaagcggagcttgcagtgagccgagatcgcgccactgcactccagcctgggtgacagagcgagactccgtcccaaaaacaaaaacaacaaaaaagggaaaggtgagagcaggcactgagaatgacaggaaaataaggcaaggagtaagtgatcaaaagtcagggaggttagagaaaagcatgaatctggatgaaggacacagcacaaagtgacttctcccatctctgttctgtgcccagaaaatttaaattgaggcataaaggtatttatcatgggacccttttaaaggaccaattagcatttactatacaccaagattgcttactgtgaagaaatgttagcaggaatgaagaactataaaagctgatgaggaaaaggtcaaataatctaagcaggattactctggtatatgctcaacaactgcccatgatgatggaaagaaatagctttgattgcctttaaaaggaaaactgttaaaagattactaatcttttaaaccagttgtctttacaaatctctaggagtaggtcagttaaatgaaatctctaaatactccgaaagtaagttgacaaaaccaaaatctcttgaatggagacagagctataatgtattgtggcagcttcattgggaattaagactgagattatatcacaaagaagtaaagccatattgaaatttattcatacaccctgtcatctctctcagaaaccctagctcctgctctgaataatttgttcagatatgcttcttaagtatgacatttgaataaatctggtttttgatttgcattttgtttttctttgccaaaaaaaaaaaaaaaaaaaaaaaggaaaagaaggaggggaggaaaaaaaaaagaaaggaagggaaggagaatgaaaaaaagaggagaacaaaaccaaaaccaaaaacacaaaaacaagctttggtcagtttgctttggctatatggttctcaggttaattaaggaattataaagaagcacctttggtttaacactcatcaaaactcttccttaaatatattcaggcatgtacagacaatgaagtctgatgtggaccaatcccaggacaattctcaaagttgtttagctttttaggttactgtgtaaacaatttttaactcttattttattttattttttgttttgttgtctttgcaatcccaaaattttctgttagtttccttatcatgtaatctaaaaagaagaatgggagaacctctttaagtgagcacagttttattagatttgaatccctgccaatttaccactgtagattgtagagtcatatgtggaggctatgtgtaatgtggcatgcggcatcctcagatgtcaaacttctctttaatttccaagtgacaattagccaacccaccgtttcccatgacttctctgactcctaaatatttttgagagtccccagtgattgctcatgtgctcttcaaattcaccttggttgctgctcttcatctcagctgggactcctgccctttttgcagtatcagaatagacttctccagtctgctttcataattctccaaaggctaggtaagacttaactgtaaggcttggagacaagcagaaggtttgcagataggtcaaagcaaattacacacagaaagctttatactgattattatgtgttaaagatgctagacctatgcatggggttcagcccctaatgccaggcaaccctgctggacttctctgcttcacccatagtatgacacttcgttgtatggattcactcagctgtcctcacagggtgctttagaccagatctcctgcaccccaaaaccatgggtgcatacaaacttactgtagggggctaagtaaagcggggcaggatgtagttctgcccagcccaggctcaggctttctctgggacatctcattgtgtcaggctgcacctcacctgaacagggatatggttttactttggtaaaccaaggggcacattgaagttttgtgatttattttctgcaaagtaaattgcaattcttctctatatacgaatgaacaacactgtcagctttaagctagcggtttatcctggcttctagtcaccaatattttaaaatgttttgggtaagttagagaacccagttacattttatataaaatatcagtcatcgtttacacatttctaatatttaactgttatagctattatatgttttctgtagccattaataaaaggtgaataagctgggcacggtggctcgcagttgtaatcccagcactttgggaggccaaggcaggcagaacacctgaggtcaggagttcaagactagcctggccagcatggtaaaaccccatctctactaaaaatacaaaaattagctgggcgtggtggctcacaactgtaatcccagctactcaggaggctgaggcatgagaatcgcttgaacccaggaagcagaactttcagatagctgagatggtgccactgcactccagcctgggtgacagagtgagactctgtctcaaaaaaaaaaaaaaaaagaaaagaaaaaaggtaataaataaatagaaaaaggtgaatgcagagcatgaaaagaggagagacaggaatgaatgaatgagacatccctggacatccctggacaagcactacaaacaatttctgacagagaatggcttagacttccatggacaattcaaccccaaatggcatattaacaagaaggagaagttatatattgaacactcaatgaggatttgctatattcagggacccacaagtaattgacatatgctttgcctttcattcttttaacagctctcttataaacccagtgttgtcattcccatttcacagaggaagaaactaaggcttagaggtagagtagcttgcccaagtctcattgtggtggagacaatattgcagcccatctgcttttccttcacccttccttctcactgcttcgcctctgccgagacacatacattctgctgcccaccagggaatcttgtgaagctccaattcaggcttaatatcccactaaagtatcagagcttcatgtagtggcagtcttttacaaactatatatatttataactcagtaaaatacataataaaattctcttgatcttatcctatgacaaatgctggggtaaaatagtcttccaacaattaaattcacccaagaaacacagaatcttatagaggaagcaaacatgcccattgataaagcaaaggaacaaacaaagttggaatcggggaagggaatctatatataaatatatgagatttctgctctaaaaatacacattcttttataatgaaggtcaaatatgtacacacatagttataatacaaaatagaaagaatcaagtaccatgagagatggagaaataatgtgccatagcagttcagaggaaacagaaagcatgcctcccaagaagcaacagtgttgagcagagagaaagttagtttgcacaggggaacagacctgggttcacatcccgagtccactgcgggcaacttactgacttgtagttctcagtttcctcatttccaaaatgcccagaaacagcataggatgtgacaaaagactgatgtgaaaacatgcagctggatcattttctacatccaataaatattctctctgctctcctgcttggaaaattaggattatttaataaaggagtcagtagttgacatgagcctgaagaataactacaatttaactaaacatgtggaactagcaataacagtagttaacacttatataggtcacatactgtgccaaaacttcatacttcatgctagaactgttctaagcaatatctaaacactatgtccatgtatatggcatgttacttagaataattctggcataaattattagcatacatgttaactaatatgcatgcatatatttatatgtctacacacacacgtgcacgcacatacacatacacactcaccatcctcttgagaaatgcactctggtccctattttaaagttgggcaaatgctagaacagaaaagctaagtgtgtgcctgaattctcacattcagtaagtgggagagcaatgactaaacttaggcaatgtgccccagagtccatcatcaacaccttgctacagtaccatgcaggaatagcaccaagaccctaaaacaagactgcatgtaatgtgtctggccaatgacattgagcagtctaattttttggagtttatagtacattcagggattgtgagaaataagactcaaagcagaacagggccagcttataagaccttgcaagtcaagctaaggaactccatatgcctgtctggcttgattcaaacattgtcaacaatgagatcagaccaagtatagaattaccaagctggatagtctgaaaatcactatttaaacttgggagtgaagcaaagtataaacagggcctgagtgttccttaacacagcaaggtacaaatacgtttatccagcgttaattccctgcattcgatatggggcatacagacctccctggtattggtgcagaggagctgctggaagcatgattaatatcagcagtggaagcactgttgcaaactattggagaaggctaatcaattcacagttctagggggtcccttttttctggatacgaaatgctttaataaatacgttgtaaagaactgaagtgaaatgcaggctacaacaagcattattttgcccccttttctcctttgtaaacaatttatcaaatcaaaaatagcttggtactttaaatacagtgtcagagtcttcttttcaatattataccttttctaatgaatagttggatctagatgctccagaaagccatgaaaataaagaaaaactcactgaatttcttagttgagtaaattcactggtaatgtgaactagggcttgagatagatctttctatatatgaattcaatacctctgctaacctgtcaacaacaacaataataatagcaataacgataacgataacaactgtttaataaacatttggtgttagaatacaggtcccccagtattttgctccaggactttttgtcttgaactatgacaatctgtgcagaaaaaggccagtcttagagtcaaatgcagacagggctactgaccaggagttaacactaagcatcactgcatcttcttgagtctcagtctcctgtcttagcacatcactatattgcaatgatgaaagctttcaggcatttctgtgtggaagaaaaaattaggtgacactcttgtggataggagaggccagagaatttctttgacactgaatttgcatagtgagcaagttttttttctatttagattgtgtgattacttggtgcaggttgacaattctagagcctttctgtcttagaaagttctagctgctataacaaatgtacaatagacttaaacaacagaaatttatttcccacagttctggaggttgggaagtccaagattaaggtgctggaagatccagtgtctggtaagagcacttttcctggtgcgcaggtggctgttttctcattgcctcctcatattagggaaagccaagatagggagggctagttctttttctattcttagaaaggcactaattccatcacagagcattcattctcatgaactaattacctctcaaaatccccacctcctaataatgtgacagtggcattagaatttcaatgtatgaatttgcaggagcgttcagtctatatcatcttctgcaaagtcatctttggaggtcactacaatgatgttatgttactctgaaatacaaataaatgtatgagtgtttaatatatatgattcttttcccacggtattgttatctccatttaatagatgaatagactaagattctgaaagatgatatgaatggcctaaggtgatacacgaaataatggttggaggtgactttcaagggaacattccttcaaagcccagtggtttcaccttgcacatgcagccagcgatccagtgacacttctcaaggggatctagggatagcacgtgaaatgaagaatgaaaaatcgcaactttgtagagccaccagcaaaacattgccatcagacttcacatttatctttagctcaaaggaaataatttcatgataactgatacctgagttaggcaaaatgtttacattttttgtgcttcataatagacaagcagaaatttcctttagtgctgtcctctcctttctttgcactgtgatttacacaaaattccactgagtttctgggaacaaccatatattctctaccttctgtatactatagtttgtgcaggtgccagggatgcaaaatgaatcagggcagtggccctcaaagtacttgttgcctagaagaggagaccaacctaaatacagacattccagctcctttgctgatttccttccatgacagcaaataccattaggatgaacaaggagagtgccaccagcttaaacacagaggttggggaaaaacagagctgagaatatgctttaaggaattagttccctgttgcctttgggggaacatctcgcagtttgatgtaacagaaggagaacacggaaaggagagaaaaagcaggagataatttggaaagcagagggctttatagggaatattaagaaatttttactttatttatttatttatttatttatttatttttgagatgaagttttgctctttttgcccggactggagtacaatggcctgatcttggctcaccacaacctctgcctcccaggttcaagcgattctcctgcctcagcctttggagtagctaggattacaggcatgtgccaccatgcctggctagttttgtattttttctccatgttggttaggctggtcttgaactcccgacctcgggtgatccatctgccttggcttcccaaaatgctgggattacgggcataagccactgcatctggccctactttatcttaaaggtaatgaactcgcttgtcagattgattagatgggagtaacactggaggccaaacaactgtctggaggctattgcagtgatccaggaaggacacgatgaagatgatggtgatgatggagggaggtgggctgtataccaggtatttccttgggtttgtgtttactcaaggccagatctcagagtttacagtaaatatccagtaattctgtctcaatttaccagacaacttggcaagagaaattaattcctttagcttgtaaagatttttcctcctttctctctttcttctttattccattattcttcttgtgttccttttaaaatttgcctcctcaactgctcattttccctaggaagggaaaaatttcattgcttgggctacttacaattcaacagaaaaagttgaaagtcacctaagaaaagaaaaggaacagaggagtgaagaagagaggaggagatcatgataaatgtgggttattatgtggttttgccaaaggctgtcagtgagcttacatcttctccatagagtgctagtttaagatcaaaatctcaataaaatgaatgattaaaaaagacacatgatgtctgccttcatattcctctttcctgcaagaatctgctatctcctcaaagattcccattcagggaggtgaaattatctttggcgaaaattgactataggacaggcaagttggggcttttctgctggtgtagacgttcatccctggaagtgatcctggaaagctctggggaggaaataaggatgagcgagcatcctagatttatttagtcatcatttgtttctcatgaaaccagcaccagccttagcttattctctggtcaattaaatgtaaaggatggcagaaactagagcccacagtctgtgagtagtttgtggggttaacaagctgactttctgcggtatggaatggcatcagggatgaaacacagacttcatatgctgcccattcactccttttgatacttccacctcaaataattttgaatagtctgggtaacatagggcttggtgaaccttgaacactgacactttattatttgcctctctgaagcactctagcctgacacttaagattcctaaatccactgtggtagtagaaggagctctaaactataacgtcataccagtttcctcttaaactaatgacatttcattgagaacattcctcaaaactcctatcctttgttttccatccaaagccatgaccaggaagatctcccattaagacattatattcagattcccgaggagcactattccctcaagatgcaccatgaaaacataacagggcttataatgaaaaaaaaaaaatagggaaaccaatgctacatttatttcttcattcaacaaggatttatgggccacctgttctgcttgagattttaggagaagactctgctctcatgaagcttagagtgtcatcgcagggagataggcaagtaaatgaatatatatgcatatatttagtttgtcaggtggtgataaatgtaggaaggaaaataatgcaagacagagagaaagagaaatcatgctgggaagacaaaaaagatttgtcaagatcacttactaaagctactgccatgcacataagaacataaaggcattatgaagactggcagccttttcatctttgtttctatttttctctttgccccaaggctttaccctgtatacctgagttagcctctccctagctctgggcctggcccttgctgcaatatcactccttaactccaggtgctctaatagaaggttgggctgccctgcctactcccatgctctagttccctacctcattggcaagaaagttgaaaaagatttctatttaatttttgaaaggataaaggcattgtttttttttttttttttttgttttttttctttagtggaatgtgaaaagtgtgattttgctaagagggtatttcagtcttttccaggcatgtgccatatgttggagctgccatacatgttggtgttatctctcagtgcagagacagaaatataaatatatgacactgttgtcaacagtcacttcattaccccctacactttttttttattactttttttttgagaccgagtctcgctctgttgcccaggctggagcgcagttgcatgatcttggctcactgcaacctccgcctcccgggttcaagcgattctcctgcctcagcctcctgagtagctgagattacagacacgtgccaccacgctaatttttgtatttttagtagaaacggggtttcactatgttggccaggctgtctcacactcctgacttcatgtgatccacctgtctcgtcctgccaaattgctgggattacaggtgtgagccatcgtgcccagccaattatctcttacacttaacacagcagaagtcacgcaaaatccagaatttcagaacaaacacagcagtagcaacagaggagtctggtgtcatatacatgccgtcaattacttaacaaacatttatctttacatgcacaacgccttcaagaacaatttctcttctgaatcatacaaaccagtgggcaacaaaggcatgtttctctttgtttctgggttgatgtacataatatcagttgtcatattttatcttctagtactaagtggctcagacacttatcattatcatagggatgctgatagactacttatatacaaaagttcatagtgttctaggaagaattttgagaactttattcagaaacttcattctaaattagtgtttggttgttaaagccataaataggcagaggcccaatggtgatttaggttcttccacatgtaccttaaaataactttatcaatgccctttcttggtgcttgtaactcttgactttcaataaattctatttgtacttacgttattgatggaggagatttaatgcaaataattcacaggcaaggacatttgttcatcaaagtagaagaaggatgagaaaatggaatatagaagtaataactttcatggggcagtgagggtagcgatgcagtagctccatggtcatggggcactgcccctacgggaagctgggcttttctgcctggggccaggtgctggtcactctgacaacactggagtctccagtgggagagtcacttaatggaagacattaccccctgcaaccttcacgggtttactgagtaacttctgctgacaagttctattatatcccctcactaagaataaaaagggatataactgatggtttaggaaggggttccaggagtgtattaggagactctatattgataagatttgcatcagaaataactttcacaggggtaaaagaataacaaagtggtccatgttaggatcccttcatatttcattttctgaagtggccacatcaagcttcaggagaatgaatgacagtgaaggccaggacaaggagactaggaggaaaatgtcaagttgaccactggtggcacgggagcacatgtgtcacagaagatgtgccaaggctgggctgggaatgaggaagcactaatacccactgaagggaatttttactgccagagacagaggcataaacaaatacaccttcagtgtcccaggtacacaactccaacagagtaagagcacagagtcgatagcgactccctgagagaagggagagaacatgagcacgtgattgtcactagcacagctctgagagcctatacccacacaactggtggtgagatcagactggaatgccagcttttctctagtgttggctgaaatccttgtgttgtttctctaatctggaggtcataaccaggcaaagcaagcagggtggcaagtggtgccaatcagtcattcccctcttgccaactgttaagatacaacaggattcttagacagcaatcaaattctgagtggtcttttaagctaatcaaataactgtcgctattaaacgacaagtagatacacacatatgcacttatgatataatagaccctgtgctccaaataaggaagagtgggggaaaaggagagttctattgtttaactctcatttttgtctcctcaaatctatcatttcagagttcctcttagctaccagtagtggccagtgcctaaaacctatttctctcattttcttttctataaacgcctgtctgaaatccatttttgcgctgctctgaatagcagtttggaactttgaaggctgaatgggtttgtcaattttagctttaagtctgtggtttgcatgttaattaccctttgccttattaaatgtatcttcttaaattagaaaagaaaaccaatcatttctaattacctctgtgctgctagttcctccttaactttagtttgtactcttctggggggacatccctttgaaagtcattcagaaaatgtaagtgtcattgacacattccttatatgtagctcgaggtattagcaggtcgttgcttcagcatacactgtcatacaaagatatttttacaagtattttctattggaacccgcctttcttttttttctctctgtctttctttctcttgaagagtattgcatgtattgaagaacctacaaaatgaagtgtcatctgcatatgtattagatgtaagattcacatcttccctggagacttcattttctctattttcttgatgagtaaacagattaagaaaagttttttttatgtttctttgttcattcattcacccagttattcagcaagtctttaataacagtatgtgcagcattaagatgctgtttgtaaattgactgattttgaaaaaagtacacatatttggcttgggttactgaaatccatttcaatatacctttaagaaatactgtgctccatgcactgttctagacaatgcagtttaaaacgagatacaatccagattcaaagaggaattacagtccgggtgccttgctggggatgacagggcaaatcgtattagtccggtctcatgctgctaataaagacatacccgagactgggtaatttataaaagaaggaggtttaattgactcacagttccacatggctagggaggcctcacaattatggaagaaggctaagaaggaccaaacgcacgtcttacatggcagcaggtaagaaagcatgtgcaggggaactgccctttctaaaactatcaggtctcgtgagacttattcactagcacgagaatagcatggaaaaaaacccacccccgtgattcaatcacctcccactgggtccctctcatgacaggtgggggttatgggagcaacatttcaagatgagattttggtggggacacagccaaaccgtatccgcagggatgttaggattagcacccaaagttcatctcttttctttcccactgcttctcttaacatggacccttaggcaaggtggtgtgtttggcagagcaccagacttgcaacagagtctccctgaaaattcccgacatcccctgtcaaggtcactgatgcagaattttgttgttgtacctgtcatttcttgcacagactgtagttaggcaaattaataacatctgcctggtggcaccgggatacttgtaatctcactgccagtcaaagtcaacagtgtaggtcggctggctacagtgaattcacagaatccaaatgagtggctctggtggcagccagctcagacctgtccactctccactgatcagtcccagcaccaatcttgccttagcctcacagtgtctccccataccatgacctgcttaacaaagtcaaggaagagcatcagcacctttgtgtgaccacaggttcttccattcattaaccaaacagtgttgaacacttaggaatgactgagtggcagaagggcagggggtgaatgctgactgatactcttttctttcacttctggcatattcttctgtgtgtcaatcccgagtaagctctccctgtgatctcctttctatgtgcttattttcttttctaatattcaggccaaatatggtggagagttcttggaagaagatgggagattgagattctctttgaagagcaaatttcactctctctgtgaccattacaagaaacttaacttctctaagcctcaagttctttaactccagggaaggaaagacaaactcctaaactgtgtttccgtgtaaggataagatcagtgaacagctttgttaagaatcatatgaatgatatttgagagtaacaaatataataacatttatctcattataactttaaaaggtctatggataaattcagtatattagtacttaaggttgtgggggtggcgggtgggggcggctggggaaaagagaaaaatcaaatttctgagaactagtgcatataatatcattcagaattgtaaatggaaaggacctgcactgattttgcagtgtgttcttgccattaatctctctgagccccagggttttcctcatgaggcggcgagactacattaatgagccacatgtttgtaagatgtactgcaaattcagaaggattaaatacatgtggaggggcgggaacagggtgtctcttttagtgaggaagtgggctgaaaccttctttgatgataagtgggacaaagtgaactaatacatgcaaagagcctagcaagtgcctggcatggaggagacccttgaaaacggtagctatgatgcagccactgcaattacttggttgcagaaaccggactccacttatatatgcaggtgattatgggagtgaagtaaaagggtcactagactctcatcagaatctctataatctagtctcaacttctgataattttttttacttacgacctcggatcacttaacctctccaaaattaagttttctcacctttaaaatgaagataaaacagcctacctacttcacaagaatactgtgatcaaatgaattgatgaatgttctttgtagttattcgtggcctcacactgtcaagaaaagtactgatctggtttccatcctcagagcttaggtctgcctagtttagaattttatatgcatggaatcgtgctgtttgcactctttatggctggcttattttgctcaactagtgtgttgttgcagggatcagcactttgttactttttattgttgagtaatattccaatctactaatattctgtattaaatttcctgtcttgctaggctctagaagtggaaaattagatttttaattttatgttgttcttcttatgtacaaagcactgaagccacaagtttttctctaaggtctgctttaactgtgtcccacaagctttgatacagtgtttttatcaccatgcaattcaaactaatttctaatttccgtttagatttcttctttgacctacgggttacataaaactgtgttgattaacttccaaatatttgaggtttttctagataatttattattgattcctaatttaattcaattgtggttaaaaaacaaactgtacggttttaactaagacctatcttattgtgcaggatatggtctcagtgaaggtactgtgtggactttaaactaatgtataatctgtagttgttgaatggagtgttacatgaatgtaaattaggtcaattttactgataatgttatttgaatctttcatatcctttctgattttttgtcctcttgtataattccattttctgtactttccatcctttttggttttgttcgcatatattttccttctacatgccttgcaaacattacaagatattattttttgaaaaactatgaactgacttttaaaatgtttaagaaagaaaaatagtcttttatatttaaccatgcagttttcatttgatttttaaattgatgggtaatacttgtacatagttatggtgtgcatgtgatattttgatacatacacagaatgtgcaaagatcaagtcagggtatttgggatatccatcagctcaagcatttatcatttatttgtattgggaataattcaaatcacctttcctagctattttaaaatatataatacatgttgttgttaactatagtcactctactgtgctattaaacattagaacatatttcttctatctaactacatgtttgtacccattaaccaatcttttttcatcccaacctcacatatacctttcctggcttctggtaactatcattctactctacctccatgagatcaacttacttttagctctcacatatgagtgcagacatgtgaagcttgtctttctgtagctggcttattttacttaatataataacctccagttccgtccatgttgttgcgaatgacatgatttcatccttttttatggctgaataatacatatactacatttcctctaactattcatctattgatggacacgcattgtttctatatctttgctgttgtaagtagtgctgtgataaacatgggggtgcaggtatccttttgatatactaatttcctttccttttgatacattttcactagagggattgagagctcatcattccttcctatacaccacaaattttacctggcatcaatttcttctacttttgtattagcatttcttagcagctttatagctaataaattatttattttgttcatggaactgtttcttttccttcatatttgaaagctatttttttgagggtgggttgtagaggtcaggggaaagcttcctctcttctttctaaaggttcactgaaaactaacaaatgtaacaaattaacaatggcaggatactagaaagaaaaggcatatcagtgtatttaacatggataagcccaggggagttgctagagactcaataactcaatgaggttcaggtacttcaatacccttcttcacaggggaaagggagatggcagaaatgtggtaattttgaagagcagtaaactattttcagggaaaatggatgtacccagtactcagactatttttaataaataattctttttaggcattgtataggattagagataaagatcatctgggttctaggtgtggtgtttaatttttagttttttcctctctgtaatatgagttgcaatcttccctacttaattacatttcagggaggggattgaagacaattgtgtttctctttggtgggttcagtttccaagtagataaaagaacttcgggaggaggagccaagatggccgaataggaacagctccggtctacagctcccagcgtgagcgacgcagaagatgggtgatttctgcatttccatctgaggtactgggttcatctcactagggagtgccagacagtgggcgcaggtcagtgggtgcgcgcaccgtacgccagccgaagcagggcgaggcattgcctcacttgggaagcgcaaggggtcagggagttccctttccgagtcaaagaaaggggtgacggaaggcacctggaaaatcgggtcactcccacccgaatactgcgcttttccgacgggcttaaaaaacggcacaccacgagattatatctcgcacctggctcggagggtcctacgcccacggagtctcgctgattgctagcacagcagtctgagatcaaactgcaaggccgcagcgaggctgggggaggggcgcccgccattgcccaggcttgcttaggtaaacaaagcagccgggaagctcggactgggtggagcccaccacagctcaaggaggcctgcctgcctctgtaggctccacctctgggggcagggcacagacaaacaaaaagacagcagtaacctctgcagacttaaatgtctctgtctgacagctttgaagagagcagtggttctcccagcacgcagctggagatctgagaacgggcagactgcctcctcaagtgggtccctgacccctgacccccgagcagcctaactgggaggcaccccccagcaggggggcacactgacacctcacaaggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaatctggaaactctaaaatgcagagctcctctcctcctccaaaggaatgcagttcctcaccagcaacggaacaaagctggatggagaatgactttgacgagctgagagaaggaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggaagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcaagactaggcagaaactgcatcaactaacgagcaaactcaccagctaacataataatgacaggatcaaattcacacataacaatattaactttaaatgtaaatggactaaatgctccaattaaaagacacagactggcaaattggataaagagtcaagagctgtattcagtgtgctgtattcagggaacccatctcacgtgcagagacacacataggctcaaaataaaaggatggaggaagatctaccaagcaaatggaaaacaaaaaaaggcaggggttgccatcctagtctctgataaaatactttaaaccaacaaagatcaaaagagacaaaggaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaagcggacctaatagacatgtacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgctcctgaatgactactggatacataacgaaatgaaggcagaaataaagctgttctttgaaaccagcgagaacaaagacacaacataccagaatctctgggacgcattcagagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaggactaataaagaaaaaaagagagaagaatcaaatagatgcaataaaaaaagataaaggggatatcactgccgatcccacagaaatacaaactaccatcagagaatactacaaacacctctatgcaaataaactagaaaatctagaagaaatggataaattcctggacacatacactctcccaagtctaaaccaggaagaagttgaatctgaatagaccaataacaggagctgaaattgtggcaataatcaatagtttaccaaccaaaaagagtccaggaccagatggattcacagccaaattctatcagaggtacaaggaggaactggtaccattccttctgaaactattccaatcaatagaaaaagagggtatcctccctaactcattttatgaggccagcatcattctgataccaaagccaggcagagacacaaccaaaaaagagaattttagaccaatatccttgatgagcattgattcaaaaatcctcaataaaatactgggaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaacaggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatgtcatgaaaatggccatactgcccaaggtaatttacagattcaatgccatccccataaagctacctatgactttcttcgcagaattggaaaaaactactttaaagttcatatggaaccaaaaaagagcccgcattgccaaggcaatcctaagccaaaagaacaaagctggaggcatcacactacctgacttcaaactatactacaaggctacagtaaccaaaatagcatggtactggtaccaaaacagagatatagatcaatggaacagagcagagccctcagaaataacgctgcatatctacaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactactatcagagtgaacagacaacctaaaaaatgggagaaaattttcgcaacctactcatctgacaaagggctaatatccagaatctacaatgaactcaaacaaatttacaaggaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgttcattaaaaagtcaggaaacaacaggtgctggagaggatgtggagaaatagcaacacttttacactgttggtgggactgtaaaccagttcaaccattgtggaagtcattgtggcgattcctcagggatctagaactagaaatatcatttgacgcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcccactctggggactgtggtggggtggggggaggcgggagggatagaattgggagatatacctaatgctagatgacgagttagtgggtgcagtgcaccagcatggcacatgtatacatatgtaactaacctgcacaatgtgcacatgtaccctaaaacttaaagtataataaaataaataaataaataaattaaaaaaaaagaacttcggagaatagccttaacctgtgctttggaacagacaaagtattgagagatggagtgaggaggggaaggtaagagagatttgaggctatttctttagttgtatgtcaaagtgccatattttggggtaccatttcctgagttccagcattggatatagaatgctagattgatagtgttttactttcagtatttttggatttccttttttttttttttttctgatgagtagtttgttgtcattcttgttgttcacatgttacattcaacaactgagatggctttgaataggttggtggctttaatacatctaacaggaagatcttttcttgctattcatccggcacataacttccggcattgataagtgattgattgactttgatccactggtgaacttggggaggggctgattgtagctttgtttagattcaatctgcctctactgttaatgctttctaggtgaccttaagctgctagcaccaggaagtccctgggaccatgcattgaaaacttccagatctcagaactgtgagaccttggatctgcttgaccatgagcctctaagactatgaaactgcaaatgatatggctctgggatagtaggactttgagactgtgagattgcaatactaaggctgcctcttctcagaatgagagtccaagattccttctcattggagcacaccatacattagtcacgggattaactcctataaagcattgccaggtcatgaaacaaatctttaatctggagcatgcgatcaaattttaaacattgttttaagatgtgtgtatgtgtgtgtgcgtgtgtgtgtgtgtgtgtgatattcaatctacaaattatgccaaactcagaaggggcagccagtcatttgaaggtggataagtttctactgcacatttggattagataaataatgctacagacctacggactcacatgcctggggaggtgggatatggtgcacacaatcagtagggaattgagagtgctgaagagaaggttccacagttaggctgtagaaaaacatgacacacttttactctacccaaaacagtaagaaaccaccagaacccatctcccttccttccctcatacatatcaaagtggtatggacgcaaggacattttaaaagaactaaactccacagggaggcgtcctttccaggtgagcagggaaggaggacagcttcatacctgtgccagatgctagtgctgggagcaggggatgtggaagagcatttctgtcaaataaagccattctccatctggataaagagaaaatgttcaaagtttgacaaacctgggagctgaaatgttgaatttgaacctcaagaaattcctcaccactaagtcattcttttatatgagagttttgctgcagaaggggctgcaaaatagaaagtgagccaattccttctttataagccactttgtgatacatgatagtaattacatcaatcgcctaatttcagagctattagctagcgggtgttttgtgcgtagtagaaatgtcaaagattatgcaagataacctaaatccacaggtgctattaaaatataatcaaggttaaggttaaggtctttgaaaatggatttcattaaatagacaaaattatcttacttggttttcactttggtcatctgcgaaagcaatggatcttcttttcattggttgacattgattgcacaccagcaagtaggttttatctatgaatattagaaggtgaaaagaagaacgttgatgattcataatgaagcaagcaaatcggtatgctagctgacatcccatcttaaagatgaggtatgattgggatgatgaaaacgttctggggaaggatggtggtgatggttatacgacaacgtgaatatgcttaatgccctgaattatttactttaaattggttataatgatacattttttgctacgtatatttactccaattaaaaaaatatattaggtgtgagcctttggatttcatcttcagcaaaaaaaaccccccaataattttcagggaaaatgaatgagcccaatgctcagagtatttttaataattcttttttggcattgaataggattagagataaagatcatctggattctaggtgtggtgtttaatttttagtttttttttctctctaatatgagttgtaatcttccctaattaattacatttcagggaggggattgaagacaattgtttctctttggtgggttcagtttccaagtagataaaagaacttcagagaatagccttaacctgtgctttggaacaaagtattgagagttggagtgaggaggggaaggtaagagagaattgaggctacttctttagttgtatgtcaaagtgtcatgttttggggtatcattttctgagttccagcgttggatatagaatgctgggttgatagcattttactttcagcattttggatttcctcttttttttttttctgatgagtagttcgttgtcattcttattgttcacatgtcattcatgttgttcacatccaaataaaggctatgaagtacaatattagtagaccacatagcttttgtgctgtgtattcttttgcttaaacttcacaaggaaatatgtaaaagaacaagatataaatctgagttgcattgtctccctcctgtaacaacaatgaaattgttgaagagtagaaagctgtagaaatttcagactaattactagccaattgggtgatttggagatttttttccttccctttttctctttctaggcttctttttttaaaaaatctgtaaaatggtgataatgataatggaaagtgcttagcatagtgactggcctcaattaatggtaacaattacttcaataaaatcctttccttctaaaagcagattgtcagttatcttccattcctcagtgagtatggacattaggaacatgggaatttcattgtattgttacctttgtaaagcttttaggtgtcatgcctcaggacttgctagaattgctttattcataaaatgtttaagagggatttctttttttttttttttttttttgacagagtctccctctgtcgcccaggctggagtgcagtggtatgatcttggctcactgcaacctccgcctcctgggttcaagtgattatcctgcctcagtctctcgggtagctgggattacaggcacacaccaccatgcccagctaatttttttgtatttttagtagagacagtgtttcaccatgctagccagtctggtctcagactcctgacctcatgacccgcttgcctcagcctcccaaagtgctgggattacaggagtgagccacttcacacagcctaaaagggatttcttaaagaataatgtgaagtatttctgaaaacaaacaaacatgatgcaggattttcacccaagtcatatttcaattgaaatacgtgagaaattaggtatgttctcagtacgagttcgtggagtaacaaatatggttttccactgaaattccatgatagcacagacctcactgcctctcctttcttctctgcagacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctatagtaagtactcacatgtaccctttaccattgctgagtgtgagtggcaccgcctacgtaacatcagtttatctacattgagattgacaatcatcttattttaaagttgtttctagactttcatatgcatatttaaaaatgttcaattcaatcccaaagtagaaaaaacattctacttaggactgtaggaatgtagttgtgatggtgtgataaaggctcaatgaaacattcaaaattaataactcttggggaatcaagtaaccatttgtcctttgcagttaaacaaaattgagtttaattcttccccggaagtggcattaggtattataaagtcttctctgccctgctttcccagagctatgagagaaaagcattcaccttcttgacttgttctagaagacgaggagaaagaacaactaaatgtaattcacaaaatgctttctccttgaaatgatctccttcattcattcatctgtgaattgtttgtattaaatttgaaattagagttctatcttgcacataaagattataaagatgggtagaactagtgatcactctagaataaggttaaaattattcagggaagattcccatccctataattctttcctgcgcgctttatactgaaacctgaaattgcatcataataaatagtttttctgccgtaagcagtgacatattctgcttatatgctaaaattcaatgacccctaatgcataaacacatttgatcactaacactttcatccaaactagttcagtagattcctgttttgggctgtaggaattcttaatgagtacatgtctgtactgttttccatagtgagatcaactgaatgcctgtatcagaatcaataggagtgttgcctagaaaatgcatttccctcaccccatcccatacatactggattataatttctgaaaatggaaatccaaaagcggaatgtttacaaattctccaagtaaactatggatatagagtgtctgctaaaaataaagccctgcacacagggaatttactggtaaaatgactgtatttatcttgaacaagcactttcagaaagaatatggtttagaacagatgcatcaacaaaccattaggcccaggaggaactgccttccactccaaactttgtatgataaagcacagaacacctacaagggtatatgtgtcctatcctgggatgtctggggcatcaagctcctcttgtcacctcctgtttgataacaatttgtcactgctaggttattttaaaatacagtatgggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgccgtccggcctgggcgacagagcgagactccttctcaaaaaaaaaaaaaaaaaaaaaaacagtatgaagcttttatgctacaattaaaagtttgttaatattattatgccagccatctattttgatctaagaatcttattactctttaacatgtccttatccttttgctttttctcagtctgttcagttgtacttatttttcatgccaattgttcacccacagtgtctacttgcacagaaagagtcacagcatcgagttaaatcacaggctgcagggttgaaagatgtctttgagcagcatgtttagcatcttctggtgatgaaccccttggagaatctgataaggaacactctatccagaaaaataataacgataacatgtatcttttctacagtatgagaaggttcagaggtctgctaaagcccagttctaagccaaggaaagaactcctgactttgtgataacagagtctacctttttccatgtaggctccaggtctagtgcatcttccaatgggataaactgccttcaggtcaacctcaccaataatgggaagttaacaaccttggggagttgtcggacacagaatgtctttatgatgtgcctcaagcaggaaccctataatcttcaatcactagtgctgatgctttggtacttttttttatttgggggaaataatttaaaaaacgaatacatttctcagtttgtatctaaaaccaatgggttagcatgccttctgaacctaattctccctttcagcattatcatgttttttatttgactggattggttttctttctttctttctttctttctttctttctttctttctttctttctttctttctttccttttctctctctctctttctttctttctttctttttttttttttttttttttgagatggagcctcgctctcttgcccaggctggagtgcatggcatgatctcagctcactgcaacctccgcctcctgagttcaagtgattctgctgcctcaccctcctaagtagctgggattacaggcgtgcaccaccatgtctggctaattttcgtatctttagtagagatggagtttcaccatgttggccaggctggtctcgaactcctgacctcgtgatacacccagctcggcctcccaaagtgctgggattacaggggtgagctactgtgcccaagtttgactcgattgtttctataaacctaaaatcttactgtaagcaccaccaaacaaaacagcaaaagctcatggccctctttagcaactacctctccttttcctcctctctcctgttcacagaatggcttctctctaaaacttctctttagttgctctccccacctgcttacctcccttcacactgcaactgattccaatcactattgagacatttgatgggcagtttaacatgtcaacttggcctttttatagtcccctgttacccaaccaaacactaatatagttactgctgtgatatgtttggtgtctacaatcatttgactttaagtaaaggagattatcctaagtaatctgaatggacctaattcagtcagttgaaatgcttcaagagcagaacagaaatttccctgagagagacgaaaattcacctgtggactacagtttcagatccttcctgagagtttccagcttccccttcttgatggcccgccctatgtacttcaggcacgtttaaccagacccacaattgtataagccaattccttgcaattagtctcttaatatatataagtatctactggttctgtttctctagggaaactctgactaatacagaatgttctagagaaactacttttctcaagatcaccagtgatttccaagaagcccaattcagtggacacttaatgtttcttaattcacttaagctctcagcagtacttgattcaaaaagctatgtccatatttttaaaacctcgtttttcctcctatctcacttgctaattggctatctcagtttgctaattggctatctcagttcttctactacttttccatctacactgcatgctttgctgaattgacagagttttgtaaacttaaacacatctacatgctggtcaccccacatctgtatctcatggcctgacctcagagatgatgtatgcagcagcctacttgatatttccacttaaagtatagtagatatattaaatagaatatagcaaaatggaactctagattagtggtgccctcagcaacctgctcttctctaacactcctccccatctcagtaaacagcagcactctccatccacttgtctatgcaaaactctgggaagcagcctttgttcttccttctctataacttcaagtcctgcgcaacttatctacagctcacagtaactctatcagttgcttcctccaacaggtatcttaaatccatgtacttctcccacttttgtgagtagaagcctctgtcagttcttacctggagttgttaagtagcctcctgtctggagttcctgcttccacactacactcaccccaaaaccatcttttacacggtcaccaaaatgttctttataaagaaggaatgaaagcatagcattccccttcttgattcatgtgaaataaaattgagatttcttactggcaagtaaaagtccttgttgaacaattgttcccagaatttacagggttgactccttctgccaatgtgattcttaattataatgtcacctcctcagagaagtccccccgactgttcctctaaagtcacctgccttccttcttgtacacccaccattagcccatgattatatgcccatggatatgtgatgtgctgtcatttactttgtggtgtcggccacaacccagaatctcactggctgggtttgcttacttctttcctgtttacctactctagtacctgcacaggaaaaagtaccatgagaccaggcaccttgtctactaacagccagcacttaattggcacaaaaagacagtcagtaagtatttgttgaatgggtacatagatatatcaatccagcctcattctctcagcataggcaacaaggttcatctggaattacttgattttcataatctgttgtagtttctaaggaattacttttgtttctatgggcttaataatttttccaaaagtttagttgagtatgttgctaaagattggtagaattcttacagctctatagtttcttcagacttaactctctacattttggaaatattaacatatttcttccactaatttattcattcagtagataccatttatttagcctttaagataccaggcatcttgcaacactctaggaacatcagaaaataagacctttttctagactttatcagtcttgtatttgtactttgaagcacttttcttgtgattacatgtcatcagttaactgcgtgattgtctaacatctgcttcccctgactcgacaagatagttttgcacagtgccctggattgtcaacattgccaaatgttggaatctgaaattctcttggagataacacatcctaatgaatcttctaatacccagatactttttttattcacaaaatcaaagttagcaacctacgattcctgagcatatgcagctccacgtacaaagtttagctgttgactgggccaagagcttctgggcttgcatgcttccaatcctctatcccttgcctgtgttctcagacctagttctacctgagaatcaccttgggacatatatgcttttaacatacctactctggctgcacttcaattagatcatgatctctgggtagggtctccagtgcttgtataagcattttgttgttgttggttctaggcaagcgtgatgaggaaccagaatttaaagctgttatctcaaacatcacttcattcttagtctgcactatcatttccgtgtctgtgattgctaatcctaaggattttaaatgaaatctgaaaacttgagaagtcagtataatgttaaatatatgggctctgaattcaaaccaacagacatagaaacttgacttcaccacctactagttgggtaatcttgggcaatcttgggtcctctgtggacaccagtttccttttctatgaaaagaaaggtaatactagtgttgcttcaaccaagtaattgtatgaaacagtgctttgcataatgtaagcacccaaaaagtgttagttacaagcatcgttaccttcgtcagatatttaggctgctcaccaaacttccctatatttttttttcccactcttactcaggaccacatctcatctgtatgtccaaggaaggtcagcttttttatataccaggtatccaaggatttcagcaccttcgtcaggccatctggagtctaggctacctgaagttctgtctgggggcttccatttgaatttctttaaatatgggaagctaattaactttatttatttatttattttttgtattttttagtagagacggggtttcaccgtggtctcgatctcctgacctcgtgatccgcccgcctcagcctgccaaagtgctgggattacaggcatgagccactgcgcccggctaattaacttttttttttttttttttttttttttttttgagacggagtctcgctctgtcgcccaggctggagtgcagtggcgcaatcgcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccggctaattaactttaaaaaacattataaattctgataaagttaatgatctgtcaggcctcccagtctcattatgaattacaaacatcattttgtacttcaggtcgcctctgttccacacaagaccttgctcctatttggttaattactcgcaagtggtatcatccaaaattcatcactctcagagctgaagtcatattctccttcctcagataaatactcttgtaattccagcttcagctgccctctttgttgctgttctcatcatctgggatcatttgtcatacatggtagaggccacacagttgtaaatctcacctctgacatgctaaggcccatacagccctatcacagggaacttcagaaggcacagtttacagctctgtcagccctccaagtggggagggacaggatgacagcagtcagacctggggcattggcagtccaatgtgaactttgattcccactttgtaaatcatagcatttttaagagttggaaaaatctccaagatgccagattcattgcagtcccctcattagatttgagaataaatgaaatttcctacccttctttctcatagttcctataggaatgactgaaaaatctcttctatgaagagacaaatgtacacacatacatggaataacaacactaaaataaaagacactgtgatcttccatcttaaatcaatgacttctttataacttttctgactggttgaggatctgaaggctccttcaacagtcaacaaacattacccagtaggctccctctgctaggcttcagagatacaaaaataaataagacaatccttgccctttaggaactcacagattttcagaagctacaaaaggtagataaacaaatgctcataaatatggaggtttaggaaaccaagtctttggcaaggcttgcaaaggagaaaaaaaatacacagctaacactgtttcctgatgaattaatgccctgctgcccagtatgtgatttgactggcgatattgctattattcctgtgacccatatgctaatggcagtgattttaaaggaaacctgaaaagggaaaaatgaccaagtagttggatcaaccactttatgcaacagtacgtttccacaaaaatgccaaggccttgcctcctacaatttgttttgcatttactccctgttgaagtggtcactggagtgattgaccgtgactcccctctgcctcctagcactaagtggcttagtctgtgcccaggtagaatccttaacaaagactgttcaccttcccttaaacataaaaccatactaaatctttttattaaaaaaacaggtcaactaccgtaagggagaaaaataataactatcgtctctaattttgacattgctatttaaatgactctcattgtatgaacatccttttagtgggcaattgtgtcaacactgtggcttaagactactgatgacggtagaagtcaggaagcagcttgtcattgcaggatgctgctgccacaacacgggttgatcattcctttccttctgtgagtttgtggctaagatttctgaaacctcatccccatagtgaaaccttttgctaacctgtctataccttagtggagtgatcactatcttctcactgcccaccatgcacctcttacttaggtgaccatatgtcccagcttgctccttagagttctattccatttcattatttatagctccccttttcaatcccacaagtcctcattagggtaataagttgtagggatcaccataatgcttccctgtaccgcatcttacagtggcatagtgatgcatttgctatgtcgctgttagggtgttcgagttcctcggtggcatggctcacgtctttgttatctttgtatctcagagctcagtacagtgaccagaaggagtacagaatatgcttaatacctgccaatgaatttaggagtaatgaataaaatgatacctactatggaagttccctaaaatgagtacattatttttgtgtaatctttgtcattattcaacagtccagttgaactacaaattttaagtgcaccccgaaagacatctatgcatctgaaatatctaaaaacaaaacaaaacaaaaaaaaacctaagcattatgagaaggcgagtcttactgttagagctagaatgtatttctgctgaggttacgactggaattcagagttttgatttttttttgtactatgattgttttcatgttttcttcttgaaacgcatcctgttttttcatgtgctatcatgcataggaatgtcagaaattttgaaagaaaagctatgttaggagttgtcacagttagctttggaaactttcctcattttcatagttcatctgaggtaatcagagttactgataaggcctggcagtcacagaattggtggaggaatctgtgcaaatttgagctgctgtggaaaccctggtggtttgtggattgctagccaaagcccttgagtcttcagtgcaagagtatggtctgaataataatcatttttcttatataatgtatcatgacataagcttcaaaatgtaattgtattgaaaatcatgtttactgtgaacaactgaagagtccaagtgggactgattgtctcagggtgaatcgatagcttctcctgtcaatgttgagcttcggctttctggcccgtgaggaagctgactctttgtccctggcccactcaggagcccagctggcccacttggggattcaagcttggaatcttctattcagtgaagccctttttttagctggtttgttgacaagctaccaacatccatcaaatatgccagcatatgcctccagaactctgtctttctcagaaaacaagctgtggcagccaggtcagcaattatgggcccagtgggaagtcggccagtgctggcattctcagtactccaggatgggggagcgcatgctggctctgtcttgacccaaaaggagaggttgtgcactgtagagcctgccttcattctaaggactctggagcatgattggcctctccttcatattctagagaagactgccaatgtatcagcatcttaacaaaccacgaattgaattgaattaagtttgtaataatgggttcttaaaaatcgattttgaaaaaaggggaagaaattgttcactccaggaagtaaatatctaacagctgtgttctgggtcactggcatggcagataaaatagagaactctgaggaacagataacaggtattaatatgaaggaaaacattccacaacgaccacattagggttttactaccttggcaaggcacaataaaattgggtaacgggggtaggtagccaggattatgcaggctgaccatgcaagtaatctgatgcattttctaaaacacaaagagctctttctaaaaacccaaaccaatcatacattttccctactttaaatgatttagtagttatttctccattgatatcagggtcacattgaaacccatattattttattttgtttttttattattatttatttatttattttgagacagagtttccctctgtcacccaggctagagtgcagtgacacaatcttggctcactccaaactctgcctcccgggttcaagcaattctcctgcctcagcctcccgagtagctgggattacaggtgcccacaaggacgcccggctaatttttgtatttttagtagagacggggtttcacaatgctggtcaggctggtttcaaactcctgacctcaggtgatctgcctgcctcagcctcccaaagtgttgggattacaggtgtgagccaccgtgcccggccaaacccatattattttatttttaatttgactctccatcatgagacttcctactctagttccgacctgttgaatccccactgcccttggcaccctacacttgagcacagagctcctcaaacctcatcaagaagagcagctactgagaaggctccttaacacaccacttgctgggtcccacacccaggtttttattccttaggtctgcagtgaggtcttacattctgtatttctaacaagctccttggtgacctcaatgctgctggtccacagggtatggttcccttcagcaagtttgattcctgatagatcctagatgggaccctgcactttgtctctctcctccttgccttgagcttgcagctccttccttctggtgggactgcccttcccacttccactccctccttctattctcctattcccaccacacccccacctcaccagcctgactgcctcttatgtctcaggactctggagaaacattgaccctgcctggacaccctcctaaccctctgcccctccctggagagggttcagcgctccctcagcacacagtgctcacctccttccaatggatgtagaattgcgtgcttgctctctccagcttagtcctcgagagcagggacctctgtagagcttgaacacaagaatgcatgagtgaaggaaaaccacaaaaataaaaaaggatagagggtttgagctttgggaagatggtggggatagagagggcattgtacctctaccataacaaagcctcccacatgtgtacatggtttccctgctctcccagaaagggagcaagtgaaagagcaagtgaagaagagcagggaacccagggaaattcagagcaacatttaaggaaaagaaaacttcttatttaacatcatccttcccttctttaaatcagcaatcagcatttttttttttttgagctttggttttcctactttacaaatggggaaaaatatggacctttcagggctactaagaacattaccttaggtaatgtgtgtatattagttccttttccccctgggaaatggattcagagaaagaaatctccacaagtgtgttagagaagttgtgatagagaatatgggagatatattcagttttatgtttttggtacctttaaatctgaagtgatcacacatttcccatctgccataaagagcccatgtctaccctttttactcctttctacacactttctttttttccttttaaaagagaatctgccaagatgcttgtacaacacaaataaagattttgatttctataaccagaccccatgcagcaaattaagttccaaagagatatccagaaaaagtcgttatgatactacctcatgaggaaaaagcagcatataatagtttatctcttattaacagcaacctataaccatgtgggtctttattattatcattttaaatctgcttttccaagtgaagttgggagtgctgagtattcttcttgaaactcatcctgttttttttcatgtgctatcatgcataggaatatcagaaattttaaaagaaaagctatgttaggagttgtcacagttagctttggaagctgattctaagttaatgtacatgctaaatcctaaagaaagtgttgaaaaaaatcaagcaatagtataaaaagcattaactatattaaataaaatagtacattataaaatactcaatactagtgtctgggaaggagtaggaagtattcagttggggaaacctttaatccttctttgaaagttttgaaaacccttttctctctctgggaaatggctggagcctgttgtgtgcaatgtaattaatattgcagaagtgcagagtgtttggctgaaatctctgagaacagcaaagtgtagctcttatcaggtactggtggtggtcggaggaaagctcccgcaccccaccaggctagttctgtgcttactaaaggccgtgcatcctctctgcaccaataagcatgtgtgagtcacacagggatcacagctccagtggctgagcatggcctgcagaagaaactaactctcccagtgtggatggtaagctggctctgaatggtgaaatagatgatgcgcaggaactcaggggagacttgggcaacatcacacttgggcataggcacctcaatggatcacagctcatttcacaggtggttctggatggcatacccttccgagtccattgcgaggctctgaattaatgtggcaaacagcgtacatctggcccttgtcctcatgagatgcattgacgtgttggacaactggactataaaccactgagaaaacagatgagcatctaatccaattgcgaggtgcattatgaagggaatggcaaggtgcttagagggagactaacagggatggaggaccccttagaaaaagggccaggtgggaaccgacagatgagctgagcatcgtggtccaagtgggcagcgcatgggaaagagctcagtggactcagcgtgggtgggtcagacagggtaggtttgaatcctggccctggcacttgctcactatatacctctttgtctctttgtgccgtgtttgtcttatttgtaaagggggaataataatagtattttcctcaaaggttaattgatgtgtttaaatgagttcctgtgcaaaaaaacatctagagaattgcagggcttatgatgtgggctccacacacattatcctagccccacacatacatgcatatgcacatacactaaaatcacagcatgcctggagcagtgtgagggttgaagaaaggaacagaagatgaggtgggagaggtgaacagagcaggatcatgtggagtcctggagactgaaattaattatcagggcaaaggaagttcaatgaaatactttagcaatgctgaggtatgatgtttcttatgctttttaacgttaaaaactgtgtcaggtgaaggtggcaaaagtgaaatctgggaggcagttctgaaactattaatagaaaacggaaagcaggcaatgatgatgaggacatgagtgcacgcctactcagtgtgatgtgaaggctaccgaatcccaaacccagacagaattttttcacaccaagttcttgatagcatctttatgctgtgcttgaaaatcttcactactgagtactttctttctataaataaggaaatgtggggataaaatgttgttgaatgcctttgtattttcaggtctgagattgtgcaattttcacaatgactttgaaggtaggttcctataagccccatcatacagataggagaactggagctcaaagaaatcaagaaagttgcttcaaccaacacctgcccccaggtagtaaggagtaaaaccagaactgaaacccagctctgttagactcgttctactgattggcttagttttctctaggtctcatgacaacgtggagatgtgttttcttaagagataacctatgtccctttgccatcaacatttgtatcctcagttaagtcactagactagccagacattggagggaatggaatgcagatcatagtaacgatgatgaatggagagggaggtgagtgagtgagtggactggagaaaagaaaacatttggaattcagtacttgacccaagaactcaggcctgcatgaggggtccaggcagccaagtacactggagtatgacattataaaatgaagaggaatgggggaaatagcagcaacataatgaatatttatatttacataaatttctccataaccattgcttggacaaaaaagtgtcaaagatatatatatatatatatataaaatttctttatataaatattatatataatttctttatataaacattatatataatttctttatataaacattatatataatttctttatataaacattatatataatttctttatataaacattatatataatttctttatataaatataaataaattttaataaataaaatttaataaataaatattatatgtaatatttatttatataaatattaatccaaattctctcactgctttcttataatcagttgtaagtgtaattgaatacattgttatgcaccattttacaaggatggaaagtgaggcccttagttttgacataaacttaaccccagtcagacacctggtgagtagtagagctgctctatagagggctcctctccttagtttaatgtctttaccagggaaccaaaggcaaatttcctccatgtggttttagttcaccacacaagggaccccacctgccatgttcaggctctgtgctcagtgctggtgctggctgggagatgaagagtatagtggtggtatgagtgagtggacaggatgtatataatttgtggatggtgattctcacatggcatgtgatagcaaaaacagaggggtgtacccagtgctagggaaacccaaagttcagatgcaatatctgtctatgggggtgggacaaatgcatccatgaataatgatggaattgagttactgcttcaaagacaccatgtgtggtatgtctcagcttgcaagaaatgcctcactgggaactagagatctttctgtcccttctccatcatgctggcctcctgcagtactgagatgcaccaaacattctcacgcctctgttatccctcctggagacactgggtccctcctttccctggggtaactcctacatattgttaaaggccaatataccactcactttctctaagaaaccctgtctgaatctaccccctttgaactgagtcagttcagttagcattactgtgagtattaatgtctgcatttgccattagaaactctatgggacactatgtggtccttccactcactgctgggcactacaggggctacctaggacacaatttctactccacagtctggtacagtggcagagtagaagcaatcagaagagaatattaatattgtgtacattgtgatgtacgcactctgcacacactaatttcagctagaatgtgagaagccaaaacatgacagaaaaagaagcttggggctactttggcatccctgggcagtaaacaactgaatcaaaattgaaaaagcatcatttggggtaagaaggtagagtgccaaccaatagagtggccttgataggaactaaaagattcctgttatttcaattactactaatacctctcctatctattattgatttaacacaaataatgtgccatgcacaatgagttcacattgatgtgtcataactttgtaagtcttagcacatgtacttctcaaagcagttttctctaatggatataattatcttcatcctataaataatacaatcaccttagaccaaggtaacccaactaacaaactatgaccatcacagtttagaatccattatgttatctataccacagtcctcactattccatgagtggtggcagctgttggtctgtggccccactttggtctgggtggaatcctagttgagataacagtcataagtgcattgatgaggtagggaggggaggtgctgagaaaggtggacatttgtgaaagtctctttgtatatggacagtttatttttaaagtcaaggtttccatcagcaacattttggttaggacactttgttccgtataaataaattgtgaaattgggttttaaaactaattacagaaaagtattatttcattttccttttcatttcagatcctcagattcacaaagagtgtttctagatccttggaaaaaaaattatcattgtgtatgctcaggctgaggattttaattacatgctgaataatacaaaaattgagttttcttgggtactcaattttaaatagaaaatcccaccccctccacataatcaccacaatcccacccacagaacatggtatataatgaatcagtttcaatttgtaattaaacagtcttacatgtttttctacaataaaagctcattataaaagtttttgtaattaaaaaaatagaaaaaaaaacccgcaaaaataacctagaacaacacattccaaatagaatctctattagatttttggcataatttgtcagatatgtttacacatacctgttacataagtttatctaaatcatggttacttgaccttcaccttgttttgctttgacaataaggaattaaatgttttgtataaaaacactaaaatgataaatatcaccagcacagataaggcagtgatacatttgccctctttgttcaaataacaagtcttcttttgctgagtatttttttccactgaacccagtagaagcctcagaatccttctcaacacagacttctagggagacagtactatgtggagttggcatcataattatatctatttttcatctctaatgttgtgtctgagataaggagatcaagtggttctgactgtcaggaagacaaatcaagagagattattctaagccatctgacatagtaagccagacataggtacttgcggtattttcaccctgtcccctccagcaaaagctgacatatcactaatgagagtttttacttctaaactaatgatcagttcactttgactcagtgtgtggtgattgcttgtaaacgaataattcccttgagtctaattagggtggttctagtctacatgtttcctgttgagactagacctggcagatctcaagaacatttctgtgaactggacatgaaataagatgggaaacagtaacagcagtcatgagaatatgcactaatttttctttcccgctccttctttgttcccagaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtaggctcagacttcctcttccaatgccaagggatggagagctcctttactccacagctcacagtgtctgacacttgcagtgtatctggtggaagtcactggagcacaatataagtgatattggtggggatagaaatgtttaaggcatgtatagcattctttgacaccatataatattgacatgtagggagagttgcaaactcattgttatgtatttattgacctaactacgtatttatccatttagttttcttagtaactcaaactctaaaaaaactttcacaagtttaagtatatacacatattataaggaggcttgctcagaatctatgctattaggtacatataagaaagttaagtttcagagggaaaatgacggggaaacattttggttgctccgggttattttgttggggaagaggggatcatatgtgtgaggtgaaaaatctaagtttctaggcattcccatgtctttttaagggaaactcttttctttaggtgccctcactgttccagagtaagccccagactcaccagattccattaaacttagtacagaatgccctcctgactccacacagttaggacatggccttccactgtgggctggcatccatcagggcctgttgcactccaggcaggtcgcgttcattgtcaccaacttcttatcccagagaaggaggagagaggcccagcctcctgtacatgatcaaaggcacttctgaaggaagggtaagctgagtacaaaaggcaggagcacagttcccaaggatgcaaacaaaaaaacactcttctatagaaaaaagaaagaaagaaagagataagctgaaaaaaaaagtaaatggccgtttttcataagaatgactccctgcctcccatctgatatttactaatattaaagggagaggaaaatagttatctttttgtcttcactataaaatagtaaagaaggaaagaaattgcaaaatgtaatttgtaaccctaagttgcatggaagactgacaaaaatccacagttaaatacattttagcaattagctggagagacataaggatgaatattagtgccccaaaactaaacaatataggtttttattttgaggcatttctgaggatcttcttggagccccatggtgactataggcagcggtagcagaaagaatctctagatttcaaagtttaactcaaaattgacacctaatatattagatatacacaccaaaatacctttaaaagtagaatatcacctagaagagagtggtaaaaaaatttgctggtaacctcattggttgtaattaccataactaaagaagcaagcctcagagctttctgaatgttgggcgtccaaatactacacaaacatgcatcaatacatttactggttttcagttttccagaaaggagatcagatgaatgaagttgaacctcccagttacaagtggcttacatagcattgtgtgttgggggtacagttactattacttatcaatagtaaagcgagtgtcttctactgataacattgtgaaatatttcagttactactatttagattcccatttcagatatggcatttcacatccaaaactctgctccaacatacaaaatctaatgttgtaaaccagatacattcatggtgtgaatggtagaaatagcataggtgtggtcatgtaacaatttttcttttgattacagatgtgcaatcaaattgtgttttttattttatttattatgtgatttattatggtggatgtcttctgagcctcagtttctttatttctaatctggggctaatgacttgtcttgcagagtatggacatgaaaaccaagagcactgtaaatacattttctatagcaatgagtaaacatggacaaatgccaaaaaatagaagctccgtattgctcatttattcaaacagtatctgaatacctcacactgtgctatgctggcttttctgaaaataagtggaatattaagataaatagcacctactccttgctatgttacatagatggcaggataagtctttcttcccagtttccatcttctctatatttccaaccatggtggtgattaagtaaaaccttacttgatggaggattaagtagtaagaacatattttatctatattctgcatagttttaagatttcttcatcttttttatctgtctctgcagcttttccctttctatcagtttaccacagttgagtgttttctgtacttacctgttttaagcagtcacctaggatacttcttaaatagcataagtttctaggttcctcttctagagaaacactgccacagattagtactttagtccctcctacctcattacagctagaagatctctggaagcactaagcaaaggggagtggtaatagctttgctttgcccataatgggaaatctataatgtaggtttcataaacaccaggataacaccttgttcacttctgtatctctagcctccaggagaaactcttcctaaagtaggtacttgaggcagattgagtacattaggaacagggttttcatctcaaatttcattattcctgttgggcttgttcaccttcaagcctgcactcctgactcctccatgatccaccactctctctgacaatggggtatatttacagaatattcacagtgtggtaatgtccagtccgatcctcaaggaagacctatggcataagtatacattagcccccatttacagatatgaaatagtagactcaaagaggataaattacttgtcccatttatacagatagtgattagtgtagctactattaccatctccaggtgttttactattaattttagattataaaatatatatcagttttagaaaaccggaaaataatataaaaaaaagaaaaatccaactcttacaacctggttatctcttttattaacattttagtatcttttaagtatttatcttagttatttatatgaattctttaaatattattctaaaatactgttgttttcctgttgtcacacagccttaaaggggaaagggtttataacatccatgatcaggattgttcttttaaaaaaatgaatcagaaaagcaagagaaatacaggagaggtgagagagacagagagaaagagaggcaggattcaagttaatgggttaaagaatagtgctggtcaaataaaggagagagttttggtttttccctctccagtttatatggacatttcagcagtgtctcctttagtgacaattcttcatctgcaatgtttattcattttctaatcagttacttgcaattcagaaattcaggctaagagtgaagaagttcagcaccacggtcagctgctcaggatggcactggggacatacatagtgtactgttgttcttctctagtgatgctctttgatgagtatccaatttacattacatagttaccctaacccttactgtgtctggcttgggtagagacagttctatggcaaaattgaactatgtggttcctctttgcctactttcttaaagtagaacattgatatttttccagaactactagatgggaaagagatttcttctttcaatccataaggggttagatatgtttcctttctcactttttacacatctcattcaaattgcccatggcagtctgccctctgccgaattacaatagtctgaacccattcatgcaggtagagaatcaaagagcagagatattacgtgacaagagaactgttgtaagaataaagaagacaacaatagtacatgcaggtcaatcatccttataagagcccagtgccttttaactgaggcaggatgtttatgcaatccccaatacatacagctgtagcaaagtgagactcaagtgagactcctagaatagaacaaacatctgaggagcacctgggggccgagtacagggttcaggcgccaaagcatgtgattgcataatcaaccactgagatgccagagaaagttctttccattctccaaagagtcaaatgaacatttaatttagctcttttgaaactcaggcattttagtcagccaactcacacatatttatggaatgtttatcatgtttctcaaattgtactaaatactataaaagtttttttttagttgccattttttgagagcccacatttaggcattgcattaaacatttaaaatacatattttatttaaattacatgacaatcctacaatctgtatccaaacccatttacagatgaagaactgctggtcagtgattcccagtcagtggctcaaggtcacatagctgcaaagctgtagatatgggattataaccttattcaatcctaccccaattctctgacattaatcactaaaatgtaataaacttttataaaacaaataataaaaattataaaacaattcataaaaatgttaaatatcaggcaaacaatatgtatgtgttaagttctgagaatggagagatcaggaaggaacagagggatccaggatcaaccttgagtaatctggagattttattatggagaggggagaaaaacaggtatttcatacaaagaatcaatgggataaaatgcatcacatttttcataaattctgtcattatgcaataagaataggttaaacaagtacagtaaatcaggcactgaattctgcactgggggttaaaagttggatttatcagtctctattttcaagaggctgtcagcctggtaaaatagttatttctacttactttttagcttggttatattaattggaaataaaataactatgcatcatcaaaatcatataacaaatgtattaagataatgttttcgaagatagcaaagtcacagaagacggacacaagttagacaccagagtagagcaacaactcctaaatctggagagtgtttttagtcaatacaatctagaaatttcttaacagctaaggacatgtgtttcattgctttagagaaacatagagacttgctctggattgagagtcaagtccattgaatcacattgcttcctgtccgtttcttattttcttcagggctctcacttggatacttaggagaccattcaatagctttgcgtattgcccaacaaagttgaaagggggtacctttacaatactggctgggacagggaggtaaaacttttcttcttattctgtgtcatgtcctcccttcttagtgttgccccattttacttttctacagctccctgttttccaatccattaaattcctttgcaaaagaatgccctccattcctactaagctacataacttacatgcatatatgggagatacagatagtaagagcgtaagaaatgagggagaatgagagtatccatttttccactaagagtagtgaagacagttttagctttggagtcaaatagagttgggttgtaacccctattctttgagtccttaggtaaatcttgtggcttcttggagactcacctttctgcagggttattatagtcagaaataattataacaacatatgtgaagtgtttaacttgtgtgagaagcttaagaaatacaagtgaatatcggtgttgatagcctgacaaattaaaggtgggtgggaaagttgattctgatgatctgatagaggcagtcatgagggaattcacgtgactagccacctattttatcaagagtaaatcaaacccttttcaagaatgactttttttttgtcaaatacaatcttaaacatgagagttcccatcccctttttctcaggctgtctgaaattcacagattatgaaagttaaagtggcatccatgtttgaacagttaagataagacctagaaagaagatttaatcaaacaaggcatttggttgaaaatactgcaacatgcatgccctttaccagaaaatgtgagttctaagtaaggatgaaagaattggcatgcttatccacagcatcttggggtggagggaggagaataaactggtaaattaaacactttttgcaaacatttcaagcttcctataaaaattgttatatttcttagggccttgggtagtatatatcttattttgttttaactatattttaaaccccatgaaaacaagtttttatttcattagaaataattatttcccttatctatttctgtcccaaaagttagtttctgtatagttttattgtttttgtccttcacaattgcccatgaaaatttttatctttgtcttacgaaattagaaacaagttaaaactagtaattgaacctcaaatgccactgagataaaacttaaaatagatattctaagatcaagagtttgataatttcgtgagaattaagtgttttgtgatctctaataatggaaatttctagggaaaatgaaacatttctgaggaccaccatcctacacttctcataaatacaattctaaacatccttttttaatgaagagcagaaattttgttttcccaattttttaaccaaatcaagtttcactaaacttgttttgatataagatatctgagtgttggtatagcataactaatggaaaaagagtgatgaaatttatccatatgtgctcctttttggttaattaataagtaacttgtaattcccaagagactcaataattacacgtcagtgatatatagtcttcaacaaatatactatgcagcgtgaggattgtgtttttaatgaagtttatttttctcattatccaaaatagttatgctcaccctaaaacacacagaaaagaaaaaaaaaatgattatgataaatgcattcttcagttttatccgcacatagtgcttatttgtgccttttccagaattgtttttagtctagattttgtatttttgtcttctgctcatgtatattttaaatcagtatagtctaattattgagtattctatttattaaatattacttttaattttatcaaaaagggcagtcactactgagtatacttttgaaataatgtaagtattttataaatatcattttgatggctatttaatataatacttcatctggtgagtctacataaatgaactcagatttttttttctccttccaaattattggacattatatccaatttttaaatcactagccacttaaacacttttccacaacaaaaagttgtgaacataagtttaagtcccttgatactaactgaaatgtttctccatagaattggtgggactcaattttgcattatctttgggcatatatatatatatatatatgtactaagtaaatgaacaatgtaaacaaggagcaatgctaatccacttttgaggaaaggtcaacaaattgctttaagtattcataaaaatttcatgagctactttgcataaaatgataagtgtgttaattaagtttatggtttcattagatggagtaagtgaaaggtagtcactatttaagaagaagtacttttattttcctaaagtcttaaaattataaggagaagaattgttggatgcaatgagagtggcaaactttctgagccaaagttaagacccaggagagaaagggctgactttagaccttgaggagggtaaaggtaaagttactgatgctagctctgcttcccgcagtggagatgttcctgcccattgagatggtggtgatgatggtggcagtggatgcaagaagggtacagtgaacaacaaccgacataacctactactagaagctttaggatttgaaggtcccaatcatgtacttagagaaccttgatccagtcaacataacaaataccaccctatccaatttactagcgttctcctgccattttaaagttatacaatctatttcactaaataaggccactcaaggattttaaaatagtggaatttagacaattggtagccatctcaaaacataaaggtagaactgtgcctcataccatacatcagaataaatttcagttgaaagtacttagggaaaactagaagaattcttcaatgatctcagaataaggagaaccttttaaactattatacaaatccagaagctataaaaggaaaatgatagatttgttcccaatacacaaatacctgagtggtgaatttaaaaaaatcaatcaaacaaacaaaaacagaaaagcagcaacaaacacaaataaagaaaggcaaaaagatattttcaaaattcgtatcacaggcaaaatataggaagagagttcaaagaaaaggaaataaaaataaaaagattttcaaccttattcttattaaaagaaatgcatattaaaatttcagaaatgcacttttttaacctaccagacagccaaattttaaagctagaccgtatgttgttggcaagcctgtggtaaaggcactcctaggcatttaaatagtcatggtctttatataggacaatttggcagtatttgcaaaattgccaacatgaaagcctttgtcctccagttctttatctaagaatgaacgctacaaatacgcttgtgcccaagcgagataatatccacataataaagtatctcaacagttttaaagatctaaagtaaatagaaacatctaaatttatatcactaggaagctcattaaatgaaatgtgatatgccctatatatcatatatatgattatatattatttatatataattatgtatcatatgtatatacatcatatgttatatttatatatgtatatatattagagcatggaatactatgcagctataaaaaggatgggaaagctctttgtattctgataaagattttcaggatagatgaaataaaaatggaaagttggagataaatgcacattctattttaccatcagtgtaaaaaattaaatgagtagaaataaagaaaatctatctttgctgcttgcatacacctaatatttttctggaagcacaagcaagacattaatagcggtgattacctggggctatggaagatgagcagatggaggaagtgaggaagggaggcagggagggtgttttactatacccaaagttacataaaaaataaaatcagtttgactgattcataatatttataaaatttatcttttgaagcaggatagggtgattaaaatattttattttaatcattgttattattggctctattaaagaacttagtagttgattaaaggccacaaaaacagcacatagaacaaataagttggggaaagggtgtaattccttgccgtgtgtgtgtgtgtgtgtgtgtgtgtgtgtgtgtgtgtgatgtataatgactttaaattttcaaatgtttaatatttggacttattattaataaatttttgttcaatgcctttcttattttaagaaaaaagtgagatgcagctcaatttcaaagtgaaaactccaatattaaatctacctgccttgttacatctagaaatgacagtttataaagcatagtttccttcagccaatgttagctcctgagtcatttcattttatacataaaaactgtgtgtggggtggcggtggtggtgttctttgttctatctccgtcacctggaggccacctcctgccaacgcctcataattacttggataccattcttcctgtactcttcttgcctgaacccctttatgccccatctatccagattatggccggtcttatagccagtcttaccttctaatccaattcccacacagctgccaaaataacctttcttaaaagtaatctgctggccgggcgcagtggctcacacctgtaatcccagcactttgggaagtcggggcagcagatcacttgaggtcaggagttcaagaccagccgggtcaatgtggtgaaaacccgtttctaccaaaaatataaaaaattagcctcatgtggtggcctgcgcctgtaatcccagctattctagaggctgaggcaggagaatcgcttgaacccaggaggcaggggttgcagtgagcccagatcatgccactgtactcactccagcctgggtgacacaggtagactgcatctcaaaacaaacaaacaaacaaacaagcaaaaaaatacagtaatctgcattagtaacctctgcctactcaaagttccatttcttaaaaaaggtgtaaactgtgtgacctagcctacaaagtcctgcatagtgggatccaggccgacgagctcctggcactcagccgctggaagtcctgggccacgcttccctacatctctaaacctggctgctgcttctcctggccttgcaaccatgctcctccttccctcaggtttcagcctgtccctgctgcataaggagggtttcacagcaccgcactctgcatttccatggccctgtgcactgagtgctggaaacctgcatacattttatagatttatttgatgagcatctctacactaagaccacgaagaccttcagagaggacagtatacctttaaactctatgtctccttaatacattacttgtcactgtgaccagctcaggtggatcacacaaatatctttttttttttttttttttttagatgaagttttgctcttgtggcctggcccaggctggagtgcagtggcgcgatctcagctcactgcaacctccgcctcccaggttcaagcaattctcctgcctgagcctcccaagtagctgggattacaggcgcccatcaccttgcctggctaatttttttttttctgtatttttagtagagatggggtttcaccacactggccagcctggtctcaaactcctgacctcaggtgatccgcctgcctcggcctcccaaagtggtgggattacaggcgtgagccactgtacccggctcataatacctttctataggagaaagaaagggaggtaaggagaaaaaatgaaagtatcttttaattcattagcataatccatcaaacaatgaaaactcagaagttgtggaacaaaccaatgaaatcaagtcagctattaattcatcagctctacttttctaattataatgagtctgatgcttctaaccctatatgaagcaaccaagttactcagtgaaggaaataatgccttgggccataatggaggtgggagtgagcagccttcggggaagtggcagctaccgcctgctgaatgtcacacggttgaacaggctgctgcagctgtactggagaaaacacttcccaagagggaggagacagacatttagctttcagttactaaggaacctaatatataaaatgttacaaaaattgaaaatgtatatatacacaaacgttagttctatttaattgttcattttgctaaggttgacgcaagttcctcaggggaagatataagctgtaatctttttggtagaggggtatagccagggacttccataaaattgagagagaaggaggcggagggggaaccaggcaggttggattgcaaagcatgcctttccagctgcatctctcatgtcttctcaaaggggtcttccaaactcaacagaggctaaatcctcaacagtatgacccgagccatgatccatagctgtggtcaaagtaaaaaggatgaggcaaacctagattcaagttctgaccgtacctgaggcatgcatgtctcacctccctgagcctcagagttcttatttgtccaatggagatgataattttcccttagaggattaaagatgaaagttatttcttcctaagtgccgtgcatacagtaggtactcagccatgacatatgggatgattatttccttgccactgcttttgcccacaaacttactagctgtcttccctttacgtatcccagctttactcctcctcccaggcacggctcctaattggctttctccactcaagaaccattcaaactcaaagaatatgcattctttctaaaaacaaaatccccattttcaatcatatttatgtagccataaggacatagttcctttcattatttaatttttcaagtcttgaaaacatgccctattttgtctggaaggaggtatgcatattgaacttgattctggaatctgtgggccaagcctgttattccttcccaggtccagcacagttccaggcctgtagggagacatcattctttgcctttagaacagatatagctgcttttgcttgtggagcattctggtgtgcaaagctgcccttggacacagacatcatcttgcctctctcccctcttcacaggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgaggtgagttgatcctccttcctgcacctcctcggccccttgcttcaatgaacgcagcaagaaaatcagtgagcagaccaactgagagaagtggtggggcactgaggagtcttaccctgggacttacttcctccatctatgccagatagtcaacaaggaaaggagtgcagccagagaatctgagcagtgaaggagtgatgggctaaaccacaagatagcagctctgtgcattttaaaatccagcaggtttccttctcatttttttttttcctgcgtgtagactttctgtgctgctgcctagtctattggttatgtatcttcttaaaaaaaagacctcagttatctgtggtgatgaaagatatttacattataaacaaaacccatggaatctaaaacctgcagtcgagactaccctttgactttcattcttccgatgcaagcttttgactaataccgtggcgagctgtttcttccctgctctcttgtagaagaggtacagtgaaatgaaccagttcaatgcaaagaaggctgcacaaagctctgcaaactggcagccaagagtttgccagctttgttagtagttcagttcaaggaatgcatgttgtgcccctgctgtacaccaggctctgctgggccataaatgtccagtctctgagttggagaaactgagataagctcttgcagaacaaggaggttaaagctacagtggatgaagcccctgtcactggaagtttagaatagagaaattttatatttatataattatgtatttatataggaaacagggcacttaattcaaccttgaaaaatggcagaagttttctagcaggagatgctgctaagccttgaaagaatagggttagaagactggggaggcaagacagagcatggttcaaaaaatgtcaaacagtccagtatttatggaattcaaaagaataggccatcagtggtgtgtttgagtcagcttgttaccagttcatgagtttcaagtgttagattttcagaaattttgtgagcccttggttaacctaggcattattaaaaattaagttggctgggcatggtggctcacacctgtaatctcagcactttgggaaactgagaccagcagatcacgaggtcaggagatagagaccatcctggctaacatggtgaaaccccgtcactactaaaaacacaaaaaactagccgggcatggtggctcgcgcctgtagttcctgatactcaggaggctgaggcaggagaattgcttgaacctgggaggtggtgcttgcagtgagcctagattgtgccaatgcactccagcccgggagacagagtcagactccgtcttaaaataataataataataataataataataataaagttatgtaaacttgaaattagttttaaaagctaatacattcattgatttctaattatttcactatattatatcgatttgcctgtctcttttaactaaaggtgctctggaggtatttcatgactattctatctgtgttgtggggatactgtaggttgggctgctaccacacagctcttcccaattctatgttcagtgaaatcccgttgacagcttgaagtctaccatagtggaaatacttataccacagaggttgacatacattacaaatcagggactgctttattgttttgtgcattgtctagaccaggggtcagaaaactacctggcttgtctggcttgaggcctgtttttttatgatgtgtgagttaagactaatttttacatttttaaagggttgtaaaggcaataaagaaatttttcaaaaagaatatatgacagagactctaagtgctacagataaaattattcaacaaaggtcagcaaaagcattctataaaactcaactggtatacagaacttacaataatagattattgcatattttatcattattcataaattgtgtgctacaagttgttaatatcattaaaagaatcttacgtttggatacacagtcatggcacaccaacacgtacatacctgtgggtatgtgtgtgttcctgtgtcccaccttggacagcctgctagcagacaacttcaatcactagtgggatagataatagaacagtggagatggagatgaataattgagaaatcgggacttattttttcaatcactatcatgagaataagagagctcttttgatcttaaccttagtttagtatactgtggataaaatatgccattcattaacttcaaaaaggaatttgtcactctttgactcagaatacaagataacaggtggatatttttgagttgctgaaaactggaaatctgtgaatatcaattgctctcctttgtcaacttgtttaattgattgacaaaagaaagaacacactcaatattggaaccatctcaaagaaaagagatattttttataaactcaaagacaacaacaacagcaaaaaaaacaaaacaaacaaacaaaaaaacctataaaatcatctggaagtctcgtcattcccccgacatactttccctttaatgtcccagaagatggttctaaaattcactctgttgccagatttaatgtttatttacaagcccatgtctgcttatcttttgtctcttgtgtgtggaatctgtataaaatcatagctgagtgacattacagtgaaagtcagcatttagggaaatgaaatccgatgaagttggaactgatttcttcagggcgtgcacggatgtcttggtgctttataaaatgtgctccctaggaaagaggcaccttgaaacgtttctctgaagtaacctctgctttagggaattcaagtcttctccagattgttcagccagcttgctccaatgattataaaagaagatagattggctgtaatagcggcgtttgacattagctgtactggaagacaagagttacgtgtcaagagaaacctccagcctttgaagattcaccccaaagtctgtgtggagatgaaagaacactggtgcagaaaccctgtgttctactcaccacatgaccactaactggctgtgtaaacctgggaaataaaaagttctaacttcagtcatccagaagcaagatccagacccctgttggaaggaatggagctaaacaggatatgtaaatctaaggtctattttatcacaacgttgcatatcaattagaatctacattgatttgctttctgccatgcgtccatatgtgcacaaatgaggcctggacatcaccagctagaggacaacagtcgtgtctttgtgtgccaatgactaatttttggagcatgtactactctgatatatacttctgatatatatatatactctgatatatacttctgatatatatatatactctgatatatacttctgtatatatcagattttatatcaaagctaatataattatgcaaacctatgtttctttttactctttaccatgatgtggtaataatggcaagaaaaggtagtagctttcattcttcatcttagactaccttaggggatatcaatcaagtgacacaatgactttctataaagcaactagcatgaactttgctgcactaagatgtctgcagtggtctgtttcccttcctgcccagaaggcaaacagacaagagctcacagaatctgctgtcaaaaaaaaaaaaaaaaaaaaaaaagggcagaatgtagatcctttacttctcattaaaatgtcttctcagtttacatcacttaacccatgtgacttctccaaacgctgcgagaaggattgtagcagctcagtttacttccagcctggagcagaagggctttagaaaaaaagatatttttaggatctttagaaaaaatagttcttttctaacatttttgtaatccaagaaggcttttcttatcaaaagtgctcagtaatcttgttttacatagctattttgtaagctcttaaactgttgaaaacatatttgaaaaatatatatgattcaggagtcaggcgtggtgttttttctgtagtcccagctacttgggaggctgaggagggaggatggcttgagcccagtttgaggctgcagtgagctatgatagcaccactgcactccagcctgggtagcagaataggaccatgtctcttaaaaaaaaaaaaaaaaaaaaaaatatatatatatatatatatatatatacacacacacacacacacacataatgtatatatgtacacacacaaatatataatgtatatgtatatgcacatacatatttgatttacatattatcacttcatagatactgaaaaggcattttacaaagtacaaaatatattttcaatgaaaattcttagtcaaaaaaacaaacaaaaaattagattgaactaaacattttaaaatacatagatgtttaatctctgagaataagtttcacagaagttttaaatagagatcatattttttaaacgtaagagtgctggagttcttctaggaatggcataaaatccagaaacttggaactaagatatataaaaaatttcgtctatgtaaaattttttaaaaccatgtgactgttcaccaaaaaaatctatataattatgtcatcctcccaagaactttaaaaagtactacaaaaaaaatcacacttttgaggcagggctggattgcagttcccactcagacaggcaaaacagcgtgtggagactcgcatcgtgaactttggctccagaacgactgcagtaatacattaggaaagcccggaggacacacagaccctccaaaagaagcagattgcttctgcaggacccaggaggcaccccaaatactgcgagtgcccaaactgtggagggaaagggagatcatcccacaaaaggaggatcatctgcccctgaacacaaacccccactggggaacccgaaggtctagattacgggagaagattttgaccttacttggagctcattgaatttagaaagctgggcaaaatacccaaatgaggaaaaaggaggaaaatccctgtgggcttgctgagtcaatttctgccttgcttcacagtggaccttcaggagggctaccagaggcactgagaaaaggccatagggagaaggaaatctctaggtgaacttcgtaacaatttgaacccattgagaagtctcctggccggcactcaaggaagggcatgaatccagtgtccagaatccacaggtcggggaagcaggaaagccctacttatttttgcagctgtgaggtgggtagcctaggacaagttcacagccctgcttttccactgcttggaaacagacttggtgctattgagggtggggcacggtgagagtgagaccagccctttgtgttgcgtgggagctgggtgaggcctgtgactgcccgctttgcccacttccctgacaacctgcatgacacagcaaaggcacccataatccttctaggaacataacttcattgacctgggaacctcaccctaatcctccacagcagttgccacaagacctgcccaagtagagtctgagttcagacatgcctagcccttcccccacctaatggtccttctctacccaacctagtaaatgaagaaaaagggcatatactcttgggagatctggggccctggccaccacctgttcctctccatactactaaggctgatgctttcttgaaaatgccagctcctgggagaaggccaaccagaacaaaagtagtgcattaatcaaacaaagctgcagatcctcacagagtccacttcaggcccctgcaacctccactggagcaggtgcccatatccgtggctgagagacccacagttctgtgtagtcaacccgcagtaccagcacagagcctggtagacttgctgggtggccagatccagaagagagacaacaatcactacagcttggctctcaggaagccacatccctaggaaaagggggagagtactacatcaaggaaacacccagtgggacataaggaactgtacaacagccttgtgtcccagaccttctctttcacatagcctacccaaatgagaaggaaccagaaaaccaactctgattatatgacaaaacaatgttctttaacaccccccaaaaaaattacactagctttccagcaatggatccaaatcaagaagaaatccctgatttacctgaaaaataattcagaaggttagttattcagctaatcagtgagataccagagaaagtcaaagcccaacataaggaaataaaaaaaaaatcatgcaagaagtgaagggagaaatattcagtgaaataaatagcacaaataaaaaacaatcaaaactttaggaatcaacagatgcacttaaagaaatgcaaaatgctctcaaaattctcagcaatagaatcaaaccagtagaagaaagaacttcggagctcagagacaaggtttttgaataaacccaatccaacaaaggcaaagaaaatagaataagaaaatatgaacaaagcatccaggatgtctgggattatgttaaacaatcaaacctaagaataattggcattcctgaggaagaagagaaatctaaatgtttggaaaatatatttgggggaataatcaaggaaaacttccctgtctttgctagagaactagatatccaaatacaagaagcccaaagaacacctgggaaattcatcaccaaaagatcattgcctagacacattgtcagcacattatctaaagttaagatgaaggaaagaatcttaagagccatgaggcaaaaacaccaggtaacctacaaaggaaaacctatcagattaacagcagatttctcagcacaaatcctacaagctagaagggattggggccttatcttcaacttccacaaacaaaacaattatcagccaagaatttttacccagcaaaactaagcttcataaatgaaggaaagatacagtctttttcagacaaacaaatgctgagagaatttgccactaccaagccagcattacaagaactgttaaaaggagctctaaatcttgaaacaaatcctggaaacacataaaaaaaaagagcctctttaaagcataaatctcacaggacctacaaaacaaaaaatacaattgaaaaaacaaaaacaaaaaacagagtatacaggcaacaaatagcacgatgaatgaaattttacctcacatctcaaaactaacattgaatataaatggcctaaatgctccacttaaaagatacagaattgcagaatggataagagttcaccaaccaactatctgctgccttcaagagacacacctaatacataagaactcacataaacttaaggtaaagggatggaaaaagacattccatgaaaatggacagcaaaagtgagcaggtgtagctattcttatattagacaaaacagactttaaagcaacagcagttaaaagagataaagagagtcattatacaatgataaaaggccttgtccaacaggaaattatcacagtcataaatatatatgcacctaactctggagctcccaaatttgtaaaacaattactactagacctaacatacagacagcagctaaataatagtgggggactttaatactccactgacagcactagacaggtcatcaagacagaaagtcaacaaagaaatgatagatttaaactacaccctggaacaaatgaacttaacagatatttacataacattccacccaacaaccacaggtattctattcaacagtgcgtagaatgttctccaagatagaggatatggtaggccacaaaatgaacctcaataaattcaagaaaactgaaattatgtcaagcacttgctcagaacatgggggaataaatctgaaaatcaactccaaaaggaacattcaaaaccatgcaaatacatggaaattaaataacccactcctgaatgatcatttggccaaaaatgaaatcaagatgaaaattaaaaaattttttgaactgaatgacagtagtcattcacaacctatcaaaacctctgggatacagcgaaagcagggctaagaggaaagttcatagccctaaacaactacatcaaaaagtctcaaagagcacaagcagacaatctaaggtcacacctcaagaaactagagaaacaagaacaaactcaattcaaatccagcagaagaaaggaaataacaaagatcagagcagaaataaatgaaattgaaacacacatacgaaaaatacaaaagataaatgaaacaaaaatctggttctttgaaaagataaataaaatttatagaccattagcaagattaaccaaaaaaaagaagagaaaaaatccaaataagctctattagaaacgaaatgagagacattacaactgacaccacagagatacaaaagatcattaaagactattataaacaccttcatgtacataagctaaaaaacctagtggagatggataaattcctggaaagatacaaccttcctagcttacatcaggaagaattagatatgctgaacagaccaataacaagcagcgatattgaaatagtaatcaaaaaattaccaataaaaaaagtccaggaccagacagtttcacagcagaattctaccagacattcaaagaagaattggtaccaatcctattgacactaatccacaagatagagaaagagacatgatagagaaagagagaaccctccctaagtcattctatgaagccaatatcaccctaataccaaaaccaggaaaggacataaccaaaaagaaaactacataccaatatccctgatgaacatagatgcaaaaatccttagctaaacgctagctaaccaaatccaacaacatatcaaaacaataatccaccatgatcaagtgggattcataccagggatgcagggatggtttaacatactcaagtcaataaatattatacactacataaacagaataaaaaccaaaaccacatgatcctctcaaaagatgcagaaaaggcatttggcaaaatgcaggatccctttatgattaaaactctcggcaacattggcatgcaagggacatacttccatgtaataaaagccatctgtgacaagcccacatgcaacgtaatactgagtggggaaaagttgaaagcattccctctgagaactggaacaagacaaggatgcccgctctcaccactcctcttcaacatagcactggaagtcctagccagagcaataagacaagagaaagaaataaagtgcatccaaaacagtaaaaagaaagtcaaacttgtagctgtttgctgattatatgattggttacctagacaaccctaaagactcattcagaagctcctagaactgataaaagaattcagcaaagtttctggataaaaaaatcaatgtagctcttctgtacaccaacagcgacaacgctgagaatgaaatcaagaactcagccccttttacaataactgcaataaataaataaataaataaataaaatacttaggaagatacctaatcaagaaggtgaaagacctctacaagaaaaactacaaaacactgctgaaagaaatcatagatgacacaaataaatggaaacacgtcccatgctcatgaatgggtagaatcaatattgtgaaaatgaccataattgccaaagtgacatacaaattcaatacactcctcatcaaaataccaccatcattcttcacagcattagaaaaagcaattgtaaaattcatatggaactaaaaaggagcccacatagtcaaaacaagactaagcaaaaaacaaatctggaggcatcacattacctgatttcaaactatactataaggccatagtaaccaaaacagcatggtactggaagaaaaacaggcacatccaccaatggaacagaatagaaaacccagaaataaaccctaatacttatagccaactgatctttgacaaagcaaacaaaaacaaaagtggagaaaggtcaccctatttaacaaatggtgctggatatttggcaagctgcctgtaggagaatgaaactagatcctcatctcacaccacatagaaaagtcaactcaatgtgaattaaagacttaaatctaagacctgaaactacgaaagttctagaagatggcattagggaaacccttctagacattggcttgggcaaagatttcatgactaagaaccaaaaagtaaatgtaatttaaacaaagataaatagctggaacttaattaaactaaacagcttttgcacagcaaaaggaacagtcaacagagtaaacagacaacccacaaagtgggagaaaatgttcacaatctatacaatctttgtcacatccaatgactatacaaattctagaagataacattggaaaaatccttctagacattggcttaggcaaagacttcatgaccaagaacccaaaagaaaatgtaattaaaacaaagataaatagctaggacttaattaaactgaagagcttttgcacagcaaaaggaacagtcagcagaataaacagacaacccacagagtgggagaaaatcttcacaatcttcacaatctttgtgacatctgacaaaggactaatatccagaaactacaatgaactcaaattagcaagaaaaaaaagaaaacatcaaaaagtgtgctaaggacatgaatagacaattctcttttttttattaggaaaatgtctttttattaatcaacttttatgttaagttccagggtacatgtataggatgtgcagatttgttacataggtaaacgtgtgccatggtggtttgttgcacagataaacccatcacgaagatattaagcccagcacccattagctgatcttccttttattttttaaatatacatatatatttattatactttaagttctagggtacatgtgcacaatgtgcaggtttgtgacaattctcaaaagaagatatacaaatggccaacaaacatatgaaaaaatgctcaatatcactaatgatcaggaaaatgcaaatcaaaaccacaatgtgataccatcttactcctgcaagaatggccataatcaaaaaatcaaaaaatagtagatgttggcatggatatggtgagcagggaacacttctgtactgttagtggcaatgtaaactagtacaaccactatggaaaacagtgtgaagactccttaaagaactaaaagtagaactaccattggatccagcaatcccactactaggtatctacccagaggaaaagaagtcattatatgaaaaagatacttgcacacacatgtttatagcagcacaatttgcaattgcaaaaacatggaaccaactcaaatgcccatcaatcaattagtggataaagaaactaatatatatatatataatatatataataaatatatattatatataatataaaatatatattacatatacaatataatatatataatgtaatattttatatatatatatatatatatataaaatggaatactactcaaccgtaaaaaggaatgaattaatgtcattcacagtgacctggatcagactggaaactattattctaagtgaagtaactcaggaatggaaaaccaaacatcgtctgttcctactcgtatgtggttgctaagctatgaggatgcaaaggcatgggaaagacaccgtggactttaggggttcaaggggaaagcgtgggaagggagtgagagataaaagaccacaaattgggtgccttgtatactgcttaggttatgagtgcaccaaaatctcacaaatcaccaccaaagaactttctcatgtaaccaaacaccacctgttccccaataacctatggaaataaaataactaaataaataaataatgctaaacaatcatacttttattaataagttaaaagtgtctacaattttttaaaaaaacaggtaacaatgaaaaaatatgtaaagaaaatgaacacataaaaatacaaatgactttcatatgtatgagaagatgctcaacctcactaataaaaaaagaaatgctaatccatgctaaaatattttcaacttatattgtaaagaccaacacttataatataccatgttgacatggaagaaaacagaaatattttatacactgttgatggcactataattaataatatataaaagaaacagtgatgttattcaaaactggaaacaaatgctcttcaacccaataattctgtttccagtaatttgtcctacaattattagcaaatgtgtgcaatggaatatatgctaggtataatacaagatttgaaattacccactaacttatcaaaaagggatttgattaaaaattgcggtcagccctgcatgggaacagctttgctcacggtgctccttgcaggtacccagagtacactcagccacaggcttgcaccgcagctgatctgagtcttggcaggacacctcgaaatgtgagaaggtgaaggccagtgaacaggtgctctgaaaacttacatcatttgcctccctacccctgtgggaggccaccatgtttctcatcacctctcagattgtgataaagggtagagttctctgccctctcctctcagaatagagctgcataatacaaaattgtttagctcaatcaagaattgcgttcttggccaggtgtgttggctcatgctcctaatcccagcactttgggaggctgaggcaggtggatcacctgaggtcaggagttcgagaccagcctggccaacagcatgatgaaaccccatctctactaaaaacacaaaaattaactgggcatggtgcacacgcctgtaatttcagctactcgggaagctgagggctgaggcaggaaaatctcttgaacctgggagttggaggttgtagtgactcgagatcacaccactacactctagcctgggcaacaagagtgaaattcctctgtaaaaaaaaaaaaaaaaaaaaaaggaattgtgttcttagcaatgggaataatacagcccatgttgtggtcatctaacccattttgtttagatgtcatccttcttggtatctacagctacagtgaatggctattctttgcttagctgtttgtgcaaatacaaaactgtctgaatcgaaatgactcttttatctttcccagtctattggtcaggctttggtcttaggctcaccttatgtattggtgcctgacaaacctctatgaaagtgtaatgcactcattaaaaggaatgaggcaatcctatatgttctgatacagaaatcatctccaatataaattgttagaggaaaaataaaatcaaggtgcaatgcagtgtaaacagtttttttgtgtttaaaaaacagaagagaacatataaacattaaagcacatataggcatagaaatttctgaaaggatactaaagcaagaggtaagttagaatctcagagagtaggacaaaaaggaagaaagccttactttttactgcataccctctttaaactttctgaatattttactccatccagaaaagtactttaagaagaaactgaggcagtagaaagaatacattatttaaaagacagttcttatatttgttttaaagttgcatgcactgatttatttttattcctagttttctttaaaaacacgtattactttataatacataattaaatatacttattttttaaattgtctatctcatcatctctagtccagccatagaatttaagctcatcataaaggttgagattttcttctttactttcatttatatctatagcattttgcctgacatataaaatatactctgtaaaaagttgctgagtaattggatgaattttatttctgtgaattataaatgatattaatctgcattctacctttcttcccttaagaagttcctaataggttctccatgctcagaggccaccccttgctgccttccttacttttacttggcgttgcctaatggacatctctctaataacagacctgatttgaaaactggccagacataataaaactatttatttggtgatcatatgatagaatagttatagatcctttgtttcctttggaaattcagttgcagggttaaaagtgaaggcctccatcgaggaaaataaactgaaaaaaataaagaaaaaggaagcaagtagatgcaaagggaaaataacaaaaatctcacaccagttaaaatggcaatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaagactataaatcatgctgctataaagacacatgcagacgtatgtttattgcggcactattcacaatagcaaagacttggaaccaagccaaatgtccaacaatgatagactggattaagaaaatgtggcacatatacaccatggaatactatgtagccataaaaaatgatgagttcatgtcctttgtaaggacatggatgaaattggaaatcatcattctcagtaaactatcgcaagaacaaaaaaccaaacactgcatattctcactcataggtgggaattgaacaatgagaacacacgaacacaggaaggggaacatcacactcaggggactgttgtggggtggggggaggggggagggatagcattaggagatatacctaatgctagatgacgagttagtgggtgcagcacaccagcatggcacatgtatacatatataactaacctgcacattgtgcacatgtaccctaaaacttaaagtataataataaaaataaacaataaaaaatacaaaaattagccaggtgtggtgatgcatgcctgtaatcccaactactcgggaggctgaggcaggagaatcgctggaaaccacccaggaggtggaggttgcagtgagccaagattgcaccattgcactccagcctgggtgacagggtgagattccacctcaaaaaaaaaaaagaaaaaaaaagtcgttttttatcattatatccttcaagttttaaaaactgaagattaaaatatttgtctcaggtcaggaaataaagttcactaagaaaaaaaataaaataaaaataaaataaagagttattattatgtatggcattttaaaattttgtttaaccacccaaaacagccctgtgagaaaggctattatctcctatatcacaaatataaaaggaggacacagagaagttgaagaagtctccaatccctattcctcaatagccaccaagaaaaacgaacaggatttgagcccaggtctgtgtgaccatttgaccagaggtttatctggggagtaggttttccctctgaggagagaaaatcaatgtctggagatacaagcacagactctggggcttggcctgggctctgcctgtgtataagacatgaaatcacattacttggtgccattttccttctagttttaaatttaagattattgtgatttgtggacttgctaactttatatttcttcaagttttatgtgagtgaaataagatacaaagacttctcttaaatttgttaaaagcaaattaattgttttacatatgatgaagggaatattttaatacaagtattatacaaaaatgcattgttttcattaacatgaactaaaggagcaaatggtaacatatcttgttttctattagctgctattagggggatgctagtaggttttaattagtgtgctacttctagtggaagtggccaataagacatttggagactggccaaatttgggctaaattactgtaatccttaataaactcatgtaaagctagccaagcccctctagggtgtttgtaagcctgaggcaagagtacagatagagaaccacatatcatgaatctaaatttgtaaagagttacaaaccaagctaagaaacgaatgaatcaaatatgctctactcccctcccttgacagatagacatccattcacgcccataccccacaggtcaaagttctgcccacactgcaaacagctgcctgttggccacccctcaggaaggcagatgagggacgagaacggtgaagacccttgaaggactatcagagctgttgaggcaggaaactgggtgttgtgtgcagagatcatgttctggaaggcggtggcaacctcctatgtcatctcccctgggctcataaggccctgcccttgtgacacaggatatgaccgaggaagaccacagtgagaccctttaggaacccagttcagggcaggaaggcccactggcctgggtataagggggatgtgaatggaggatttctattgaactctttgcttgaatactaaaatgtacataatttacctcattggccaaagaatctaatgtaaaaatatagtaaattcattcagacaaaaaattataaaatatatgttaggcctgttgggctgtgtcagcagctgacgtctgtcagtctgtgaaaaaatacctatttagagaaaggaactgtaggcctggcattgatcaggtttaagccaggagcaataaggacaaccaaaacaataagaaaaatggtctgaatataccccgttgcaaaacctgatggtagtttgagaatatagggctgccctgtcagcagaaaatacgaggagctgatttatgctgttaagaaaacatgcgtggcgtctgctgctatcactgtgccccacttctgcttttcatctcctccagggctgcaaaagactcaccaaataacatgggccagtgtgctcactttgcctgagacaagggggcaaattttgccaggtttcccagaatggagagagccgtaaggatgtggaacatttagttttaaaaatggcaatgtttcaggcaaatgaggacaagttggtcaccttagcctgggacttttcattgagaaggctgctcagtggaaccaggtgtagaagaagctagggggacactgtgtgtgtggcacttagagttggggctctagattgaaggatgtggaattccagctctttaccttgtggctccaaggtctcagtcaagctgctaaacctctgtatgctgtcattttttttcagctgttaaatggagcaaatcagagtacccaactcaaaggttagagaaaaaacagtgaaggtcagctctaagcatggtgcccgatatataaacatgatcaataagtcctactattgctattactaaaacaatactttgagagagtgcccagggttgaacaagagagacaaaatccaggtgaaatttaagggcaattattggggttgggtcagaagccataggcagaatgtagtaggagggatgtgagcctggagcactggggcaggatgtcaggacatggatgaagcaagggagcgcaggcactttctaaatgaggagcactatcaagaacagtgctttctcttactcaatgctgggctgtgtctgggtaagaaatcacccactctctatcactggcaaaaaagaaataggataaattttttgcagaaaaaagaaggacactggaaacttgtgaaataatagattgtaaaaccaataaggaagaggtaattgttggtaaaaatgtaaacaattgcctcgactcattatttggctccaaagtcgaagcaaaaataaggcatgatatgtactacgagcatattaaagtgacagacatcagaagttccaaacatgggacagactgagtcattcatcctgtcaaacagtaaaacataagttacaaaacgatgaccctgggcaagatttggaaagccatcgtccaattttgcctatatgctgttttactttcttttttaaatactcaactttcaggctaatttttaaaaatcaggagatttaaccagaaaattggaatttttgtcctcatttgtaatggcagaaattcatccacccttgactagtatcccaaaggctgatgatggtgtgtttctccttttgaagggccatgagctttgcatgtacctcagcaaacacccagccagtgtaagtcttaaaagatgaaaaagaagacagcagtttggatcctttttttatacctgtttctttaagaagtggactgtcagaacaaaagtgagacaaacatttacaaatgagaaacttcaaaagtatcagatattcaagtcagatacaaagtgggatctttagaacaggaagactccaaatttaaacaggaccagagaaaaagccaacaagggaggaatgaattccttgctgtggaagtaacatcaaagattgaaaaagagacaagcaaataccaaaccaaaaaaaataaataaataaaataagatcaaagaaaaagagagtggtagattctgggacctcatgcatttaacatcaatgcaggctttctccggggatttatcctgttggagctcacctgtgacaacagtaaatccagcaagttaccagatggactatgttgtccaagacattgagactgtgagtgaaactttgcaatctaatacctggcatttttgaccactaagatcaatgaaaggcacaccattcaatgaccactaagatcaatgaaaggcactcattcaatatgccaagaccaagcaagcaagaaaagtaagaaaagaaagagaccgaattgccaaaaaagacaatgaggcaaaagcagatttagaagcaaattgtcagtgctctttttaaaatccaatttaacaaatatctgttgaatctattaatggtttaatcatacctcttggaattacatattcaaaaatgaatcagatattatctgtgcctctgagaaaattttaaggaggtattccacaaacattcaacaaatgtttctttcagcatctactgtgtttcacgtacccctttaagtaggtgaaatatctcaatgcaaaagacaaaagattcctcccctcatagtgcttgcattctagcaggagaggcaaactataaagaataaacacaagtaagtgaattatatagtaagtaagaagataataaatgctatgagaagaacaaaaatagatcaaggtaatggatctaggagttcttggatggagggaacgagattgcaattttagatatgtcagtcagggtaggcatcattgagatggtgccatttgagaagagacaaaaaaaagtcagttttccaggatgctgtctgagagtgcttgctcagcgtattgatctcttttacctaccacaactagactccatttttcatgcttccaccacctctcacctgaggccaaaataagcctctttgatctaatatttgccctctttgtttatttatttatttatttttccatttttacttcaagaaaataattttctttaaaggtggttattatttttctccaaaaatccttcagcagaatagtgtaactattctctgaaaatccttcagagaatacaataactctattcttttcagcctagccttcaaatatcctatcctatggcaccaactgatcttgctttctttacttatgacttaaaatttgatggtttcctgtagattttggtcactagtatgcttgcattgtttctatcatactttgtcttccatcagtctgttggagcatgaatttgtctttagtgactggccctacacttttagatagaggcagcatgtgatttatccttaattccaccacagggctttgaatcatgcttcacaaaaagtaagggttcagcaactattaagtgaatcgaatttgtaccaaacaattggaattaactttatcaagtgtttctaagagttggtaacagaataataagaataaaagagtttttgatcagtattcactgaaaattactggtcagatgagacagattttgttcggaaagtctgtgacaactgtaagttgccaacgaatggatgagcacattacctaatggaagcaggatttccagctcagtcttccatatactgaaggccctgggccatttcatacagactatgtactcagaaatacaatctccattcagtatcatccacatctgccaaataatgaaatattctagagtatgaatagaaaggcataatcagatcttcagcatcctcggaaatgaaatctgtgaaggaaaattaaaaatgattaaaaacaggtttgaaatgcggacaaaggtacaccaattaaatgtagacagaaagaaagcagaagtggaaaaactagtacctttgaaagtaaatattaagatcaaaacaggccgttgtaaaataatcattatagtctctaattaaaaacacatactaaccccatgtgtatagcacataaaatatcaataaatgcaaaagtaaaagacttctaattgttcctatgcagatattggtcaatagtgcccttatgtgagtacctgtgttgcagttccaacatgcagaggccctagagcctggttgaggaagatggttgttggtttaaccagctatgctgccagatgaatgaactaatggacagagttcaagaggaaaagccaaggttgggaatgttggagggagccaatcagaagccagcagaactaagcaggagactagcttgaggatgatcagtattcaatttttgcaaagagtaggtacaataactcggccagcccaaatcttccatagtggtaattcttatatggagggcttgatggagagaaacagcttagaggaagattttaatttttattttcaaagttttggtaaatcagacaaaaatatgaaaacaaatgatctgagggatatatttattaatatagaattaagaggtgtgtagcctataagtgtttataaaatattcagaaaagaaaaacatcattatatgaagcaaatttctccagtctaatttaatctgataatggactaaatctatagttcaatagtcaaattataacttccaattctcaactacgtaaaacatctaaaaatctaaatcagggtgcaaattcacactcatattcaaatgcacataaaaacggttttgcttcttttccctaactggattcaatatgctcatcagcctctgttgcttctaatggtagaaaaatctaaccttgatgatgaataataattacttaatgattatttaaaaagtagtacattattgggtatatattgggttatgttgtgacgttctctctgtacttttttcctcttcccttggcagatcactaatggggtggtttgtgtatcgtgctgcgtcaagggagtcatgccattcacgagtcccacctgtttggaggcaaaagacttgcatcacagctttcattgctgttgtctgtaggacctgccttagtgtactaaccagggttctctagagggacagaactaataggatacatgtatatattaaaggggtttattaaggagaattgactcacacaatcacaaggtgaagccccatggtaggttgtctgaaagttgaagatcaaggaaggtagtggctcagtccaagtctcaaaacctcaaaatagggaagccaacagtgcagtcttcagcctgtggcagaaggcccaagagtccctggcaaaccactggtgtaagttcaagggtccaaagccaaagtcctcagagtctgatattcaagagcatgaagaatccaacacagcagaaagaagcaagtcagcttcttccatcttcttctgtctggtttttctagcagttccggcagttgactagatggggcccacccacactgtgggtggaccttcctgagggtgagtcctctcctagtccactgactcaaatgttaatctcttctggcaacagccagaaacacccagatacacccagaagcaatactttgcatccttctatcaagttggcacttaatactaaccatcgcacttggcctaagggagtgagatgtagtcacttggactctcccagacctccaaatccagctaccagcccttaacacatttactgataacttcagcccatttgtaccctcaacctgctcttctggtcctggggaccctcagttgcctgcctcacactgtgctagagtgaccaggtcactgtggaacccctctagcctttctgcgttgcctcttcctcagcctttgctaacctgtcttctcctccccagctgatttgctctgggatcatgctgaacttgagacagctctaacaggcttgcagccatcactgctatgggtacttctggaggcagtacctttctgtgttttccaagatctgtcttgtgacctctatccatatccacccaactcacatccagtttcaatccctcagggagaaccagagagcaggcctcaagctaccacctaactgtgctcttgtctcaaccaactgcctctgaaaatcttccacccagagtagaggagagattgctcccctcagtgtaataggaaactacaattttttagtatatggtaccctctatactacctgactggaaaaaactctccaccctgaatattttcaatagcactgtgttttgctatttaaaagacagcagctttttttcattctgtttttttactaacattttcctgcaaacaatattttcttaaaccataactgagcgaagtagagcattaatttttttgaaattgaggaaagtagccaacacaaaatacaaatgtcattaaatatttaaaataataaaaataagtaaaagtaacatatatccaaataacatatatttttacattataaatttgatgtatgtgaaaaatttgcaaatccaaaatagatcttttctttttttttacatttttaaattttatgttaagttcaggggtaaatgtgcaggatgtgcaggtttgtcacataggtaaacatgtgtcatagtgattagctgcacagagcatccaatttcctaggtattaagcccagcatccattagctattcttcctgatgctctccctcctcccaaccttccacaggccccactgtgagtggttcacctccctgtgcccatgtgttctcatcattcagctcccaattataagtgagaacatacagtgtttggttttctgttcctgcattagtttgatgaggataatggcctcctgctgcatccatgttcctgcaaaggacatgatctcatttctttttatggctgcatggtattccatggcgtatatgtaccacattttctttatccggtctatcattgatggacatttatgtagattccatgtgtttgctattgtgaatagtgctgcaatgaacatatatgtgcatgtatctttataatagaatgatttatattcctttgggtatatacccagtaattaaattgctgattcaaagacccatctgcctctaggtctttgaggaatcaccacactgtcttccacaatggttgcaataatttgctctcccatcaatagcgtaaaagtgtttctttttgtccacaaccatgtcagtatctgttgttgactttttaatgatagccattctgactggtgtgagatggtatctcattgtggttttcctttggatttctctaatgatcagtgatattgaactttttttcatatgcttgttagctgcatgtatgtcttcttttgagaactgcctgttcatgtcttttgccccactttttatggggttgtttttttctagtaaatttatttaagtttcttgtagatgctgcatattaggcctttgtcagatgaataggttgcaaaattattctcccattttgtaggctgtctgcttgctctgaaaatagtttcttttgctgtgcagatgctctttagtttaattaggtcccatttgccaatttttgctttagttgtaattgcttttggcatcttcgttatgaaatctttgcctgtgcctatgtcctgaatgctattgcctaggttttcttctggagtttttagagttttgggttttacatttaagtctttaatccatcttgagttgatttttgtatgtggtataaggagggggtccaatttcaattttctgcatatggctagcctgttatcccagcaccatttattaaatagggaatctttttcccattgcttatttttgtcagttttgtcgaagatcagatgattgtaggtgtgtggtcttacttctggactctctattctatggttccattggtctgtgtgtctgttcttatgccagtaccatgctgttttggttagtgtagccttgtagtatagtttgaagaagggtagcatgatgcctccagctttgttctttttgcttaggattgtcttggctattcaaactcttttttcgtttcatataaattttaaaagagtttcttctaatttcattaagaatgtcagtggtagtttaacaggaataacattgaatctatacattgctttgggcagtatggccattttcacaatattgattctccgtatccatgaacatggaatgtttttccatttgtgctctcttcgatctatttgagcaggggtttgtagttctccttgaagaggtccttcactttccttgttagctatatttctatgtattttattctttttgtagcaattgtgaaaggtagttcattatgatttggctcttggcttgcctgttgttggtgtataggaatgctagtgatttgtgtacataattttgtattatgagactttgctgaagttgcttatcagctaataagcttttgggctgagacaatggagttttctagatatcggattatgtcatctgcaaacaaagataatttgacttcctttcttcctacctgattaccttttatctttttctcttgcctaattgcctggccagaacttccaatactatgttgaataggagtggtgagagagggcatctgtgtcttgtgccagttttcaaggggaatgcttctggtttttgcccattcagtatgctattggctgtgggcttttcatatgtgggtcttattattttgaggtatgttccttccatatctagttttttgacagtttttaacatgaagggatgttgaattttaccaaaggcctttcctgcatctactgagataatcatatggtttttgtctttagttctgtttatccacatttatgtatttggaccttttcttaatgtaaatgactcaaatttaaaatgtttgaaaacagcaataaatcaacaaaggagattttgtaatacttttacaaaatatttgtggaatttacaagttcattggtaatttaaaattttccagaatgttttatgagatttaggagccattcatatgataaaatataaaactcagagacaaatttagacttgatctaaatgcttgacaaaagaaaactagagctcaaactaatttattacttaaaatatgagcacaaatggaacacaagagtggttcaataagagagaatttgttaactcacaatgtagtaatataattcagctcatcagtagatcaaacaaaatactctcttgtctgtcacatggatttttgaaataatcgtgaataaaactaagcattcattcttatttaaaataaataaataatttgtgtgtaaaagagcagaaggatattctcttcatgtggagtcagaactagtgttatgtatagctgagaaataaaatttttgttttgtttcgtgatggtattgttgttgatgttacaagtttgtataccattattattgttcaatattgcttcaaaaattttggctaggagttaggaagttttgatggagacagtaaaataggaaataaatgtataagaaattgatttcatattaattatattgaataaggtgttttatatatatatataaatacatatatatcatatgattaccatcataccttgcaggtattgtggattccgttccagacgaatgcaataaagtgaatattgaaataatcaagtcgcacaaagtttttggttttgtagtacatataaaagatatgtttatactatattatagtctattaagtgtgcaataatcacattatatttgaaatatatatgcctcaatttaaagatattttattgcaaaaaaaataaagctaacacagagacacaaagtgagcacccactgttggaaaaatagtgctgagagacctacttgccacagggctgacgcaaatcttccattcatgaaaaccacaaaatctgtgaagtacaacaaagcgaagtacaataaaacaaggtattgcctgtatctccctcacaaattaaaaggaaataactaaagagtatatgatttaatataaaagtatatacaagtatctggttaaagaaaatataccagcagcaataagatgagcacagcatttacatgataaaatgtttaatgaattaaaacaattcatatacaatggaatttttgaaatcatgaaattcatagaaattaatttaatgatgggtatgaaaactagagaaagaaaataataaccttagttggaggactttattagaaatattctgaaaatagaaaacaacggtgggttcttggaaagaaaaatcaaatatttaaaaaatatccattcttctctaactaaatgttttaatgtaaataataaattatcaataaaaattctaacaaactagttaaataaaattattctgtaattaaactttaaaatgaaatagataaaatatcaaaaaattctctttaaaaattaaagtagttgtaagtaaaagtgggcaacaggattaataatactcttcacctattacactgcattaagaaacacttttttactagtgtgaagcttgtaaaaaaatctaaaaatagccttaagtgtatcagtagttattcatataagaagacattctgattgggagaccacatcctcctgaaacattaagacagagacagctaaaaagagacagtgaactagagaaagatggagaagtatccaaatatagatatagttgaagtacatgctgacagtgatatttcaaagcagtggaaaaaactgcatttctcattaaatggtattgggataaacctgataatataaattatcttgattctttttcatagtagaaaaaatactcataacaggccgccttgcttttaaaataatatatctattaaaaaggcaatttgtgttaatactaattagaaataaaagttgtaaaagaagaaaaccgctagtatctcataacctttccaaagtgaaccactattaaattaggttggtgcaaatgtaattgcggtttttgccattacttttagtgacaaaaaccgcagttgcttttgcctcaacctaataataacaattcagtgtatttcctcccagactatgctttatgctcaacttcttattgttgacatcatactttatacccaattgtaactcttgcattttaaaatcaacattatatttacttcccattatattacaaatgtttaataagcaccattattgacaagtgaaatttcatcacattgattcttaattacttgctttacaaaactatatagaacatttggaatatttcctgtttttcatcattatagatgacaattgtggacaatcttatgcataaggctttttgcatacaatataggcttttaaactaggttcttctgtagctgaatagaggtatgttttgtttgtctcttggctttagtatggccatatcttttaagatgcttggataagagataattataaagacattgattttctttttctttttccctccttctgtaaattattgttttatttagtattaaaaaggttcagaaaggaagtgaaaatggttgtgtaaaatagtcccttaagaagcaagcaattacagttatttttacataggctaatcagtatccttttaaatgtgtaatcaagtagcatctataattatttgagccatttggctcaagcatacaattgaatctaccaaaaacgcacgtgtttactttcctttcctaatctttctgagcttaaaactaagagtttgtttctattttcaccccaaaagcttagttttggaggaattccagtaccaggaaaacctgggacctttttaaagaaaaacttccatggatgcatcgaaaacctttactacaatggagtaaacataattgacctggctaagagacgaaagcatcagatctatactgtggtaagtcagcccatctgttttgtcttgatggtttctaccactttggggtaagtcttgctttcaccagcccattcctgaacccattcgtaatgtgtttatcttatgctctgagttcccatcagcgtctgacgtgacactggagagaaagagaatggcagatattgaatctgtgttaattgcactagtggaagaaacaaagacattagggccatccagagaattcattttttttttttgactgtgggtcatatttcaactgtgggtagtatttgcagtctatattgggacaacatgaattttttattatctctggaatatgaaacaagaaaaccacatattccattaaattctatggcttgggagttacatatatgtctacttattgttaatattaaaaatagttccttttaaatgagggagattaaacttttagtgtgtttgagattctcatttatcatattgacaaattaaatgattttctaattaagtaacatttgtcttccctaataatgagtttcatgagggtcaggactgtgttttctttttactactgcattcacaatgcctaacagagtgccttaaacgttgtaggtgctcaataaacgtgttgatgtttccaacaataattttggatttgtctgtttctctctccagttctatccatttttggtttatatattttgtagctctgttgtttggtacatacacatttagtatgctatgtattctggtggattcactcttttatcattatataatattattatttgtctctgataactctctttgctctgaagtgtgtctgatgttaatatagccactcttgcttttcctctataaaggtctttgtcatgtaacttttcccatccttttgctcttaacctgcctatgtaatcatttttgaagtaagtttcttgtaaacaacaaatagttgggtcatgttttttaattcatgctttcaatttctgtcttttaattggtctatttagcaaatttacatttaatgtaatgaatgttctgggcttaagtgcctgtttattttgtttcctgggtttttaaaaattctctattttctctaacgtcctgtgtttcctggatagtttttaaaattctatttttcttatctagtgttagagtatatctgtgtatagcttttgttagtggtttctgtagacattatattatatatgcataacttattgtggtttactggtttaatcattttaccaatttagctgatatgtagaaacctaatttccattgacatccctttatcttcccttatttattttacaattgtcttaattaggcaattatatttttagaaccatttctatatatttagaaccatttcaagtggtattattttgctacaatgtcaaacatcatttaaagaattcaaaaggagaaggatagtttgttgcatttactcatatttttgcccaatattgacaaaatgtaaagaaaaactcttgaaaccacaagggatatgtttggcttggattagtattaaagactcatgactgctgcccatgtgatctgcagtgacatcacagtgtttgtgggtgggtgggagagggatgcccttcatatcactggaatgtgatgaaagtcctgactcaccactaaaccatctctgagactgctcctgcaggggatgaagggggttcctcatgatagctcagtagcggcagaagtctaggctttccttgtgatcgcagttgataccatagggagagacttggttctatctgacaatgattaaattcacagatcttcagaattggccttgtaagccagagagtcccagattgatcttcccatataccaccctggccagaaacttgggcacctcactacagcatggctcagtggaaatggggccatagtcttttctatggcatttggcttagggagagaagtcgttgtctaacagcatctctctttctatgctatcctttcctcatcctttggctatagacagcagtcttttaatggcaattttaaacaaaattttatctgcaccagttggtctctctgggttgtctttcagcagcatacttaaaacagatcaggttaagagaaaatccagagaattctccactgtgtttttcttttggtcccgagatttttatatatcctttatttcttttccccaccattcagagatattttaggtaagttttatacataattcctatagtcttttagttgtacttagcagaataaatagggaaaactatgttacttcatattcctggaattggaaatctcttcaactgacattttttctttaatccatggcaagagtaggtcaccctgtcattgacagcaaaaatatgattctctttgcaatcttattgtagaattatttgaacaaactatggcttaaatgactttgtgtttgttttattctttgataaatataatctataagaatttttttgtgttttgaggtatcatattaacacattttcttgaaaattgccattggattcaagggtatgaggcagaggatgctcatggggaatcacacttggattaaagattgtcagcattttaaaaggtttgtgtcaagtccctgactccttcggtttggaaaagttaggatgatgctagggagggattaattacctcactggctctagaaaagccatgacattacttgtccatctctggctaatgcccaaggctcctgacaattctgcaacttatccacatgagcttaggtcaaccatctcctaattaacataaacactggcttgctcatgacatttttttttttttttttttgattctaggtttggagtcttgggctatggaaagcacactcattcctatccctttcccaataatgtttcaagaaatatttcataatatatcagtttccttgagtccaatctgctgacacagattgtgattggagcaggggcactacattgaaatcatgcactaccagaagtttagattagcctaatgtcagaaatattaaagggcatcactacctaccattttgctaagatgtggcagagcaaagtgaaacaacagtaagcttataaaaacattgcacactcattgttcataaactggggcttaaaagtataaaagcctgagctttagatataaataactaagatccctatagtaatattaaaaaagaatatctttatacatattatgtgttaaaaaatatctttaacgataagatagattggagttactgaataagcagagcaaaaaaaaggaagataaaaaggaacaagagaaaaaaaaaacttcagtttctgaatatcagtagctttcaccgtttcgttttctgagagaatcattatctaaaactttgctaagtgttgtggtgacttttaaactactatagcacttatcaagttgcctacaactttgctagcatatgttactccttggggtttaattggcagtattgttaatatgaggcataaagaatccatttagcactaacgtatttggaaaaaaatcccaagaaaattgttttattgtgcaggtaggcaaccttagttttaaccttcacaatttagaagaaaaaatgtacattatttttcttccaaattgcttccaacaccctgcttaagtgagaattcgtatcactatacacttgcacatgtacacacacacccacacacatatttatatacctagtctatctcctttaggaatttcttacgagaagcaatggtttgcactgttaaataccgaagtacaaactctttcctttctgtagtcaagcttaaagtttcccccaaagacaccatatctgctacaaaatcagctttgctccatcactaagtcactgtggtactaagtaagggcttttggaaggaatgatatttttgtccttttctagtgttcgcagactctcttacagttattaggccttgggaagttcagattcaagggatcaacaaatcaggcagcaagagtacggtactactcataaattataaaatgtgtttcaaggcccacggaagctccagcctttgcctaacctaacgtatgcctctttagcaggctgcattcagcaggcatcctcattgcaatctgtcatctctttcttgtgggaccttcccactccctggagacttaacagctgttccatagggataattcaatttagtctttatagctcgatttgactacaagacaattctccacatcccgaaatgcagtaaaactaacagcttaaagtagacataaaaaatacctcactattcttcctcaaatcctttattatatgctaatacagcactatataataaacaatcagaaagcaaatggcccattgaagtgtgtgtacagtacctgtaatatggattattatatatgtagtataagaaatatattgctctgatagtttcctgaaaatgattaatttcataccttgcactccatcagaaatgatgctttttttgagctgtcctttctgagtcttctatctcttctcccagaggcaaggagcataacatgattccctgggagctggctgaagtttcactcccattattgtaggtctcaaaatattttcctttttatttaaaagatcatagtggaaatgcatgtgttactttactttgtcttcaatagaagggaagaaaatgcaaataactaataggaagactctacttacagagttggctttggagctaattgactatgtcaattcatttctgtacctttgtttccaaatgggaattggaatcagggaattggatgggcgatggccaatactaagccaatataataatactcccaaccccatggttgaaattgctaaataatcacaaaatgccttttcttttgtcctagagggaaacccaaaggtctcacttcagtgttcctggaagcatcctcaataaaatcataattgaaacattgacttcctaggttgttcatccccactccatggcttattcagctatgggatcttgagaaagttacgaaacttcagtaccctcatacataaaatgagggcaaatatagtatctacttcaaagtgttagtgtgaagattaaatctgcaatacccttagggcagtgcatggtacacactaagcacccagtagattggagctattaataaaaacatctataaatccattcaactgaagttgacatataagccaatatttatttgccattttagatagctaattaatgcagtcacatacagttccaaataataaaagttgattggagatagctcctgttctttcctgaatctgagtttctgtttactcccaaactatgagtcatgaagtgggtttgcagtaaatatattacaaacttaatcatctcatttatttgagaaaatttgatgaaaatcattacttcagatttgatcaaatggtagactcctttaaaataaggaacttaaaaaagtgttgcctgataggcttgggtataacagatgtattgaagagtaacaacagtgagttttcttgaagtatgttgcccttcgtttgcatctctgctgtcatgcaacttattggagcatggttgattatttcttatggctctaaagccaagcaaacactcactgtcagagttatgtgtaagagataagggtggacatgagagcacacacacatttacatctgcaggtgcacacatataacatacacacacacgtagtgacaggcacctttatcttacctccctgtgacccaaaacctcatgaaaattgctcagagaaaactccctactgtctagtaaagcctataatctctttagcttgtttccgggatcatgtttcatctctgtgagtatgctctgtgataaatgatactttctcttgatcgaaggaatcatttgaaaaagcaactaacatattgtgtcttttctcttctcattcctgctctcttctacttccatttgaccagtcggacatccacatcacctgcatctatgctgtatgctcctcatacccagcaaaaatcatttccaagttattcactcactgaacagttgcttccttcctttcttcaggaaaattggaattaaatagtttcaaggtcatatgaagaataatgtgccttaaagaaaaaaggaaaaactaacagtgtaatggttaatatcttagtccatcaaggcagctataacaaaatgtcataaactgggtagcttatgaataagggaaatttatttctcacagctctggaggctggaaagtctgagatcagagtgccaggacgatcgggttcgggtgagggctcccttccaggttttagacctcacagttctccctgtgtcttcctccttcctcacgtggtagaaaaacaaacaagtcccttggggctattttgcagccattaatcccaagacctcatgacctaatcacctcctgaaaggccttacctcctaataccaacatactggggatgaaatttcaatatatgaatttcaggaaggggaggataaaaacattcaaactatagcagtcagcctgtctgaaaattgttttacctgaaattagtgttatgacttttcctttctatcagataagcaaatgtaaccagtttcttttgctcatctgataaaattattatgtaaagtattaaagaaaatttctttagaatgttttaaaaatatttctatataaaatgaaaatttgcaaaatacagaatagggtatgcaaccagccagagaggaaaacactgttctcatctattataggtatttcattttcacactttaaatgtatatttatatatcatagaccacagtttattgacaattttatattttacctttttaaagtattttcaatgtttttaaaacttttattaaaagttgtttcttctctatttacaaatactatttcagcactaaatcaatttaccatagttcatttaagaatctactgtgttaaaatttgagttgtttgaatttttttctgccaaaaataatattgagattacaaccatggtgcaaaaataattttcttaaatttaaaacagataactagaaatgaatataattgggtcaaagattgtgaacttttgactcaacccacattgcataaagccacaccacattccacgcccactggccgtgtatacaggagacggcttatcctgctagtttcacctgatacttttcaagtcatttcaatcttcaagtgctttttaaaaaaacgggctatgtaaaagttgaaacgacctcagatgtgcttcctgatgcaaaacatccaactaatgagctgagcatattctttttatgctctcgcacctgcagtaataaacgcaatgaccactcccccattcgaagatcctgtatttcagagagcttatagacaaggccacagatcacggtgctagcactggaggggcggtcagtggagggttgactgatgacctgtggttctattagagatcctctgtctcctgtgtgtagcaggcaggaggcagacattattatccacgttttataccaaaaaatatactcaggattagggaaagtcaatgatatatattagtggctgtgcctttcacagtcttcttcctcctcttatggaaagcaatccaccatcaggttttattcatttttattaggcatttattttttttagggtcctgaatgactttcatgtcaaagtgaagaaaaaaataatacaaggctgggcagatccgtgaacagcactgatctctgagtattgaagaccaatgaggtgtttcagaaatggcccctgtgtgctttgttatttgccgaagaaatctctcctgggtgtctcttgcaatgtaagagcttgagggcggaatccttgtctttggtgtgaaaaaggaaggagggcagcgaagggcagagtgtggaatcccactgctccctggctcccagcggctcctgtctctgcatctggctggcaggctctccctctgggttgaaggagaaggaggcgaatgctgcaaagggtcaaagcgcttccccagaaactcagccctttgtttccagtgactcttgtactccttcaaggtgaatagaaacttttatgtgagtgtttcaaaactgttataatcagtttgtcctacatataaaagtttgcttcccagtttgtcactggtgtggcctcttttctaaccagacccggattactcgctgtttctggaattcactccttgcacatccttctctcagcctttgcatgttgtgtttctcccatgccagctgagctgtcttttttctcctttacctcttccctgacccagccccaaactaaccattcttcttcaaactcactggtagggttcacattctgaaccagagtaatgctcaaaatattcaccaggttctcagaggtaaagcagggtcctggagcccccaggctatgctaacccagaaacctggagttgctacattgtagggaggcctagagagcactggaagacaggcaggcaagcccaggtttcagggagccactaggagcttgggaccagtggctacatatcaagtaatatggaaggctgaaattgttaaaaatggaatcaccattagcgcaggccggtatgaacctgctgcataccctccatgccttatcaactccaggcattgtggagcacagtgctgagaaaaactgtagggctgtattcagagtgggtagagaaggctactgtaatctgtaagcagtgtctaccacagggtagggcagtggggagtgttgaatgtgctgtctgcccaccctgtccaggtgcactccttgtcccaccttctcctcagagcccctttcagactctcagtttcataatacctttcttgctgtgaatttcatatgtatacaacatggcataacttagcatttgagtcattattgtcattaaaatgcagttattgaacatctactgtgtttacagcaaatgatccttcttttcaaagagaagcatcctctctgctctcagaaattacacacctggcatggtcttatctttgtagaactcagagttcacagcagatgccctggccttggccatctcctccgaactttctgctctcctggccaccgtttgacagccacccttcccctttttatctcatttgcccttatggtttgacccttactttttgtttgtttctccatcttgatcactcatcacaattctggtttcccatttggcttttccacttcctttctttcaccacaactccagcctgtggatcccgacactacttccaactaccacagccacagccactgcaccaggtggcaagactcaaacacagcttataagagctagaaaggagaaatcacagggatagtaagttcaggaaagactttatgtaagtgcaggaacttggcttggatatggtagatgcaaaagctcaaggtgggactgtgggaaacaacaaactttattctagtctatttctttgcaagagttattcctgtttccctaagtatataaaagaaacacccttttatgtcactcatggtgttaaatatgtgatatacggtcaggaaatatatatggatgaaggcactaggtgttgaggaagagaataatctttgaaggaagtaagattaaatcccagccttaccacgtaatggatacaaaatttagataaagttttttaagctgtctctgcttcagtgtccttcatctacatggtagagataataatgcctactttacatatataaagtgactcctaggatattataggcattgaatcactaagagctgataatattatcataattatttttatagcctcactctgctcaccatttcttctcacatgttccccatgaagaccatagtcctgtgagtaatctctagcctgctcgacaaatggccttttagaagtacaacactaaaggttatagatcagtgattattagtattttatagggcacacacacccctttaagaatgtaatgaaaactatgaacacattttacttcacataacatttttgaggcttcattgatgcctgtgaagctcatccacagacagcagcccaagaactccaggttaaattttagacaaggaaacatttatatgtaaaataaaactgtgtttttataaattcctaataaccttctataagtgttccttgttgaatcaccaggacgcctagtaagtagggaccggacactggatttgttccatataagccagttgggcgggcttcttagaaacgcttcaccttttgtcacaagattcagaagacatctctatgtgtcaagttctgagttattagaaaatgcaaaaaaaaaattatataaaagtggctttctagtagaaggtgggtaactaataaaacaggtaaataggactccaagttgtccagaaatagcatgtgcaaaaaatcaggtactttctctagcttgagatagggtggactgtgaaggaataaggactagaaatgttctctctgcccacctcccaggctgagattcagacctcttcaagtaggtgcagttaccggccgggcacggtggctcacgcctgtaatcccagcactttgggaggcccaggcgggtggatcacgaggtcaggaaattgagaccatcctggctaacacggtgaaaccccgtatctactaaaaatacaaaaaattaaccaggcgtggtggcgggcacctgtagtcccagttactcaggaggctgaggcaggagaatagcatgaacccgggaggcggagcttgcagtgagccgagatcacgccactgcactccagcctgggcgacacagaaagactctgtctcaaaaaaaaaaaaaaaaaaaaaagaagaaggtgcatttaccggggaacacatagcatacagatagcaaagaagcttgccggaaaacttaggtcccagcttcctgcagaagctgacggctgtggggagactgaagctggggtcaaccatgcagattccctgggactcccactgaagaacagtaatggaggacaggaacctggaagcatcttccagcctctgtcaccctgcagcggccctctagtgccccttatggacaaagcataacattcagccagtagacaaaagagaaatgtttgcagggtccaactccgctaccgtttgattgagcaatttcactactaggtgtctacccagaggaaaataagtccctataagagaaagacacttggacttgcatgtttatagcagcacaatgcacaattgaaaaaatatagaaccagcctaaatgcccatccaccaaatggaaaaggaaaatgtggtatatatgaaccatggaatactactcagccataaaaaggaacaaaataatggcatgtggagaaacctggatggaattagagactattattctacgtgaagtaactcagtaatggaaaatcaaacatcagaagttctcacttataagtgggagctaagctatgaggatgcaaaggtataatcataataaaacggactttggggacttgtggggagggtggctggagggtgagggataaaagactacaaactgtgtgcagtgtacactgcttgggtgacaggtccatcaatatctcagaaatcaccactaaagaacttaccgatgtaaccaaacaccaccaatttacacaaaactattgaaataacacttttttaaatgtaaaaacaaaatgcagggcaaagaagagtggctttggaactgaacttcagaataaataattagcacaactgccaatctcttttcttcttttaaaaatttgggttaaaaactagagaccttggacatctggaaaagagagttgggaagaaacaaggagacatacacatattcacggtttcatatgtcacctgatcacagttttatgcaataccagcatgtctcacaaatgtatgaagtccaaaaccacaagtataggcctaggctcttgtaattagtaaaatgtcaatttatttaactttgtcattatgtatatgctccataaaaaaatagtgaaactactacttttattataggcccatgtaatttattacattaaaatgcatttctcagactcaaaaagtttagaacactgtataggtggacatgaattagaagtactctaataatttacctgtctacatgaagatttactgtaattctcacaaaaacttattcatatttaacctaaaaattgttttacatagcttattcttttccgctgaaattgttttatttccctgccacttctttctacgtttgtctaataccttagttcagctcatcactctaacagtacatccacccatggggttatccagtatcccccatggtggctagtgattacttcagtattttccctgatgctgtaacaaggtccaagatatgccctgtgtcagcctaggaagcaagctctctgaagcatattcaaattcatccccaaggcatcagggaaattcagtagctaaataaatatcttctctttaaaaatattaatgatcatttaagtataaaaaataacagattgactaggtcttcaagaatgtgactctgagatgaagaacaaagctaaatgaacatacgtagccttcataagccgcatttgatgtgtctgacagaaatttcgtatccaaacacattttagggtgaaggtatgctctgaaacccaccatttacttcatttatatgtgccacatggtggatgcctgtaaggacagtatgtttgtgcagctgaaaatctgatctttgttacagaaacttcaatgctagcttcccaaggtaaatggaagatccagcagccccagaagatgactttggtagaggattatatgtgcccatacacacggaatgagcttgcctagaagctcatttcatgtgcatgggcacatataatcctccatattgcaatcataatgaatgctttctctataggcttctagtaaactggagtgcattttatcaaacttttaattccttatgatgactggcaaagaccaagaaaatctaggcttttttttcccccatgtttttacccacaaaatcgaatgcttatactaggatttgacaatccacgacatttgggtaaaacttccagcttgtgacccaaagatttttgcaaccctcatgcacactacaggaagcagtcagtctccatgattcataagagtccagagatcattaggtctaagactgctctggaaaagtacaagaatcacagtcttctcaacaatgtaactcaacaaccaaactataagctaataaatatcttgtaaatcacattgcattaccattattcatgaaaaaataatacttatagattataggaaattgtgtaaacaccgaaaatcagaaagaaaagaagtcacccgcaattttatcaaagcaatcataaatactatacaggtatagattttttagtcttcatttcaaaaggactactttggtgtaattttgtgtaattccttttcttgttatcagtattctgccatgaaaataacgtgttgatcatttattacatgccaaatattgtgtcaattgatttttatatttatctattttaatcctcagaataaccttataaagtggatagctctttgtggtttcagtttgggaaaaatgaggttcggtaacattaaagtaacttccccaagatacgtaactagcatgtgatagaatctgctttccattagtggcctttctaatgccaaatctgtgcttagctgctgtgatgtgcttaacacacgttttatattttgctctaatcactgagtttctaaatgttaactaaaatgaaattacattataaaaatggtgatcgataaatgttgaataagtgaatgcatttttaataagaagagaaatgagtaattttaatttcctgtaaagaagtgagcacactacaaattggaggtgcatagtaaatattcattgaagcttatgttgtgatgattataccaagatgaacttgaaggatctgatgaaaggtgaagaagaatgtcttcctaagggagcatcttctcatagaaggctgagcctctctgtacctaaagatctccatatacacttaagagatctgttgcacagtctgactcttagctgcctggagatagagtgtttgaagattgtcttcacgtgtctccctccactaaatgttttctccttccctgattcagcagaggtggcaggacctaattaaaaagagccctgtgtgtggcagaagatgtggcttctccagtcaattgggccactacgtagctagtggaatccattgtttaaagttcacaatgaactcgttctttctggtgctttccatgattgagaattatgtcctctggataatgtctaaaatacttttcaactcagcggtttcattaagaaaaactattaaaactccttctatcactgtattagtctgctctcactgccaaaacaaaataccacagactgtttgactaacacaacagaaattattttcccacagttctggaagctggaagtccaacatgaaaatgtcagcagggttgattctgagggcatctcccttggtctgtagatggccctcttctccctgtcttcacatagtctcctcattgggcatgtctgtgtcctaatatcattttcttataaggacaccagtcctgttagattagagtctatcctaacagtctcattttaatttattcacttcatgaagtgtactgtttccaaatacagtcgcattctgaggtactgggggctgggccttcaacacatgaatttagaggaaacacagttcagtccacaacaattagactctgcaaaccatctaaagagcttgtgtgagcagtctttaagacctctcctccaactccacttcctaaaacaaaactaaaatataggattttcagctccatgaagtagtcaggtatccagatccttctgaccctctgcttggccattccaaccctccatcttccattctgagagtcccaataggctgctggagcttgaggtattctatctgcatgccaggctgcagaagaaaggaagaagtgaaggcaaaggggatattcctcccagctgagtcagctcccttcaaggagccttccagtaagtcccatccaatgctccttccatgccatgccttataggtctgacttagtcacctgaaaatacatgtctgcaagggaagtggggaaatgtagtcatccagttgagcacattcttgcctcaaacaaatcattatttcactaccaagaaatggaggaacaggcagagtgcagtggcttaattattattaattattacacctgtaatcccagcattttggaaggccaaggcaggcagatcacctgagatcaggagttcaaggacagcctggccaacatggtgaaaccccatctctactaaaaatccaaaaattagccaggcatggtggtgtacacctatagtcccagctacttgggaggctgaggcaggagaattgcttgaaccagggaggtggagtttgcaggggaccaagaaggcaccactgcactctagcctggacaacagagcattgttgtccatttcagaaaaaaaaaagaagaaagaaagagagagagagaaagaaagagagggagggagggagggagggagaaaggaaggaaggaaggaaagaaagaaagaaagaaagggaaagagaaagaaagagcaggaataataattaatttttgttatataactagggatctttccacaatctctttgaacaataaagatcagtatataagagttcttatgtaagaagtaaaacaatttctaccttagtgtcaaaattggcaaaactatcattactattataatgatgcactagatttgtgtcatccaatatggtagccactagtcatgtgtaactattgaacatttgaagtaagtatgtctggtgcaaactgtgatgtgttttaaggcatcccagatttttaagacttcatataaaagtaaaataattttatataattattatgtaatgtttttaataccgattgtatatttaaataatatttgcatctactgagttaaataaccctgtattaaaatataaattaagttactctgttttaaaaaaaattttttttaaatactgctactagaaaattttaaattacttatgtggtatgcattatatttctattagacagcattgacctgggatatcaccccaaatgtcagtatttcagtagcagatttccttttacttttttattttaaaacatttaattgaaaaataaagatagtatatatgttcaaggtgtacaatgtgataatttgatgtatgtatacattgtgtaataattaccacaatcaagttaatcaacacaaccatcatcgtctatgctgtaaattagatcccaggaacttgtttgaacatcttataattgaaagtttgtaccctttgattaacatctctccatttctcttaccctctaaccctgacaagtactgttctattctctgctcctgtgagcttgacctcttgagataccacatatttgcctttctatgtctggtttatttaactcagcataatgacctcctgatttattcatgttgccacaaatagcatggttttcctctttcttatatatgtatgtgtgtatatatatattcttatttatgtatgtgtgtttatatatatacacacacatatggagagagagagagagagatgtcacaatttctttattatctgttgagggacactaaggtagtctcatgttttggctattgtagataatgctgcaatgaacatgagagtgcgcatatctctttgagatactgatttcatttctttcagatgtatactcagaagtggaattgctaatatggcagatctaccttttggtttctagggaacctccatgttgttttgcataatgcctgtaccaatttacattactaccaattgtgtacaagccttccctttctctacattctcaccaatacttgtacctttttttttttcttttggatagcagccaccctaacaggtatgagatggtacctattgtggtttcaacttgcattgtggtttggatttgcatttccctaaacgattaacaatatgaatacctgttggccacttcaatgtcctctttggaaaaatctctagtgaaggtctttgctctttttattatattatttgggttttttgtttgtttgttttgttttttgctattgagttatattatgagtttcttgcatattttgtatagtaccctcttatcagatagctagcttgtaaatgttttctcccattctgtaggttgccttttcattctgttgcttcctttgctgtgcagaaatttgttagtttgatgtaatcccacatgtctatttttgcttttgttgcttgtatttttagtgtaatatccaaaatcattgcctagaccaatgtcaaggatatattcatctatattttcttctcagagtgttatggtttcaggtattatatttaagtctgtaatacatttcaagttaatttttgtgagtgttgtaagacaaggacttaatttcattcttttgcaggaggatatccacttttctcaacaccactggttgaagagactattctttcaccactgtgcaataagtttatttctgagttctgagttctttgttctgttgatctctgtgtctgtttgtatgccagcatcatactgttctgagtcctatggctttgtggtataccttgaaattaggaaatgtggtgctttcagctttattttttcctcaggattactttggctatttgaagtctttttcggtttcatacaaatgtaaggatttttttattctacttctatgaagactgccattggaaatttgatagggattatattaaatatacagatgactttgggtagtatgaacattgtaacaatatttattcttattactcgaacatgggatatctttccatttttgatgctattgtaaatgggattgtttattttattttcatatagtttgttgttagtgtatagaaattcaacttatttttgtatgttgattttgtatcttgcaactttaggaatttatttattagttctagcaaatttttggtggagtccttatgattttttaatatataatatcatgtcatctacaaacatagataatttacttctttctgatttggattttttaataattttactttttcttgcttaacttcttaggctaggacttccagtaccctgttgaatagaggcagcagaagtggtttgtcttgtttctgatgttagatgaaaagctgtcaacctttaatgttaagtatgatgttagctataggtttgtcttatatggtcttatatagcctttactatgttgagatacattccttctacacctaaatcgttaagagttttttcatgaagggatgttgacttttgtcaaatattcttttctgcgtctatcaagatgatcgtaagatttttatccttaattcctttaattgatttgcatatgttgagctatgcttgcattgcagcctctccttatttaatttttaattaaaaatatttaattattattatcattattattattattttgagacagaatctcgctttgtcacttagactgaggtacagtggtgtgatctcagctcactgcaacttcctccttccaggttcaagcgattctcctgcctcagcctccctagtagctgggactacaggcgtttgcctccatgtctggctaattttttatatttttagtagagacggggtttcaccatgttggccaggatggtctcaatctcctgacctcgtgatccgcctgcctctgcctcccaagttctgggattccaggggtgagccaccgcatcctgccttaattaattttttaacttaaaagtacttcattgaagataattacacacattccttcctatgttataaatattactgattaaattgagaagttgacttctataacatactcattatttgttgatggtactttcccttcacacacacttgctatttgttctatttttactcaagaacaaaggtactcatattttcagagctaagaatattttttcctgattaaagtgaatttagtctagaaaagcagcatatacttgtatgtgaagtggaaagttgttttgtttgtgggctaaaaaaagtagtttggagacaaaagaaaaccataaatacacacacacacacacacacacacacacacacacacactccacttccttcagccttatgtgttagtaagggttccctagagagaatcaataggagactgtgtgtgtgtgtgtgtgtctgtgtgtgtgtgtgcctgtgtgtgtgggtgggggggtaggggaaatgattcacatggctgttaaggctgagaggactcacaacatgccatttgcaaggtggagacactgggatgtttatagcgtgactaactccaagtttgaaggctggagaaccagggaagccaatagtgtaactctcaggctgaggccaaaggcctgagaacccaagggggtggggtgcaccagtgtaagacctagaggccaaaggctgaggcgcctggagttgttgttcaaggacaggagaggaagagtacatcccagctcctgcagatagatgaacatgttcattttttctgtttttgttctctctaggcccctagcaggttggatggtgcctgccaaacctgaggacagatcttcccctcctagtgcactcagactcacatgtctcctctggaaacaccttcagacacacccacaaataatgctttaccaggtttttaggtattccttaatttagtgaagttgacacctacatttaaccatcacaccttactgttataatgacttgttgcttttgccttatgtgagtagactggacgcatgactaaagattgcagtagaggagacaagcaattctgaaattatgcaaaagtagaaatcatttgaaaagtagtagtcattgggtttcaaacctagatgcttctattcctacctggattacctgctattatttctttcagcaatctacactaatttcctaatagcaattactgatcctgaatatttttgtcatgaaagccttcaaataaattcacatacagaaaactgtttaactgaaactcctagtataaagctatacctctttattttaaatacattggaaatacaaaagattttaagtatggaaataaaaattgccataattccaccacccagaaagagtcactatttagtatattagtcatggtcctatgcctacatatttatatgggtatatttcacctgattcatatgtgtaaatttgtattctatttgttcaatttaatgttataagcaattttcttgcttgccataaacatcgctactagtggtggcaaaatagtttttcatatacatataccataatttacttaaatatttatataatttcagacccagttttttattattataaataatggttctcagtgtgtaaatcttagtccaatttcaaattatttcctgaagacttctagaagtgaaagtagagtgtcaaaaggagtattaatatttttgagcttcttgattcatagttccaaatagctttgtgcaatatttgctaacggatattaaaaagtagatttgggagggcaaaaaaagaagcaaagacaagagaccatctctgaggccaaaggcagcatgtggctctagtagttccctgtttactggtgcctgtgcataggcagctgctgagaggccagaggagaggtcatgcagggcaccatcttctagcctgtccatgcaccatggccattagcagggccttccttccatttctaaaaatgtgtctctcgtggatgtctctcaaatgaaaccctaatgtgcacgatctttatccttgaaggcctcctttggcagaagcagaatgttgcctgtccatagtaatgccacttgtttagtttcacttaaattcctaacatgtattatggacttcttttcagtacttgtcctttccggttttctcttcctccacccaagtcctattcccagcttcactctcttccctgttttctcttcctccacccaagtcctattcccagcttcactccttcttacttgtcctacaaagctcaaatccaaaggcacctcataaagccctgtaacaatgctttgttacatgctctcccagcagaatacgtgtctccctcatggcacttggtcatagctgtgatgacatgttccatgacccttatcctactgccatgtaagctctaggtgggcgggtctgagtctgtctcactccttcactgtatccgtagtcatgagaatcaaggtggcccatatgaactgcttaatagagaactgctaaatagagaactgctaaataagtcaataaaaaaatgaaggagcctgtctttcccaaaaatgaaaaagagccttgatttgattcccgagtcaccctgagtttgtgaataggaaggtagcttgagctcacagggcagtcttttccctacatttgctgacagcgtgccagtcagtgctggtagttctcagacaaatcaaattagaaatggttgtactcatttggaaaatcaagaactggctttgaaatctttccccgcaaattagattggatgaagatcattttctccagcttataaatgcttgattggctttgtttgatgcctcatgactgaagctcagctttgcactgctagctttattttttactcaccagggtgttgtggcgtctagatgatgattaaaaacaaaacaaacacccacaatgaaaaagttttgtaaataacagctcagcacagtaatgtaacccttggaagcgtcacacataagaaacttgaaaaatagccaagctaagcagaacttcaagctgggcctgctgtattctcttcaggtcttaaaaattagtttcctggagtggcgggacagccacacctgacttactatttcctctcaggaataatgaaggacgtgccaggatctcactgtccctacggtagaggagtctcaatgggagcagactgtctgtcttccttccatcttcttcaccaacccatgcatcccctttctctggcttctgccttagtcacctgattggattcagatgcattctcctttcagtcgtagcctatccatagctacctggatgtataacctcaggtcttttttcaacaaagagtagtcccttattcttgttttattcttcccaggtgactcaaggtcagaccagagctttactgttgagctggtaagcagtgtttgaagcagtggtgacagcctggttgagaatccgctagagaccatggatcttgcatggtcctcacacgctttttatttatagctttttttattttcaggttttcatttaaagcagagcagccaacaactttctggagtcttccacaaaatagctaaatggcttgagtcactaatagtaaacagtaataggtgtctttgggtagtgaaaggagtccaaaaggaatgtgcttgaatatccaaaataactgaccaatgtttgactagaggtataatgcccactaatagaaacacctctgagccatttaacagtgatggttcactttagcataacctattgtctatgcagccaacatagggttggcaagtaattcagtaaaagtcttgaaagaggatggactcctagcagaaatataaggcaaagccagcatccaaatggaaaattcaagcagaattgtcttttcttgctaagttctaaagtttttcatgtacatcaatgacctcaagtgaaataaccaaaggattatgtttaatcataaagccaggaaatgagtacaaatgaagccatttgttaagaatgtctctcttctcatttctgataggtacttgttctagcttagtaaattatggtttctatgccacgtgctgagacctggcaaaaatacccagtgaccaatgaacatacgagagtccaggtttaggaatgtttgactaacatggaggcctgagctccctgttcaatacatttcagtctattctttctattatacaatcacattcagaccactgcagtggttccatccttgtgtctatcagcagagcagcatcttctgaagttcttcgtctgtgtaacagataagtgtaaattcattcgattggttctgtagtcacatgacaaagacttaactactactgtgttctctgtgtcaaaagtcttgaggaagtaaaccttctgccatgacactcctgtccatcagtcatgagatgatcatggtaattacactattactgcaatatctccttttggatgagtttctctgcgacagaggaaagcttttaggtggatgggttttattggatttccatcagcatatggcacacttctggtttagtggcagaatggcctgaatacgtcttcaaggaaggcgctgcttagaaacttcattctctctcacggtttgcttctggttttcattgcatagtccctgaactggcacctgtctaagtggctgcatataatttctcccattttatcttctgcaagaaagttgcaaccattgtagttcctcatacagctcagcattaatctagctttctctttgtaaaatattttaggctacagtttctggggagggggagggaaggggaaagcataatcagtcaattggttattatactcttgtaagtgtgttttaaaatatcaggcttcttatttactttttaaatagagattgggtctcatcatgttgccgaggcagatctcaaattcctggattgaagtgatcctcccacctcagccgttctaagtgctgggattacagatgtgagctaccacgcttggccttcttatttctttaacacgtaaaaatatatcatcttttgctcacttactttttattttaatatacttatcatggattgtgattcttggcctctttcctgcatcaagacaggaattattagggaagaggcctaagtttccctctttagagcctgcatcattcaaagaaaaagtcttctaaaatgtaaatacttggttacacttctcatgccaacaacagaatgattcagatgatccccaaatcctctccaaagacaagacagatgttaaagatgtgggtcttcagtctcagatacccaaggttagagaaacaagtgggaatattagggccctccagctcaatagcctcaggttacaaaaaagaaacctaagcctctagaattgacttacctctggccacccagaaaagcatcagatctgggaaaagggagaaacaataagccaggagcaatgctagatacattgcacgtggtctcatgtggtcttaaatcatcccactactattattccccagatcatgaaggaaacaatgaggaccagagaaaggcatgtttttttttccctaaatatttgtaacaagaatctagttctgcctaaatttaacaccctcacttccttcagaattcagagcaagatgatctataccaaattgtaaacctattgtgtaaggcatgggcagttatcaaaaagtagctaattattacaaggcagtataagaaacataatagatttccacaggtagcacacacgactgtaagcccatggagaaggcagccactgtgggatggatgtcaggaaaggtctgggcatgggcaagcccagaaggcttgctgggccctgcagggcaaaagtggggatggagggtgcagaggaatgaagaggtcatgcctggtggaggaaggaaggcacaacgtatgtctagaggacagctttgcttttagtgtgtctcttcactctagtgagggtagtgccgatgacgagggacacaatccaagggaggtgatggtctatcagtagtcagcaaccatctgtgctttcctgtttgaaatccattgtactctcagagaagaatgggaaccacacttgcccctccagcaccttcctcagtcaacactttctatcaattgtactggcaaatttctcatagatctgttttcttttctcactctcccacattgttattggtattaatcagtgttctccagaaaagtagggccaggatctctatatatgtggaatacatatatgaaagagaaatagatttgaaagagagattgagatttataatgaaaaattggctcactggactacagagtctgggaagtctcatgatctgcagacccaggaaagtcagtgctggtctgtatttgaaggcctgagtaccagaagttgtaaatcccagcctgaacgctggagaagacgagatgaaatttcttgatggagccaagaggaaggaaaaaaaaaagtacaaattcctccttcctgtgcattttactctatgccctcaacggagtggatgatacccacccacattggggagggcactgtactttgccaagtccaccaattttaatactaatctcatccggaaacacacagcgccacacccagaaataatgtttaatccgggcacctcatggcacagtcgagctgaccaaggaaagactgtagtgggtctctagagaagtgttgaaaaaacagtattctttacaattgttagagaagataacgggggctactaaatggggttttatagtagcaggaaagattgggctcagctctgaatgcaataaagaaaagtggggatttatagccaaggagtagggtgggggtcagggaatggaaaattacttagaggtagggtacttctttgctaaactagcccaacaggagctttgttgaaggcagacaagtgtgataatatatccaaggaggtcagaccaaggtgggaggttttggtatactgaactctgcagaattcttgctaaaactggaaaaaacgggacatggacagagcccaacatcacacctagtacaagggaggactcagaggagcctggctagagttagatcaaggaaagagtcttttgccagaaaaaacagacattgtctggggatccctaggggcaaatgtctactccatctttggcccagcacttctgaacatcttggctgttcgagaaggggcatgtatgacagtgaaaatatagggcactaagaactaccatcttaggaacaataggagacctacacttggcgggaccagtgacttgtggcagttgctgccctgggtggtctcattatcatctggaacagcagtcacagtcagacagaggagcccacggttcaactggagctttgggggtgtggtaaggaaaagcactcagaccccaaggatttccttccttccttgaagactgacttcctttttggacaatgaaagaccctggagttcttataagatatagggaggaaaaaaaggacccatggcagctcactgacttcctttcaatctcacttatgaggtcaaggccagtggttttaccttgaaggtttgatcaatgcatccttccttgccaggcatactttgtaccaattacagtaaattagagtaagtacataaagtgaatttaattactacagcatgcaaaggatcaggtcacatttatgtgtacaattaactaatccctgtgcttagcacaattttataatgcttgaaaaatcttgaatgaatgttgaaatcttgaatggaattaaacatacagagggacaaatgggctttggggaatgaaacttccttctcgggaataggaggaatgatatttgagaaagagattaaaagatatatagggtagaatataggccactgaccatttgccatgtctcctttgacacaattctaaagtaatgtcttctcacatggcttttctaaatggccggtgggaacttcctcaaatgccgtcttgagacagattctggagacacaaatggcactactgaaaatggtcagtccatgttgatttcaaaagtagcatttttacatgcagttcatttttcttttttctcctccctttggtgaataggggtgacactgatggccctcaacactgtacgtcatttctgtcagcagtaagcacagctgagacaggactgtcagaatagtggcacacagcagctatgtgacaggaaactgagctgccaacactcacgtgagcccagagagctgggtcagattctgtgtagaaggaatttcccatccacccacatattttctctcctacttgcctttggatttgcccttagagaatacagtagaggcatgcgctaaagacaaagaagttttagatagctggagtggcttcacaggggcaagaatgatagagggaagtgtgaagggaatcgggggaagggagagagaagctggcctaaggtgagcgagggagctgtccaaggaccgaaagcatatcccagtgcatttcaaagttttcctgctttctgttgagctaggtgtgcatccccactcacaaccttatcttaatagtgacaatctctgaaggcatttatttaaagcccttgctctggagaaccaatccaggaactccttagattctgagcaaccctgtattgtgctcaagaagttgggcccattaaacaatgaaatgaagggagactgaggaaagagagccaggcctctggtcagatgtgagcaaactgatcaaataaggaaagaatctcaggtcctctactcctccactgtcctgaagccgccttccatggctgtgatccagagaacactcagaagagggcttgggtgaagctaaactgggttttagataactcctggaaaggggatacttttgcaacctcctatgcctttgccttcttcatctttgtgaacattcccactctacacaacctcagactttgaatgcagctgtgttctggcagatttgtttttacaaaaatgatactgacctcaggaaaggaaaagataaataaaagttattactacttcctagcttctctgcagagcatttgtgatttggcttcttccaaaagacagccctaccacaatgagttggccatcattggtgatgtttttattcttgaaagggaatttaccagagatccaaaaatgcaaattaaaacaactgtgagataccaagagcaagttggtggatttttttttaaatggtagcactcagtgcagaggatggaggtatcagagatggtggctaaaagcaaaagcctccaagttagacaaacatgggtttgtctcccatgtttcctgctaactaggcacatggcttttgctaagttatttattctaagtctggcttgtgcaccctttaaatgaagaaaataatacattacggcattgttgtgcagaattcacaagatatgtatgtaagtgcctatcctattgcctagcacggtggggatgatatatactgtgggtgattgcttgacggatatcaaggtccttaccctttgacacattaattaacttgtgaggatctagcctgaagggaagaaaacatctaaacaactacaacaaatgattcatgcaataatatgctcatagcagtgtgactgatggatgaatcattagaaatgtgctactggtagaagtttggggactgctattcattttcaagaatacaagactgtcataaacaaacatggttggcacctacggatgttcttccaggtagaggcttttggaatcaaaccactacgctgctctggaactgagaactgtactgcgtatctaactctgccacctggccacttctgtggaaagttaaattcaggtagccattcaggttagggcattccccttgtgggatccttaccttttttttgctatgcaaagaataatcttcttactcttcttttgggttcgatgcacacttaatattccccatgaccagtcctttcatctactcctcatctatgttattgaaaatacttttactaagttaaatatatggcccatgtcactgcactgtttctaagtttgaatgaaaaccattcaggaagcatcagagggctttcaagctctgcctctcttcacctttccagacttacctcctttatgctacccggaccttcctgtcccacgaactacttagaaatggcagtttccctggaatttcatagggatgctgttttgctaatttcttcaagcctttgctgaaaatgctagtcaagttacccccactccacccctttcctaattccttcctttgttttgttttccttcgcataacctttgcttgtccagttatttctcctgtccggctcccgctggagctagtatctatcccttttttagcacgttccacattgtgagcttggcacatagttgacttgccataggtatttatataatgagtaaatgtaattatttttacgccccttagaaagtgtggatacttccatcccccttccttctgggactctcagatggccctctttgcagatagcattgtgatccttaacaaatgagcggaaaacgatcttgtgagtgtgtctgagcaaagccgacatttttttcttctttaagatcttgccgctgaatgtggaatgatcctgaaattaaggtcagctccaggtggttgtttatatcagctgtcagattgcggaataaaaaatggcttttatatgtttgacttttattgttttccagggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggtactgtctgctgacactctggatcagcttcttgtttatccaagtcgacaaaggttgaggtcctgacaaaaacatacagaatccaaatctcagggatatgggttagcccagtattcacaaatgtactccaagtctgaagaggcagcatttttttttttttttttttttttgaagatggagtcttgctgtccccaggctggagtgcagtggctcgatctcagctcactgcaacctccgactcctgggttcaagtgattctcctgcctcagcttcctgagtagctgggactacagatgcacaccaccacatccagctaattttttttatttttagtagagatggggtttcaccatgttggccaggatggtctgcatctcttgaccttgtgatctgcccgccttgggctctcacagtgctgggattacaggcctgagccactgtgcctggccagcatttttttttcttagtaggaagcaaaacaaaaagtgaatttataattagctatgtcaactttggttaagtgcttaaatttcttagtctcttagcagtctcattggaaagatgggaataagaattcttacctgggagtatttagcataatctagaccatttatagaactctctgctaggttctctataaacatggcatgtttcatatggaatcttcaccatgcttacggaaggaagttactattttacacttaataaatgaggaaatcagaagtcatggcaatcacttcaaaattccacgttcctaagtgatggagctgggaatttatcctgaatttgcctgacttccaagtctatattctcctcttaaaccacattaccatggaagtttgtataacccctaaattctatttcaagtaaaaatcagtaaatttaaaaccatttaaaaaatatatatgtatacatatatattttaaatgtattgagtaaatgctagtacatatgacaccagggaatgggaaaacttttaaatggtcctcaaatggccaaaatttgggaaacactgattcattgccatgtactacagatcttactgcctagcaatacacagcaggtcggtgaacaaattgtatttctggataccctggctcctccagctgctgtttcttcaacatgaaacagtggaagtctctctctcattctctgttatgttaccaatctctgatgtccttcaagcagcggtgtatttactaagttgacaaatactcattgaggtcaaatctcacatgccaaggattgggcagggattggtctgcagcatgctgatcgatgaagaagttctttcagaagtctccctgaataaacaatctgaataaaaacctccctctgcttttcaccgcaggtcaacatccatcatggattatactacaatttaatttagatgcctttttctcaactggactgcatggttcttttatccaagtagattagcaaaaattaagttaaattgtaaaggatatgacttaatagttgtcgacctaaaaggaagaagccaaggcaatattaatataagtagatagtttatttgggccaagcttgagtattgcaacctgggaatatagattcaggttgccctgaatgtatattctgctctgattagctgcagttagaagcagacttttaaagaaaaaaaaaaaaaaaaagaggcagtttctatgttgtttatcagaaatttacattaaaatcataccagctaaagattgcctgtgcattgttctttgtatcgcagattccaggagcaagaagataatgggtgaggcaggtagtcaggaaaaaaaaatgactttaaacaattgcctggagcatgggtgccttgagctcaggggaagggtgtgtgactgaagtttcatactcatgcctctctgggcccaatatactttgcatcactcacatagttcagactgctctgagctgtttttcttttctcatagttatggtcatgtcagaccgtgggagacattcaaatgtccatagtgaacaaaatggcccactgaacccctgagcatagcagaaaggcctgagtctggaagtcaggcagtcaagtttaaaagtattaatatgttttctccttcctttcctgtggccctggataaactttgtctcatatgcaaactgaattgtattagttatctatagttgcatatcaagtgacagcaatatttaatggttgaaaacattttttattatgtctcagtttctgtggatcagaaatccagggacaacttggctgggtgactggctcagagtctcccataaggtcacaattgaattgccaatggggactgaagccatggcaaggttcaatggaggaagatctgcttccgcactcactcatgtgctcaggaaggccttagaaaatccacttccacatgtagggaagtttacatttttaccctcaagttatttgagaataacttgagtctataaaagaaatgaattacagacaaattaacaggaaaaaatgcacacacattttattacatgcacacaggagtcacaacgacatacaaaatgtaaaagcccaaagaaatggcagatggttgatgcttttatatcaccttgagattatagaaagaactggcgtttagagcatggccaaaatcacgttatgggccaggcacggtggctcacacctgtaatcctaccactttgagaggccaaggagggcagatctcatgagcccagaagttcaaaatcagcctgagtaacatggcaaaaccccatctttacaaaaaactgaaaattagccgggcatgtgggtgcatgcctgtagtaccagctactcgtcaggctcaggtaggaggatcagctgagcccagggaggccgaggctgcagtgaggcataatcacgccgctgcactccagcttgggtggcaaaatgagatcccatctcaaaaaaacaaaacaacaacaacaacaaaacaggtatggtagtaaatcaggttatgatggcaagacaggtaattgaggggagagaaaaggaggttctgtttaccaaggtggtcttaaaatgtaggtgaagccatacaggtatcagcccttagagagaataaatgacaaatgtttttttcagacttttaaatgtttggactctcagtcctcgatccatacaagggagagccttacagaaagccttgttgtagcaatgcaggttttctctacagatgcaagtcccccacaaaagacagctttgcagggctacttcttttggaacagccctctcaaaatatgtcaaagaagtacattttgaggtgaaatattttagtttctttcacaagcttcctcatgagcctctccagaaggctgccaagggtgagtgagaaaaagcacccaaatagaagccgcagtctttttataatctaatattgaaaatggcatctcgtcacttctgtcatattctattccttagaagcaggtaaatatgcccagcttgtgtccaaatggaggggatgacatcaggacttggatattagcaggcacagattatccaggatcatcttagatattgcctatcacaagagataaaaaaaaaattatgttggtgctggcaattaaatgaggtagtatatctcaaatactgaacaaagtgttgagtagctatttaacacatttttcttccttccgtgctgactcaagagatacagctagaaggggcctctttctagagagtcataaaagttaagaatgaatttgtgcagtcagacgatttttataaaatttattagatttccagtaatggaggtgagttaatcacttagaattgtaatattttttcatgttccaaattataaaaattaagcctcaatcctccttatttgaaaaagaaaaacgtgagctggcattgagctgtttctctatcggtgagatgtttttgagtacagagacttgtaggcctcaggtcaaaaatgaagttttaatacaaggaaggccctggcagcacattgctcttaaaaatccaggtgctgtctgtattgttaagcgcacgtcagtccattaaaatgcatttatgactgaaagagagcctggtaagagctgccaccttacccagctgcagaaagggaacaaatcatcagttatttcagacccacctctcagaaactgaaataagcaaaaagaagtttttaaaatgtgcaaccagagttccaaaaactcttgtataattctctcctaaggagaatttctatgtttttggaaaatttgaacttaatgttttttagaaaaggatcaaggttttgtgtattcttcgattttcccatctgggaggaggaagaactaacaaataatcaaacaaaaacagttttctctttccttacatttctgaggaaacttgttttcaaagtacttgagcttatattggctttaaaagaagatgaaaatctcatatgaacaatgaaaaaataatgacaattgttccaataatttttgagagtcaacggggctatacttgatgcttggtatgtcccaaatgggtcagagaatgcagataatcaaaggtttatttgagactagttctaacatcctggatctaaaagagaaggtaattcctttggaaagggcagtacaatgatgcctcacaccttcaaccctgttccccgagctttgtacagtgtgcttggctttttaggaaggaagtagttcttatttagggatttttgcattgaagatcaaggagagacttgcaaagtaaatgcatcctcaaaatagaaggcatctgaatttagttattctagggatgaagtttcaggaagatgaaggacaacagtggaatctctttcttgtatttttctttgttttctatttttgtcatctcctttttttttgcaagccttatgtatgtatgtatgaggaaaggtagaagacctcatttcactgtaagggatgtgaaagtagaaccagcagccattgtagatcttctgccagttaggcattgtgctaggggcttgtcatacaaaactgtaaaaaaactcataaaactttatcaggcggttagtataccaacatacatagaaagaaactgagaatatgaatttaagttaaagtagccaaagtgatgttcaacctcagctttttccttagaattctcaagttcatggtctttacacagtatcctgctgctctccatattcattgtgcatactgtccattgcttaaataactcaaatgtaaagaacctctgcttttacatctatagataatctacagaagactcttaaggaaagtggctatttaggtctaaagctgtgtctttcaaaaacagtttcatggtggtcttatacaagaataagacttggataagaccttgggattcacactagattggaagtctgttgtctttataaacttctgtgtactttagctaaaattaactgtataatattattaagtaaataatacaggaggctgaggcgggtggattgcttgaggtcaggagttcaagaccagcctcaccaacatggtgaaacccatctgtactaaaaatacaaaagttagttgagtgtggtggcgcatgcctgtaatcccagctacttgctactcgggaggctgaggcaggagaatcacttgaacccaggaggcagagactgcagtgagccaagatcctgccactgcactccagcctaggtgacagagtgagactccatctaagaaacaaacaaaaaagtaaattatatatctatatatctatatctatatctatatatctatatatctatatctatatctatatatctatatatctatatatatatctatatatctatctatatatatatctccatatgtcaacacacacacacacacacacacacacacacacacacacacaaatattcattggccactgcactccagcctaggtgacagagcaagactccatcaaaaaaacaaacaaaaaagtaaattttatgtatgtgtatatatatatatatatatatatatatatatatatatatatacatatatctccatatatcaacacacacacaccaacattcattgagaaaataggtcatactttcttcagactctttttttggtgctcagtactgattccttaaaaggattatcatctaaggatgaaggctgccaagtgacatgaggtctacttcagtaagggcctgtctacttctaagaacattgccctgctttctgcaggctttcccattctaattttccccgtgccccatgaaacaagattagatctctcagaattcaaactgaaagatctgatccatgtggaaagccatgagtttcactagagcagagaacaccttctaggagtcttgctggactgtgaaccttatctgaaaatccatttaggcaattctccaatgaatgagcaactaccttgataacctaatttatatattttaagctcccagttctttcttacttttcataaggtaccaagtgccatggggacctctcacatggtcatgtggtcatgaggctctctcaaactccataccctttcattgagcaatagatatcatgttctatttttaatgatggatgtggttgccgttttaaaggcttttatggagatgcttagaatggagtttagtatttttcaaaacaacctgaattactaagaaaacaggacatttcataaaggtaaaggagaccacctggtttgttttcttaggaggaatagggcagactgttttgaatgtcatatgaaatcataagcaatcttaagagataaccggcaccactctaattatctgaaagggatctgacatttcaatgttatttttatttttccgatgggaaaatacaaggcaaggagaatcaaaagaaacaggcatggagttttagcttaagtttttgtttgtttgtttgtttttgttttttgtagtgcttctcaaaatgtcagccagtctggccaaagagcttgaactcaggcttcagtggttgtgcgtcagcctacctgtgctctaatcagatgtaggacatgagtaagtcttgttccgttagcctcactgtcctcatttgctgaaggagaggatcagtctagaatcatggatgctccctccagcactattcatgatttcttgagagaaaacaataggccaacccaccccttattatcttcaaagaaatcatcaacccaaggctcttcttttgaaactggcataaatggtcctgaatgattgggagtacccagggccaagccccttgccagaggtcatgctacccaactcccaaaactctggtgcactttgtggagtcagaaaagtaaacttagcctatttgataccatgaattttgtggatgagttgcttgcatggtcttaaaaaggttatgctatgactcttcacaacctgtagagaattaggagacaaatatctaaacctgaatagggttttttttttttttgcaaccttccttaaatgtgtatatgtgtgtgtgtgcgcacatctatgttggtaggagggttaacaaaatatattaggtcttcaacctatgttagtagaggaacaatattggttgtaggtactgaagctatttcctgcagagagaaatccaggcagagacacagcaagggtctttggctgtgggaccggctttcttatagctaacggttggtatatgtgaacatctctttagaaggcaaagcaagcagcagtgaggcaggcagagagcccactttggattccattaaagcatcttctccccagagcttcctagatgcacagtgtactgccctgatgtcaccagaggcatcaaactcagcctgggattttcagtattaaagagtaagtctacattttaaatacatggttttggcacaataaaatgaaatccagaagggtgggtggggggagaatccaaactaagagatctgaccctggcgctggcaccacttgctcattattagctgaaaaggcaaaaggtgaagctaatcacctgggacagacaaaatctctggacaaaaggtgacatggacagcaaagagccagaaaccaagaaaataccatgaaaaagtgtctatagtcaaggcaaatggcttatcggaggtgccatctcagcgcatcccatttaattcctaggagcaagcaatagtgtttatcatatttcctcaaccaccgtataacatttcactctttcgataattccttgaacagtattagttagagataaggtattccaaaacaaacaaacaaacaaaaatgtaaaaaacatttaagccatcctttttatcagttaattttctatagccagtagacttctgtgactggcttgttctttctctagcttgaaatatggtgagattctcagatcaacagccataatgaatgttttttctgatgattattgagcattgactacatttacattaaataaaatatgtcatcctgtagctatggtcaacatgacacccttagctttcagaatttaatctcaattgatattttctcaagaaacctttccaaggcaggccaggtgccttgtttctttggttttcttctttttaacgtttgttactaagtatgtatatgtatgtattcatctgctcaggctgctataagaaaatatcacagtctaagtgtcttaaacaacagacatattttctcagttttggaggctacaaatccaggatccagatgttggcaggattgatttcttctgagggcttctctctttgcttgcagatggttgtctttttctgtcttcacatggtcttttctctgtgcatgtctgtgttcaaatagcttctgctcataaggacaccaaacatatggaaacttattttaccataattacctttttaaagatcctgtctccaaatacaattgtgtttttaggtattaggtgttgggactttaacatacgcattttgcagggacacgattcagctcatgcaatgtatattaatatgtctatttcattgttgaccaatgcccttctcatcactagaatgtaagcaaccatggaaacaagtacattatttgcccaagccttggtccaacaccttgcttaccacacgtcttccataactatttgccacacgcatgaatacactagtggagttgacctctaaaacatttctgaaagatagaattttaacagggaaagaagagttagtagtgatttttaacaaacagtcctgttacaacaattatatgccgcataatgtgtcaaacccaggaatgagttatactcaggggggagtactaattaggtaaagggcaggggagctcccagaggtagggagatggcctggagagctgcatcgtgcaggatggaagtgctcactctgtggaatgctggcagccaggtggttataggctacggccctgcagttaacagagctgatccccaaatattgccctttctcatagaagccatttgtagctagccaccatctgcacatcaagtaaacatgacgaggccgcaagcttcatcctctgcttcaattaagttgtcattaatgcctcggtatttgagctaagataatgttaatgagaaaatcccattagcaagggcaaaaaagtggatagccacagggctgtgactgtcacaacaagctgtctggtttgagtttcagaagatagtaacatgatatcacaacaagcacagagttcgagtttcagaagatagtaacatgatgaagcatttcgtgttatggaaaactgagaaatgcaattgcctgaactttaagataccaagcaaaggttggaaatgtttaccaaagtagtgatttcttgggcgtcttcagctttttaagtttggataatgacaatggagacattgtatttcttaactcactgttattttctctgtctctcactcaaaagaggaattgcaggagatagaatttttttttatcatagattaatcttcttgtcaaacctgctatcacttccctttttcttttgtattttttactttgacaattttctcatgtaacttgaagttcctctcattggctttaggaaacttttggagtatctactctgcactgggtactgtggttgaacctgggaaggaggcactgccttccaggagctcataggcatggttggaagagacagtaaagaggcattaatgaataatagaacatgtgcctgggacactggggaagcactgggaagaggcagctggataggtgagaaagggaagactttctagaggtggggatatcacagcttggttcttaagaatgaatagaatttggccaaatatggagggaaggaaaggatgctctaataagagaagagaaatagaacgagaaccagaggtgtaagactatggaagcttagctgcctggggcccagatggcaaaagatgaagcagagttttggtcagggaccccagagtttgtgctgtatcttggagagaatagggaaataactctcttgagtttagcttaatggttagcgtgtggatgtttgatctcagcattcaagtctaccaaggaaaccacactttcaccatcaaccacaaatgcatcgtgagttcctaacagaccctagcggatggcaaagccagatgttttccctttatgcactgatcaaggcttttcaggatccaggttaccttgaaatatgagccaggcattaaacgactaggaaaggtttaacctgtgatttatggctaatgctcacatgagggcctgcttctgacacttggcagtggagattcagttggtctgatgctcaatccatcaatgaaccttggagagcgcagaatgctgccctgctgatactggggcagagcggggggtgtcccaaaacgtgactcaaactctgacccccaggtacctgttatcccactgggaagaggagactaacatggacggattgttaattaataccacaaggcagtaaatattatgagctaaacaaatagatcagacagtggatgctataggaatttagaaagagaaatcaccctgcactattctagtcaaggaaaacctgcttcattcgtttcctgatttattaacttactaatttattcaatcaatcaatcattcatcacgttttatatgccctgcactgtgctagctggctgtgatagaaagtaataaaacatatgttctctgtctgtacagtttaggaaagaatttgctgacacgaaaacttggccttggaagattgggggatggattttgatagcaggaaatggtaagggtagcgtataggtggagcagaggctgggtatggaagccccaattcactaagtatatttacttggagcataatgaacacatggtccagctggagcagggaattcttgtaaggattttggaaaatagcctgaaaagacagagggagacttgattagagaaagagtagattgtccaactaagcagtgtgattttcattctctgggctccatgacccagtggaggggtatttgctgtgaggtccatgataaccttgctctttaggtagttggatctagcaaggtgtcctctatcagaaagagacaggaggctgggaaaagagggggaccactaaagaaatttccagcttcagggataaggaatagaacaaaaataagagagggaatttgaaggcatatgtgaactcaatctaccataagtagggaaaagttaatcgaatttgatagctgatggataaacagtgtgccaggaaaacataactcaggctctaaattgtagcataatggtactagtaatcgtaatatactcttctactatgtaactgacattttcagacttccttattcaattattcatatattgcctactttattctcacaaaagttgactgtgagacagtcaacaaaagttgacagctaccttcgaattgttaaataagagcatgtatgagaggacatagaaaggccattgaattgagttttctggggaagataaagcctagaaactttcaagtcaagccaatctattttgtttccattttacagatgatgtaataggtttagagatattaagaaatctgtctaaatttccggaaatttttaagtgtcacgcacttgagcaaggaataacaggtgaataaagccatcaaggaaatctgtaacaagttatctccagggttggaaacagtctttagggactatgatctggtttgggctgtctttttgctcttgtgtgtggctgtcatggcctagggtagtcacagctgacacttaagggccctgaacagccacttggttacaaaggttcattgacaccttgcaacattgattatgatcttgctttttattttgtcttcaaaacataaaaaaagatgtcaaaatatggtgacaattgaagtgcaaagatctgttagaaattttatggaggaattggtggggttagagagaaagagagaaagaggtacaattgagagccagagtacaagagtgtgtcaaggctctgcaacctcaaaattatttctttaactcaatggttctgagccaagggaagatttccattcccaccaaactcaccttttagcccacccatcctccacatggtgaaaaaatgtgctgttggtgatggggatttgtagtgttggtgatagggttgtgctgttggtaatggaaggttgtggcattgatgatggaaggttgtggtattggtgatggagtgctgtggtgttggtgatggagcattgtggtattggtgatggagtgttgtggtgttggtggtggagggttgtggtgttggtggtggagggttgtggtattagtgatgggagattgtaatgttggtgatgaggtgtggtggtggtgatgagggttgtggtgttggtgatggagggttgtgatggtgatggagggttgtggtgttgatgatggagggttatagtgttggtgatggagggttatggtgttggtaaagaggggttgtgttgttggtgacggagggttgtggtgttggtgatgggagcttgtggtgttggtaatggaaggttgtgttgttgctcatgggaggttgtggtgttggtaatggagagttgtggttttgatgatcgttctttgtggtgttggtgatggagggttgtagtgttggtgatggagggttgtggtgttggtgatggaagattgtggtgttggtgatggagggttgtagtgttggtgaagaggggttgtggtgttgatgatggagggttgtagtgttggtgatggagggttgtggtgtttgtgatggagggttgtggtggtgatgggggttgtggtgttggtgatggagggttttggtgttggtgatgggggcttgtggtgttagtgatggaaggttgtgttgttgcttatggggggttgtggtgttggtaatggagtattgtggttttgatgattgttcctaatggtgttgatgatggagggttgtagtgttggtgatggagggttgtggtattggtgaagaggggttgtggtgttggtgatggagggtgatgatgtttataatggaaggttgtgttgtgatgatggagggttgtgatggtgatgggggattgttattaccatctagtgagcaggcgtgctgctacacatctgacacaggaggtataccacaagacacctactcctaacaaataataagccagtccagaatacccagggccagtgttgaggaaccccactttaagcccaaaccctactcttgtaaaacaaatttaggaccttagaatatctcttaactgttctgagtctcagtttcatcaagtgtgagctataaagggctgtggagatctcattatcaaaagcattttaaaagacatattatatgctctgtaactattttttgttttatctagaaagatatatcaaagtaataacaattgactagaattctaatttctgacataagtagacatcctgagaaacaaaagttgaattttcatttaattattttcagaagctaggtgattcacaaaataacagaactaaagtttgaagttggtattgttaaaagcgaagtcatttggtgggaatgtaaagtagtgtagccactttggaaaaattctggaagttcctcaaagggttaaatatggaattgccctatgactgagcaattccaattctatatgcacacctaagagtattgaaaacatgttcatacagaaatgtgtacacaaatgttcatagcagcattattcttaatggtgccccaagtggaaacaattcacatatccatcaaccataaaaacatacttaattgaccaggtgtggtagctcatgcctgtaatcctatcgctttgggaggctgaggtgggtggatcacttgaggtcaggagttcaagaccagcctggccaacgttatgaaaccccatctctactaaaaatacaaaaaaattaccctggcgtggtggcgggtgcctgtgatcccagctactcaggaggctgagccaggagaatcgcttgaacccaggaggcggaggttgcagtgagccaagatcatgccactgtactttagcctgggccgcaaagtgtactttagcctgggccgcaaaaaaaaaaaaaaaaaaaaaaaagtactgattcatgctacgtggatgaatcttaaaaacattatgctaaggaaaaaatgccagtcagaaaatagagcataatgtatgattttatttatataaagtgcccagaataggcaaatccatagaggcacaaaggtaggttagcggtggttggccagggctggaggtgcagggataaggggattgggagacagtatatcaaggttacagagtatatttaggggatgatgacatgttttaaaaattgattgtagtgattgtataactctgaatctattaaaaaccattgggtttcacactttagatgacatatatggtatgtgaattttatctcaataaatctgttaccaaaaaataataaaaataaaagcaaagtagaattcagtagcagaacataaaacttttcagagctttttggtcatcaaagagatggcaggagcagggcagggctggctggagttgccagcatgatgagcaaaaggagctcagctccagtacccacacttccctttgaacgctggctctgcctctgagcagccatggggccctgtgcagcctctccacttttctctgttacatctattacatgagggcaatcaacttgacctccaggactattgtaagaattaggaattacattatttaaagtgcctggcacattataggcatttgttactggtagtgtgatatattattagctatttttacaactggggtatttcaaaggttcatttgcaagttcagttggaaggatgaaaactgtcattctttttttctctatggagaaaattttccaagtctttatttgattcctaggaaagcgcagggcagcctatttaactctctctctgtaaggaaccctttatactgatgccctaggctgaattccagcacctgagagaagccatgagaacaaaagtgaaaaggacaaaaaagttttctgtcttttatttcagcttaaacagtttatcaggtttttttaagattataaaaaatgtacattaaaaaacactgaaaattccagtataatataaaagaatctgtgattctgtcattctacattattgcagtgttttttgtggtgttagtttttaacaagatgggaatcatgcagcacgtcctatttatttagagcttttctcttatcaagatatcagtagcattcttggacattatgatgtttaatgactacattatataccatattaggaataaaccatatttgctttagctagcctgctactatgggaaatatgggtagcagtgaatttttgctattgtaaataatggtgtcaagaactaccttcaccataaatcttggctacagctctgttactattttagaaataattcttcagaataaaattcacaggaaatgaggtatgacattcttgggatttttgatacttactggtgtattgccttccagaaagaatgtgcaaatttaggctgccacgaacaacatataaaattgactgtttccctctattctcattgagattgagcataatcagtttttatcctttattagtctgggagatggcaaataatacccaacatgtctttaaagttcagaaattgtatgtttgtcctcatctgtttctggaacccaaatcccatcttttaggcctcagcccctatatcatgggggtgcttagtgccccatattggccctcaatatcctgctcgtctctcctaagataatttttttcccccatcaagacattctcggcctaaaaggtgttgctttcctgttctcctcattggacacgtctattctttcaaagccatttatctcaaggaagtttgggaaaaaagcaatctcataaggtgatttctccctaacttgtgaataattaatagcacttccacttttacctttaagagagtatttttaataacaatacctcagagagtctctagggatgttattttggatctgttaacagaatgaagtgaaaacgaggaccaggtgaaagtggagatttttagctggggatgtaccacttcacttgccttgaaacccatgcctgggcagctctcctgggcgggtcccaatttcccagcttctttcctttctcttctgacacctccaatgacatggctcctgaccctggctgcaaacagaatccaagggacctttgaaccttccaagtcctgggataatccccagaaatctgacttaattaacctggagtgagccccaggttctgtattttcaaaagctccccaggcaatacctgcattgagaactattgttctaataattttcctccacagagctaaacttttcacccaggctcccactgcaggcattggggaacatgtaggaaaagaccaaattaaagaaagggcagaccaaaaaataaaaagaaaaaaagaaaaccaccaaccaagcaaaccctcattatgtgaaaacttgaaagagagacatagatggcgatgtggggagaggacaggacccacaatcacaacagatgatcctacagactcccattgagcagacctctcccctcaggccagtgccatctgtaacatgaatacatgatagatacctaattcgaggggacactcactgtggcctctataaatacattcttctctactgtatcactgatgcctagcagggtgcttggcctttagggagtatttagaacttttattctgaactagttactaactcccttccagtctagagtttacctgcaaatgcagtcccatatgttatgcagatgtattcaaatgagtatgcaagtgaaagtttttaaaaaggacttacaattgactgtgctccccaaatacccctgaaagaagtcaaatgttcaccaagacacacctgacagattctctgtctcattagcagaatccctgtggccaggacacaaaccctggtcttgtctgaggacaactgcctttgggaggaagtggggccaccaggctgagaagcctctgggttctcttcttcaccccaagcagatgttcaggattgcagtgatctggcttgagagatctggctgaaaacacatcaggtgtcctacatctgggatgctctgagcagatgggtcacagctgcccaggtgcaaatacagctgggctccaagcctggtgcttgtttctcccagggcagcctctccagccaactgggagctcaggggtaccggctcttcacttgccactctgacggtctggcacacctctgtggtgatcctcagtgttttcttcccagctggctgctttggggctgctctggtaggctctaccaaggcaggtctattttacctgcagaaatagctctgaatccatcacttactttgcattttcactgctgctacttttggtgagatcctctcattccgcctcctggggactctgcaagcagtaggacctgtgagttctgcctctagccttgaccccttccagctgctatcattggctcttgtgctggctgattctttgaataaacacctcccaccctgatattaccatcctagagagccctcatggagtcccatgttctaaagctgtaattttcatctctggctgcacattagaaccacccaaggagcttttgaaaaaatgcggatgcctggggcccatgcccagagatgctgatggaattggtttgggaaaagtgctcttcagaataatttgtcaaaggatattgtttaaagtcctcctggtatgtgagacctctgggtgattggatcctctttctagctgccttcatattgtcatctcctgcttctcagtccagacctttgtttctttatacaggctctctgtctcctggaacccttgctccaagaattacaaactcttgctcactttccacgactccccttaactgtcatccacttcaatgaaacattcttgggatcctcacatggagttagttaggctttctttcttctctgctcacatattgctgttccacccagaattgcaagaggtggtgttgtttgcttacttctctgtctaccccactagcctgaactcaaaagacgttattttaatcctccttgcatatgtctctgccttttaacaatggactaccctagggtagagatcatgtgatgttaatatccataccctctaatgacaaagaccatctcgtatttgcagctctgttcattttttaagctaatatgactgcccacatatgattgaaatgaactattctgcatacactgctggactaactggcgtaattctcacaatggcctgttaagtacaaacattgtcctctttgcaagcgaggaaactgacacaatgagaggaaagacaactcaacatgtaacagggcacaataaatgactatttacaatttagaattgtgtggctgtgtgctcttgccacagaaagtctttgtgaccaatcagttaatatgactttattttctcagcaagcactttacaccaccaggacacagtcttaatagatgataaactctttaaaggaaatagttgaaacctcatgactagttcccaaaacagttttttcagtaaggtaggtcagcagcacagggtacagcaaagacagctggagcaatggaataggagagaaaagaaccttacaaaagcacccacctttctcccagtgcctttagagagtgtcgtgcctcatttcatttgatccctttaacaataataaggaataggaatcataatatttacagatgataaaatcagagcttaatgaaagtgagtaactttgacaatgtctcctaattagtatgaaaaacgctgcaattggattatatgttacctctctccaacaggaggctgcctctgcctggcacatcattggaatctagctttcctcatctactttaaaaatagcttactttttcctaaaattgtaggaaagtatgagaaaaccaaaattgctcttaactctaccactcagttaaaattgctggtaatattttgagttcgtttatttttgttttttttttttcctctgcgtttatacaacaatagatcagaatacgtgacataactttggttgtggtgtgtacaacattttgtatttttcccttttgttttaaaacaaaacatatcagaagtagttcagccgtcttttttaaaaaagagattagaatgaagtggcaagaagaggaagaacaatgctttttatgaatcttccaagggcttgtatccagccgagtgaggagtgggtttgctctgagaatggcatggacggcagcaggctgggaaatgagccccctctctctaagtcttctggacccatcatctctatgcttactctcttgtttctcttgcaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggaggtaaattctccagtctttaagagggaaaattaagaagggagggaaatttaagtgggcaattatttcactatgatggttctggtttggtcaattagacaattctcccaacacacaaacacacacacacatgcacatacacacacaccctcaatctcaaaatagtgagaagcaaaatctctcacagctgtgtgcaaatataaattatctaggtcagtgctgaggaagaaaagaactttagctacaagagctggtgttatataacacatccaaaggagatttttgtagccatgccaagccctgtaatcacatgggaaaggagaaactcagctgaaaacttggagaaagtgtatcaagagtcagcagtacctgcaagaggcaaaattcaggtggaaaggcacaatcagcatgcttagcacccaggcccttcctctgccactttcctctcttagtctcctgtcccctccttccccacatccctagaggccatgctcgcagaaatccaggaatgaggaggaattaggaggcccatgaatttgtaactccaggtgtagaagccagttcagattattcacattctgccttctctgatgttaagtgagtcctgggaacctttccaatgacaaaaacacaagggcaagctgatggtgaagaaaaacataattaggcatctactgattttttataaatgcatatctatatatatgtatttagtctttcaaaagtatttttcattaaaaattaatatctaatttcatagttgtttgtattatagaaacagtctctgaaaaggatttaacctcaatagctgtctgaccttgagaaagatacttatagtccctaaacttcctaatctgaaacacggggaaataagctcacctccagaatttctggaaaagttaagtacgaccaaggtgtaagcatatggcagagtgtgccacatggcaggggatggggaaactggctccagctcctatagatataagtcagggtctggtctacagtttccttatttttttcctattagtaaattgaagagaagtattgtataaaattatgcatagtctcttaaatagaatttacagatcacttctctcataccaatggaatgtggttaaagctttaaaatgcaaaagggattttgcacatgtgcagtgtacatatcgaggtctcctaggagggaagcaatatctctgtggcttgattttagggtgaggaagggcctgtgacctttacctcaaatgtcctccacctgtgcatggataacaaattcctttagggagggaatacacgtccagtctctgcaaaagtttttatgacttaacctcatttaattcatgcagaaaccttgtgcagtaggtaatatccccacttaatagataataagactggtgtttgctgagatgaaagaatttgtgcaaggccatagagctcatgaattcaattccagatctgtgttcccacagcccaccagtgaaaacagagattggaacaaatgtattataatgatcgtagaacaagggtgttggggtccgaaaagataacctcacagaccgaataattttgcatcttatgcaatatttcagcatcagaggaaaaaacgctatcttgcatttattcttgagggaaatgtttgtaaataattctgatacaataagcatccaacatgcctcagagacaaaatggctctcctccctcagttgaagaagcgttcttagaggcaagttttaagggaccctgggtttagaaggtgaagatgtatcagtgatttgaacagtgtttaaacaaatgccccacgcgtagactgtaaacttaaggaaggtgaaaaatgagtttcagtaataatagtcaacttacataaattctctctacagcttcaattagaagttgtagcatctctcttcattttacagtgtgcctgtgagctgttaaccagctgctgggcttcagcccagcagtgactgtctattagagacggctgaaataattcccagttatttatgggttattaccatggtttcaagcttgcattcccatatgctctgaacctattaaagccattgggatggagttcgtatggagcacaagcactcatatacctgcaaggctctatacctgtcttaatgagaagtagatatgccctggttgcaagctacactaaatcagtgtaattttttaagaacactctttaaaaaggtatagtattaacctttcccatatgctattacagccctaaaatgacatgcatttaaacccttagttccttctaaaaccagcaaaacatctgattttgctttgcacatcacgtcaaaattccagttacgctcctgtgtgtacctttctcaggaactaagcctgttaatgctaacaattaaccagacaattactctgctgccatccttacccagagcgtaattttctttgaaagtgtaattcagaattgaatcgtgcatttagatatgtgtttcaagacagaaccaaaattctgaagcagctataatacatttcttccttgggatgagtgaaggatgccatataaaagaatagcaaatagtttaccaatggaaaaacaaagtaagaaggagacacatgttacagtattggtattccctttgccacgctttttattttctctacagtgatggagtataccctattttgtaccaattctgtcccctccctgagaatgctaggatttataatgaaaagggtgtgcactgctgtgaatgagaaagcaccaaactaattagacctcaaggtcttccatcaataggtcgccaaagcaatgacggatcatttcagcattcttcttcatcttttttctctgtcccacagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtaattattgtctcttctcctctgttctgccacccccttcccattcttactgttctaaatatgagtttctttaagcaaaattctaatccaccgacattagccacattagacataattgagttgcctaatggaaaatatttctgaaaggatttcaggcccagagaaaaaatggtttaaattagttgagtctctcttcatgttgacttgcagtaaatgggatatgcaaattaaatcaaaatacaaatttgtgaaaggattaaaattttatgcataaacaacatttgattactttgaagttaaagcaaaaaggaggaaggaattacttctctcctaaaccatttcatttttcactgctgtgggtgtcctttctaacacaggcagatgagcattggaccatctgggaagtctgcagcagaggttcccgaaatgcccaataacacacaactactcctgggtttggctggtttttgctcttactgcccctaccactgcttctctggcccagagatcagaaaaactcactttatctctcaatttcccctgggatctggctcttcttatattagaagtttctaaatgcaaagacacactgcagaaaaccaaagaggatggattctgaatttgcatcaaggtttaccatgttcttcttctttcctctccagagcctacctccttcattcttccagttctgctcacccttgtcaaaatatcgtttatagaatgggtgaataatatctgttcagtgcttgcctatgtgttgatgataaagggtctctgcttatgtttcatctgggaataaattagcaataaagttacaataaagttagataaatgaccaagaaatgcacccttatttgtcagacacatggcagcagcaacttagtctgaccctgagaatgagtcgaagaaggtttcagaaggtgatgctgagttgaatcttaaagcagaagacactggcaggctaggccaatgttgagaggggaagggagattggcatagaagcaggagaaagcatggattgcaagtatttcatcaattcaaaatacttttttggcatttgaaggcatttgaaatctctaatagttgaattggcaatatctatttttcatagtggcatataaaataattgtatatcttacaattaatggtgtcttagattcaataatatatagctcagtagggatggtaggccactgtggattgtgaacctggtgtgaataagtccagagatgtggggcaggaccagtcatgaaggactttgtgtaccagtgggatttggtttcatgctcttggtgagaaccacagaggaaggtggctagcttttcctgttagaaagagtactcaagaagaagtgagaaaggtggattggaagagagctggcccacaactaggcaggtgactgccccagttcaggagaggaataatgagtagtagcaggtgcctctactgaggggcacagaaatcagccatgcagtgcatagtctctgctaacgctagaatgagctgcgtaacttggtgaaaatttacacacatttctccattaatatcactatgcatgggatcatcaacaaatcatgcagattttctggctcttctgctttgttttttttttttttctatttgaccagctgaaaaagtagtaataaaatatgtgcttcattaaaatgtgctagtttagagctcggagaataaaagttattgcaggcgatggttggcaactattggctagaccaatagtctttagtaatggcgagggagaagcatcctacttcatcagccagtgcagcctcttccaaagtgttgatcaatacagggaacatttatcaacaggggtctcttatgctaccttaatttttaatcaagcaagctctcattatttttgattgcatgaaagtcattgccatgtactctgcatcattagttttgtgtaattgtagtcttgtataattgtattacatacaattgtgctttcattaattgtataataagggattgtgtttagtttcgtgagtaagtggtaagtttttcttgatttaccaggcactgtgtctaacagaagggaaagctggggcaagggactgtgtttgagtcactatttcttaaactcataattaatgttatctgaagagaggcaggagttagaagggcaggtgttttctgaatttggtgtttcatttttaatgtgttaatcaacgtgagctggatttcaggttaattgcaaactctttgccttcaaggagcttgctacttgctgggagaaaggaagggaataggctggcagtggttttccttacctggactgctgtctggaaagcccacagaggacaatctgagaatctcttcttactctgagaccccttgccagtccgttgttgcaggctgtagagaaccaggcctccatttgcctctttgtggttgtcctaccccttctttttctctctcaaagtgaagtgggatcccgccctgccagcttttgttttttgctggccccaaccgggcatcttacatacttaaacggtattagtgctagtcacgtgggaaaatcagatataagacatctaaagtagaattctggccgggcacggttgctcacgtctgcaattccagtactttaggaggccaaggaaggcagattaactgaagccagaagttcgagatcagcctggccaatatggtaatatcctgtctttactaaaaataaaaactagccaggtgtggtgacacatgtctgtaatctcagctacttgggaggctgagacagaagaatcccttgaacccaggagatggaggttgcaatgagccgagatggcacctctacactccagcctgggcgacagagcaagactccgtctaaaaataaataaatacataaataaataataaagtaataaagtagcattcctacctgaggcacaaatgttccaaaatctcaagagctccctccggtggaggtcctttaagcaacttccttttgaggtggtgcctaagaccctgacacctgcttcccagtttgcactatttacaaaccacctttgatacttcatcctgagcaaaagctaaaagggtctcttctcagggattaagaaactttaaccaatgtgcatctcagggatgggcaaattaccaaatcttctggctcctgggaggaaaggacttggaagaactggccttgcgcacggctctggaagcaggaaggtgttggtactgggcagctccagtgcctggcagtccatgggcaggatgggagaaggaagcagtaggaattagaataaggcattcctgacacacactgtgccctgttcacggtccttctaaacctctaggacacagtgtgcagctgctgcccctcttctgcaggccaaaccaccagcctcataatctctacaccctaagcccctgtccttcataataaccatctttccagcctctttgacttgaagtaggcaaaacacaatagtctaagccagcggtccccaacctttttggcattcagggactgggggcttggggagatggtttcaggatgattcaagcacacatttattgtgcacttgatttctattattattacattgtaatatataataattatgtgactcaccataatgcaaagtcagtgggagccgtgagcttgttttcctgcaactagatggtctcatctgagggtgatcgaagacagtgacagatcatcaggcattagattctcataaggagtgtgcaacctggatccctcacatgcacagttcacaatagggtttatatgcctgtgagaatctaatgctgaagttgatctgataagaggaggagcttaggcagtaatgtgagtgacgaggagtgtctgtaagtacagacgaagctttgcttgctcacctgacactcacctcctgctgttggtcccagttcctaagaagccacggaccagcactggttctggtttgtggcccagggtttgaggacccctggtctaagctatcacaaagaaaagtcactttcaataaggctttattcagtgaacagctgttgatacaccctctgtagttctgactcataggtaggcactgagagagtgagactgacttacatctatccctgagtaggatatgatgctgtaaaagctctagaagctctaggagtccagaggcactaatatccccaccttctaaaaggggaaagctaagacctggagacgtatgtcagtgttctcaaggtcccatagggctgaagttatgatcaagagtcaagcactgtgtgtattctctccttggtactatctagcaaggaggcactgatctggaaaaggcagtcactctgtgtcagtggctctaaatgtgtaaccccattttccaattgtcgacctaaaaggaaaaagctgatgcaaaattaatataagtagagagttcatttgggccgagcttgcttgaggcaatccaggagcacagattcaagttgccctgaacagacactcagtttagcagccattgcaactgggtttctaaaggcaaatgggaggacaaggagtgaactgatataaagttctgccaggaattctcaatggtttacagtttacagatttgattagtgattggctatgtattgttaagctgtagggtgtgggttctagtgtgtccagtgtagcattattaggttaataacaagcagttccaagaggtgagtacacagctcaaagtgggggagtagagtatgactggggtgtcattttaatgttttattggcctgataagtaaaaggacttgcattcctcacataaaagtttttttcttttctcatgctcaaccagattgaatttttaagaatatgcaatatgtcagattctttgtaacatttatgtgcctgatgtaattccatctatgaggggacattcagagtggcatgcaatgtctagcagggtctgagtggagtaaggtgagccaggttcaaagagtctctgccccgcatccatgtagatgattcccagtcaattccaggagccatgtccagtcctgtgaggttcaagatccaggacaggagagacagattagcaaatgctgtccaagagtatcaacaggagacaggctccaaggtgtgaagccaaaccaggagggaaaaacagggatgctgatgaggaaggtgtctgaggtggggagaagcagaggccatacctgggaaaaatccagaatcccagtgcaagtggcagcagctttcagaagcagcaggacacatttaaatccaccccgcccacagtctgagatgtgacacacattatttaaacttttgtccatgttttcccttttgcaaaatcaggatcacaaaacctacctttgtgctaagagttgaatgagagagtgcgagaaaaatgagagtgtgcgagaagtcaggtgttcaattgcatgactggaatgcggtagatgctcagtaaatgttcactgtgttaattcctctggccaaaggtttgccggttctctagtttccatggggagagaagaggcttaagtgccccgccaccctttccccaacccccactgttgcaagtgatccttagtagtttctggggtgattcccatgtgaatatttcacatttgtcccccctcccaaatcagtctgctttgtgaccccccttggactttggtcccactttttcagaagacctgccatggcccattaggaaagcactcataaatttaggtgccaaggttatggtcttcagattttcctaaagcattagtctcaagatcaggactagaatgagcctagagagtaaaatttaaggagacccctacttctagggccatgcatgcatggagatcctgcatttgcagaaacctgagagtgagggtctctttaaatcttataggcaaattggagcattttaacatcagaatcaccagaagtgcttgttaaaacacaaattactgggggtggagcctggaaatttgcatttctaagaaattcgtgtgtgatgctgctgctactgggctggcctggtggccgtactctgagaacaatgctgtaaagcttctgctcctggaggacgtggaattgtgtggaatctgcaaagctgatgtgggtgtggaggagagggatggttcctgcccccacctagggcctcaagcagctactcttctggccagagtctctctgaaaagtttttgcagctccctcaaagtcccaaagtccctttctccaaagaggtgttgaaatcagcccaaggggtgctgcaggaggccactgagtttcttctgcctctgagctttcctgatcttcctctctcagctcctcccctgcttcccactacaaacaaagccttcatgaataacaaggaaaatgatcagatcctctggcacgcctcagtgaggagtatttcggctggaggaaagtgtggttctagaacagctacagctgctgacaagcataactgtttgttgtgaggtacccctgaacgtcacagcttgatctttccttctaaaatacttcacagcctgcgggtggtggtggtgcctatataataggagtgactccacctctccccagtattgcttaaaaaactttataaagattgatggacacttttgcagcaacatgaatggtacttaagtgaaacaagtgagatacaaggagataaatattgaatgttttcacttataagtgggagctagataacatggacatacagacttagagagtgtggaatgataggccatggaaaagtgagggagttggactggggtggataatgagaaattacttaatgggtttgttttggataggggtcctgatccaaacctccagagagagttcttggatctcgcgcaataaaaaatttggagtgactccatggagtaaagtgaaagcaagtttattaagaaagtaaaggaatagaaaaatggctactccacaggcagagcagtgacatgggctgctttactgagtatgctcatagttatttcttgattatatgctaaacaagaggtagattattcatgagtttttcaggaaagggacagacaattccaagaactgagggttcttgccctttttagaccatataaggtaacttccagatgttgccatggcatttataaactgccatgtaaactctatcaccactgtattttctcccacacacattcatttaagaaattcgggtgtggtggctcacgcctgtagtcccagcattttgggaggccaaggcaggtggatcacgaggtcaggacatggagaccatcttggtcaacatggcgaaaccccgtctctactgaaatacaaaaaaaacaaaaaatgtaatgaacaatgaggatgagcagagatcactttcatcttgacttggtgggttttggtcggcttctttactggatcctgttttatcagcagggtctttatgacttgtatcttgtgacaccagtcctgttgacttcctatctcatcctgtgactaagaatgcctaatctcttgggaatgcagttcaatatgtctcagccttattttacctagcccctattcaagacagtcactctggttcaaaagcctctgacaggttcagtgtacgttgttctggtgatggatatcctaaaagacttaacttgaccactaagcaatctatgcatatagcaaaattacaattgaacctcacaatctatacatataaaaaaatgattagacagacactgatttcatatggccttctggtgaccaccgggcccattccttcatcatttcctcatacagtgatgctaccggggaagatccgaggagatcccccagctctggttgtgcacaggaggaaatggaggccacacagagggaggcaaagtcagatatggaagcagggtgctgttcctgcggtctttgcctttgcatcctatggagacttttcgctgtaatcctttctacaattaaaccatttactttttccaaagaggagatcccatgtggagcaccacattacatttcttgtggcaaacaagttatgaaatgtagcttctccctccatcaccactgtattttctcccacacacattcatttaagaaagccaggtgtggtggctcacgcctgtaatcccagcactttgggaggccaagaagggcggatcacaaggtcaggacatcgagaccatcctggccaacatggtgaaaccccgtctctactgaaatacaaaaaaaaaaaaaaaaaaaaattagctgggtgtggttctgcaggcctgtaatcccagctactctggaggctgaggcatgagaatcgcttgaacccaggaagcagaggttgcagtgagccgagatcgcgccactgcactccagagtgcagacagagcaagactccttctcaaaaacaaaaaaaataagaaagaaaagaaaaaagaaaaagaaagtgtctactgaactctctggtcaaaattcttaccttgttggttcagggtttggagtacagtaaacactgaaagttggcaagcattatgttggattacctcccataaacagactcttgctaaaaacccaccctgtgtgtgggagcttgttaaaaacagtgggtaatataaaaagattacattgcgcggtaatacatatgttttagttcttctctaaaattgaaagcctttacattgggcgccagaaaagccattggaagggcagtgcccacacaatctgagcttctaactctgaagtgagaaatgttacaatatgctgttctcccttaactcatgggatggggccaaaatcaaaacaagatcatttctgctttactatttatcatttgtggtctatttcacagaggggaaaaaaagttatattttatgtaacacttactgagcaaacattcctaaatgttatttcgttttattctctccatagtctgcaaggcctaccaagtgggttctcaaagtatggcccccaggactgcagcatcggtgtcacctggcaacttgttagaaatgcaagtctcagacagcaacccaattctactagatcagaaatgtgggttgggggccggggcatctgtgttttaatcatcctccaggtgactaggatgcacactcaaatttgagaaccaccacgttgttcggtgatcgccgttttctacataagacaaccaattcttagagaggttcagtgactgccaaggtcatatcttagtatttggaaaagccgggattcgaattcaggtttttctgattcctcagtatatataaataaggaaagcctgttaccaaaaggccagagaaagaggagacatgggcttgggtagccagagcgggccagggagggggctacagaggaagcagcacttcctgaggaacttgaagagcaggttggatttacgggggtcaaggaggggtgctccaagggctctcatgtggagagtgtaaagctggggttgggaagggctgcagtgctgaatgtttgcccatattggaagggctgtcttggcagcagtggatgcaagagaactgaaatcagaaccggagtaaacttgccagtgcacaaaacagtttaaaacttgagagaccagacacattaatagtgaatctttaaataatggttactgtgggccagggcagtgtgacaatgtgtggtgtgtgtgtgtgtgtgagagagagagagagaaagagagagagagacagagagactaatcttcaccacaatgttgtgaggttaatattattaactccattttacacacaataaattggaggcacagaggtactaagtaatttgcccaaggtcacacagcctatatgtggtagagcctggctgcaactcatggagtctattgggagagattaggcctgtcctggcactgtggtacttctaaccctgctgtgggaaggtgccccacattcttcggcaggattgtgaagtggaaaatgatgcatttttgtcttgcattaaaatcacaaaggtggttgtattaaagcaggaagagaagggctgtggaacacctcggtgcctcacgggttatcatccctatcctcgcagctcactgtcactatctcctaaagaacacactgagatagacgcagaacgagctcagggctcccatgagacactgggcttgatctaattctttgagctgactggggaatagaagaaactgggaacttgccaggaatgactgtcttgagaagacaggcttcaagctgactttgtaaaggtgttccatctggaactgcccagaaaaaggactgattcatttctctacttctttaatgagggtttccttcccccatctatctcacacctgcttgaatctcagaaaagaagaaggttttggagaaagggggaacctggatttgattagaaataagcgaccttgaacaagtgcatctgtgtcctcttacaaacctcatctctatcatcacttgtttttacaagaaaagtggatcattatcttgatgaaatggtccttctccacctgtgcatatggacgggcacaaaagagcctttattcatggaaaacacggagggctgagcaagccaggttggcacttcattttggcccaccagacggtggtgagaatccttccccaccaactggtaatctgacatattgatgctgaaaacgaagccagaaccatgagccaggtgaattatcacaagcacttccaaagacgaggagttcatttcaagtgctgtatttttgcgattgaggtacgacatgcatgtcaacgtatcaggaagaaaatgtctacaaagtccccagggctctggatcatatctgtcctgagatatactggcttagaaattcagatgttttaggccaggcgcagtggctcatgcctgtaatcccagcactttgggaaacccagtttggtggagaccaggagtttgagaccagcctgtccaacacagcaaaactccatctctactaaaatacaaaaattatccaggcatggtggcgcacgcctataatcccagctgatggggaggctgaggcatgagaatcgtttgaacccaggatgtagaggatgcagtgagcaaagatcatgccactgcactccagcctgggtgacacagtgtgtgagactctgtcagaaagaaagagagagagaaagagagactctgtcagaaaagaaagaaagaaggaaagaaagaaagaaagagagaaagaaagaaaagaaagaaagaaagaaggaaggaaagaaagaaaggaaggaagaaagaaaggaagaaaggaaaaatgaaagaataagaaagaaaggaaaaagaaggaaggaaagaaagaaaggaaggaagaaaggaagaaagaaagaaagaaatttagatgttttagatggcagagtagcagaggagactttttatctagatagaaatgtgagaaaaaggtttagattctcaagccacttatgtgaagcagagaacattcataaattaatgaaaagaataaagagattccttggtattgattcctttacatgatcgatatctcaataagccttcatccaacatcccgataagagccttccatctgtttctcatgttctctaaagagcactgccttctgcacagccaatgtcacattaattttttcctcatttacattgatgtccactcatggggcccttgaggcgaagcacctgaagcctttgaatgctgtttttccctggtccaaaagcattcatcgatggcccattataagcaccatttatagacacagttggaagagagaaggagtataatatgttttcagttgggaaaaaggcaggtctgacctgcagtaaaaggttctcacctgtgtctgcagtgaaatgtaaatttaaaattagctctatgctacttacattttgaattaagatatttcataggaagttcatagaattccaattaggccttgtgggtttgattgtgacatggatttctgaaggctgaactgatacttctgcatctgtatcataggcatgggcagcgtcatagatgccatccactttaacacttaaaatgcccaaaggaagcatcagtctccctggttgtcaactgagaaaatcgatattcacataaatttattaacttgcctcaaattggaatcagactcagaattttaaggtgggaaagcctgtgctgttcatattttagcccaatcttggacacaatgaatatgtcacttctttgtatcttagctcccctagttgtcaaatgtagataacatgttataactgcaaggtgttaaacaaaagcaaggcgatattattcccgcctgcctcttggaattttggcaaggattgactgagatcggaaagaaaagttcttaaagttaaaagcgagagagacagaaatggatggggttctgtgtatatcagcaggccaggttttagaaaacccatacataggcagaaaacgatgacatttctctgaataatttacctacatatataacctattttattttttagacaagtgattaatgttttcacttgattcaagttacaaatatgaaatcttccctctaggtttagcttcatcttaaaaatatctcttggacatgatttactaagcccactgcagggctcttctctcctaatcctgggagtactgtagacatagcagtagatatctcaacacctgagaaatgcaaagggaacacacagagctaaaacagagagttaattgggagaatgcagattaagttggattttatgtcttgccaaattttagtctctaaactcgtgtgaggtctagtacatccagaacaccgttaactttattatgacaaaatgttagaatcaccttgctacctgcttttacctatgctgaaaagtataactgtgactgtaataattaggtagggggctatccctgctttggatatggaaatcttctcagatgtggttcccaagtaactctaggtttataggtttgatcaaatcattgtattgagaattgtaaaaccctatactctgaaatgagaatcatttgtatcaacattagcatttgtgtatgtacatagctgtgtatgtgttcacatgcaatatgatattagcctgtgaattctgatgcacacttctaggtcctactaactgagagactgcctgtgctctgctaatattcctctgtgacctagtcattcatttatgaacatttccttgcatgcttactctgtaccaggcacatttctttgcctgaacatccaaaagtgagcaagacagagagtttttgatcttagagtcatgtcattgattttccctgctctgatcttccttggatcaggaatctgcttttttttagtattatgaatcattcattcattcattcattcattctttcatctcttgtgtttggaacctttctgctgtgccaggtgctgggtagaagctgaggatatacttgagtgccgaccacagtagacaatctctaacttcagaaagctccatggaaggacacacatttgaaccaaataatcatggaaataaacatatatgctcccaaataccatgagtgtcctcatgcacataaatagagcaccaggagagaacctgagaggaaggccactttatactgcagagggggcagtgtgccaggaaaggggatgtggacattgttatcttcaggctctacaaaagcatccgtacagaggtcgctgcaaacttttctcagtcagtttcttagagctttgtcctctccatggctttctaagaacctctggctgatgactgtgatctccatgttctgtgtgtgtcctctgctgaaatccctgtttggtgtggagacttagaggataagaagtacaaaattccgatttttttttttttttttggtgagaagaaattttttcactggtgttttagctgaaaacaaattccccacattttcccaaaacatgtatgtgctgggaattcctgtctgccattaataccactttcttactctcctcccaccacctcccatcccttccctggctgccatggttaaagggtcaggcttctagtaattcaattctaatagtatataggctacacccctacacttagaaaaatatgagaaaaagtcagcctactcaaaataaacaccagtgtaaaggtgggactgatatttcagctagcaatttggtaaatcccaagaatctgaaagtgacaaaaggaatatgcattttaaaggtcattccaattaccatgcttactcatgttgagctgaaactctggagtttatgtgagaagacccacgcactagggggataaatgagaacatgtggttgggagaaactcgaacaaataataaggaagggaatacaaatcactgttgttttctgtgatattaaataattcttcaacctcagaggcatctgagaagtagaggaaagccaactatcgataaatagctgggcaaatcctcacaactctaagagcccaggattccatgatggatttacttctgatctacattttgcacacttatatgaggatccagaagaagaggtctcaagggtgaactcttgtctgcattaaaatgtctatttgcaaccactgcattctccatgtcatagtggattcccaactcaatttttctcaatagaattatcctaaatgtagatatacctttcctgcttttgaaataggaaaacaaaatagccaagaattattcctttagacagggtttgcctcatatatctctcccacctccccaaatgcatacgttattgcaactgtagctattctaaccatcagattctgtatgtgcatttcacatgacctccagcacatgatggagcctgaggcattaaacacacgaatccaagtcctcctgcttgacttttgcagtcttctggcctcacctgttcctccctatctatttttacctcctactatatgatgaataattcatcattccatctgtgtgcatttactgagcatctagtatgttccaggacatatatacatagtttctgccttaaagaagctcaagagcaagagagctagataagaaacctgaaagcagacatcttacaaagggaagttaatggcactgagggccatgaagttatgtcccagctgcattttaacaggagagaagtaaggaaaatgggagtgtgatgggattccagaagtgcaccactgcctgccacaaagcagccagctgccttccagcctccaggcacttgctgctatttctcttgtctggagctcccttcccagtttcttttgcccaaatccagcccatctgtcaaagtctagttcaaatcctacctactctacgaagtcttcttgactgctcacactcttctttgcttatttgggtgtctctggcactttcttcttatattttgtttagctcccaaccatagtcatgactggttttctatttgtatcttgcccatccaaagttcatcacgtctactgatgcattcagctgagacacgtgccctgtgattatttacttaatgatttgaaccttttgagctttaacagcatctgctctcagtagctgggggataaactgcatatgaagctaacaaaactcaacacgactcttggttttgggcaagtattgcctcaagatatggaatgaacttgataatctttaatgtcattgtatacccaaaactctggaggttgctatccgagatttaggagttaaagcctttcacttcttttctcatcttgaaaacttcccaatgtggttcacgccaaatactgctctatttgaatagcaagagtgcctaataaaagcaacgccagagccagctgtcatcattcacgtggtgttaagtgctccttctgtaagcactagctagcaagagtatttttgtttagcaaggccatcacaaaattagacaagcaaaccatagcaatgtatttgagcaatgtagtctataaataacacagtggaaggaagcataggagcacattatccatattacaatcttgtgccttaaaaaaaaaaataggttagctctgtaatagaaggcagctccagagaaatagacaaaatgtctttggtgattgttaaaggatgtaagcagcctcctggtaataagatctgctgagtgtaccctgtggattctgtgcgcccctaagcaactcctacaggctgagtagtgaacgcttgtaaagttggcgttgtttacctagcaggaatggaacaaaaaattttcgtggaaggatgctgatgtgtctgtaaccatgtcggctgtttatctgaaagtgaagttattgaagaagaaaggtttcacattagcccagaaagcagcattcgaatcagatacggtccatacactgccactgttttttagatttatttatttttttctttctttttcagaagtgcctggcagaaacttaaacaacattgttattcatttggctttgtcaaactctgtagcatcgtcaaatgtagagagttgcttccaacttttgccaaatgccatctaaagcctcttcatttaataaaaaggaatatagaagatatatattttttctcctttgatgttttaccgtacttgtttctacagtggattctaactagaatcacctaggtttactaaaatgcaacaattggaccagatgctagctagtttttttttcctgctaattttcttgttcaaatccatagagaactataataaaatatcttaaaatgaactatgctcattttaccaagaaggacactgaggttcacaggtatgaaattactttcccaagattacagagttggcaagtatcttccacccccaaaaaacttagaagttaaaaaaaagtgccctttgaaagttaaactaaccatctaacaggtcttaagggatcatcttggagatacaagagagtatccatgcaaggctagttagtgcttggactaaggctaatgtttctaaagaaaaaaaatgtgtcaaataaaagtaggttggtaagaagatgagttataaataaggaaaatcaaatagataaagctaattttagctaaagaactaaattaagacttcctaacatcagatatgtaaagaaagaagcccattctgtgttgcaacatcaatggggaataatagaaataacaattgtacactcccatagttcttaatcctcttctcagactgagttggaatatccccccttataactgataaagcttacaggaatgtaatataattattgcttcagtgaatcaaatattacttgtctagaccagcactgtgcaatggaacactgtgtggtgatagaaatgatcttctctatgctgtcttaacatcttgttactattggtaatagagaactcaaaatgtgtgatacatttagatttaagtaccacatgtggctagtgactaccatattggatagggcagggttagacactctgctagggccagtacttgtggattttacatttttcttatccataagttcagcagcggactgcaccagaggttaagtataaagattgggtttgggccttcaaattcagatctggtgtggtagatttaatgtcagccttagcagcccaggctggatatggtcatggtcactatctgtcatggagccccttctcccaaagacaattacatcaggagacaagggcttatcactatttgacttaatttctcccaacatccttgcaaagaagtgatttaacgattactagatcaaaatgtcaaaaactttatattacttaagaagacaagtttactatatcaagtgttcttttgctatttctgttacccagttcaaagttcctttctaaattagaattcatgttaaaaaaacacacattgtaatctaaacataatccatttagtaaggtttggtttctaatttttttctaaaataagagagtcttcacttttaaaatctccaatagcatactatatgttgaagttattgacagaactcccaaaaccacctgctcaaatctgagtaattcagagtaagaggtactctgcttggtcaacaaaacatgtgagttcgttttctagggtgggtttagattaatgcctatcgcaaagtagaggcatgaaacccccaagttctgtgactattcttgtcctgatttcaagcttaattcacagccctcaaacatttggaaaacctaagaagctaacctaaaggaagaaaagatattgatcagtctggtggaaatattggtccctttgaaaatcataacatttaacatatatttattaattgggattctagtatcacatactagtctcttgtcagtttgcttgcatgagtcattatcgtggtgactgtggtcctgggaatctgtcaagagtgaatttcaggccttatcatgtggaaaacccagttggctttgatttcatctgagtctccgtactagcacaaatggcgtcacataaagacctataccagactacagatgttaacccaggacactcttcaaagctaaggatgggttacaaataattttaaaattcagcctcaagccaagtacagtagcacagccctccagtcctaattactgggcaggctgaggtggcaggatggcttcagctcaggagttcaagattaggctgggatacatagtaagatttcatctctaaaatataaataaataaaacattgaaagttagacctcagccctaccaactgatagcttcaaactttggaattcataaaaatccattaaaagctcttttaatgcagttgtttggaccctacaatcccagagattctgattaagtccatctggaatagaggttggaatctgcattttatccaacaccccagttggataaaagactgaccctgtggatcagtcctttagaagtactgtgtcagaagattaaataaagacatttctttattgaattcatcataatacaggctcatctaaattttttcctgcacagtggggagctatacttccagttctgcctaatgttaatggtagtctgtggaaaatgttttctttgttcaaattagcttgagaaatgctggagtaagaaaagtgtgtttctttactgcaggatttctcaatgtgtgtgtgtgtgtgtgtgcaagtgtgcatcctcatgcttataaactgtgcaaggggggaagtcactgaaagctatgcacaagtttacaaacgtatatgactatgaagcccttgtttccacaaaactactcattcacataaggagcttttggaaatgcggccctagagtgaataaatcacagtaaacaccaggaaccccttgggctgctcattgtgggcagtggggcagcaactctgggaggtagttggtagtgtagacaatgtggcttcaaaagctaccattaaagagaactcaggagtcataagcagacattagccttcactttctgcttttctctacaaaacaaacacccttaaaggtaacttcttctgcctctttttccttctagtatggaggacttgtgcttttgatttgtacaaacaaattttcagcctgcatttttagtgtctgtgattttaactgaccacttgacttgtgagcctccctttcctagagatagtgatacttgtcttacaagattgttttattgattcattgaagtaattattgtgataagctagcaccaagtccagcacgctgagtccagagtttgacacctggtagagaagttaactttattttatatgtgtaaatatttagggagaattaagcaagaaaagggagggagcagaatctctctgtctttcccctgtcaaacccactacctcccccacccccgaccaaaaccctagagatagcaaatagactgcaagttttataccagcctcaatgctagcaatggtggcatcagacagtatgcagattccctggcaggctttgggctcaatagagaaacggtgcattgaatgacagatgagtgaggtgacatcagccacaggagtagcaggagagagtaagccccgcaaggaaaaattaaaaacaaaatgaggagtgacctgagccatctaagaactgactatctgtatggcatttaattctaacttaataaaaatacagttgatgggcagttaaagactgaattttgtggtgtggattgttcattttgggaattctttcccgggatagaacttaaattgagcttagaataacaaagaggattttcatgcaaaagcgagagccagtaaaggcaggggacatgtgtattcctgtgtgaggccctttagaacccatctatgatttgatcaaggggctcctgttgtgtcagtatctggggtggctgctcgtattcatctcccatggtgtggtcctccaagagttctgtattcttgcgtaagtgcttgccttggccagggtggctggtccagccaggccaaagagagccccttgcaggggttctcatatttaagattaaagagtaaggttcttttctcatagcagaagccttaggctgcaggattcagcaattggccgccacaattcctgccacgggaggaagtggggatgagggagggtgagtgaaatcaactcacagagaaaagagatggccagggaggagccagcaacctggttgtattcaagccctgaggttcagcatttcctgaagctatgctgtgtctcttcctgctgtttagagacattcagctcttacttgcatcttcgagcccatgtctctttcatttcctaaaatggcttaaactgtgttttcaccatttccatctgaggttttcattagtataagtctttttagaccacatcttttacaatcttaagttagatgatgaagaatctaaacaagttgaaagagggggaaaaaacattaattgtggaaggaaggatttagtgttttcctctttgtttgtgttctccataatctccatgtgtaagggtcgtgacattttagctcaaattggatgcagaatctatttctagaacaggcacgatgtcaggggccaattaagttgttggccagctgtagtttgaatcattaacaacaacctgtggccaccagcagttttatggcgaggctgtgctataccactgagcgtggcttaggatctctctgccttaactgctcaagccccagatgcagatcagaactgaagtggagaggcagctgcccagttcactccatgaaaccaggtttgctgttcacaaggacaggacactgatgaaatttaaatgaacaaagatgaagtgtaacctttgttttcagctcctgtggttggcaacagagaatggaaatcccagatctgcataggcaggctgagtagtatactgagcttagcaatgtgcaaaccaaatctctctctccacgaactggaaaaaaaaacaaaacagttaaaaaaaggaaagagtgcaggaaagaaaaaaacacagtctatgactgtgtcacaaaaccatctgcaagtataagtgacaaaaataacaagagttcacagttacttacattttacaagaccttatttagcgcccacaaggattaagatattgtgctttgtcttgattttagaaacagggacactaaatctctgaaagggatcaataattgcaaatgtcacagagctagaaactggaggaactggaattaaaacttgggtctctaatctgacgcctgggctatatgactgaatcttgtcacctctgaaggaggtcacactatgcctcagctggggcacaaggggatggtctcagaccagcctttactccatcacaacagcctccatgctcagacatggtagcctctgggcacagtccctaatcctctgcttctcaaacaccagctcaattttaatttcattgcatgacctttaaagcaaaaattaaagaatcttgcaacatgtcaaaatcgatgagcatcctgggtaatccaggcactgctggtatctgttcacttcatccatgggttctagagaccacggcagccactatagcagtaagcgccaagcttggacagtggtagtctccattggaaaatgaaacctagaggagccgggataataagatccagagggagattagtggacccaattataacctgtgtcctttttggcttgcactatatgagtagttttcatttttactttaatgtggtgaaatctttttattccatcaaataaaattttagttctatccataacaaataaatacaatatttgaagattaaattagataattctagacctggtctatgaaaataattctttgatccagggggaggagtgtcaaaatttgcagtcatacattagcctcagtattcattttgtttggctgttctggtttggttgctaaatattaagaaaatcttgattcacacaaataagctgcccactgatagaagttctagataccctgttttgcaatagtagatgtttttcaataagactgatctagaagcgttcaaaagtaggtataattgctttttttcttcaaatttgagaatcgtttgcatttcttaaaaaagtaaaagccagataaatatatagtcagtgctaacacttgctatgatacgttattattttaatgtcatgttcatccattcacttgttcttgcttcattattatgcagtggaaagagcttgtagcatgcaggtgttcctgagcatggctgggtttaaggggatggggctgtggagcagcggtgccctctctgtatccacgctacctgcgtgggcctgagcagacctgataatacatgacagtgcagtgtaacatcattcccaattaaagttcacaggaatcccaggggaggtggggaaagatttccattaaagtccccagagttagcctggagctaaagactaacattgctagtgcagtgtgttaaaacctgattcatgacacatttgaaaacgataccattttaacataaaacttacaaaataattagaaatacttcacaagagagcccaaaacaaggaaaggaaagggaaaaaataaaaccccacaatttgcaacccctctgaaccatctctacagaatgactctctactgaagtgcagaactttgctattcagtgaggtctgggagccagcagttttctcattcccataagcttattataaatgcggaacctctgtatcagggtcttcattttaaccaaagtttgagaagcactgagtcaagtaatagaattatttctattcatagtggaatctgagtgatgtcctaaaattaagaagacccttacagtaatccagagagctctactgtctgtgcgtttcctgatagctccaatattccaaccgaggtatcataatcatgatgctgaacaaaagcctgtgagtgcagggaacacaaaacctgcttcctagtagatgtgaggtggactaacccaaccagatttctctcccattaaatctacagcccctctgtcaattgcgtggtggacttccattctgatggatcacttctaggtcactgagataaatgggttgattaaagaaatttaattatattctattttgtgaaaatgacccctaccaagctaatagggggttctcttcctttgtgaattttttgatatatattattttatagtttggtggtaggggacttgtttctaaagttcccaggtagcaatgtcttgctactattttcataggctcaggtggtttgtcatactaacaatattagtatgcatgatgctgatacattcttcttgattctgaatgtcctctgctttgaagaactggcctttgaagaactgagcacttcagggtcatacatttttcagtgtgcggtagagtagagagaggacctttcccttttctgttcagtggccttcactggcccgtgcagggagaggcatgtgtgccctttgtgcccggcttcttcttgaaccccagcattgttgctgggatcactgacgtgcattgcaaactcattcgatcatctttgcttgtccattatctggggatcatcgcaacaatctgcgattgactccctgctgtgaactagaccctggaaaatttaggaaactgacttttgacacttttctttttattcccttaatttcttaatgtctgcatctgctgtaattacaacaaatttaaattataatggagatccaactgtgggggtaaaatgggattatgataattgttagaatggaaagacatagaaataggtttcaaaagctttcagaaaagctatctgaccaaaacgagatcaatgcggttggctgctaattaaagcaaacagacaaaggaacgcaacctagctgatttttaatgtatgcgcttcataacacagcttacattagtcagcttgcattttgaggactattgaaatgttttgttcttttgtctccaaggaaagcatatagaaattgaaactgaccttcaattttataaagaaggaatgagaattctttaaaagggaggttactccatggagcataaatacattcagattcatgtatagagaatcatttatctgaacatttgggaatttcaaaggcctgtcatttggtgtcctattcatttcagtctgttatgggaaatggagaagagggaaatttaacagggaagaaaaattatttccgtaggtttttatttaagtacactgagtatattttttaatgctcttatcttttaagcgatgattttctcaagatgtgttcaggttgaagatttttttaagaggggtaggcatgtgtctaaacagttcatatgtctaaataactgcaataaaaaatgggcacttgggcacacacagttaactactgtgcttattttcttagacaaaggaccattttcttttaatttttacaagagacttagaatgtacatgaatcaatagggggcaataatgaatggtgatcatgaggagtgtgttatcagatgagcttaatccaaaggagcaaaggccctccccatttaatttgatttctagagtttgatgagggaagtagagggcagtcggctagacttgggtttaaatgttcactctgccctcactggaaatctggaactcgctgagtctcaggagcttcacatgaaaaggtgaccccactacacccctcgtgagtactatgacagctgcatccaggcagtgacaccaggacaggcctggcatctcatggggcccttgaacatattggcaatgatacatgtccagtgcccacctttccaggtggattgcccacgctcagatatctgaacatcttcttttgtccagctggtctcattcctgggcttataatgtgccttaggacagcttgactctctttttagagaccatttcctccatcagctgcatgaatgtccctttaccattgtctgatagcaagcatatacacacatgcacacacatgcacacatatatgtatgtgtgagtatatctataaatttgtgtgtgtatatatgtgtgtgtatttatgtatgcacacatgcatatatacaaactaaaataaaatatctctacatttctttccagactcattgcaaaagccatgagcagaaatatacaaaaagtgagatggtacttatattcccaccggtaaccactgttaacagttttccagtccattgaaggactttccaatctctttacgtacagacgtactattcgttttaatgtctcatggcattctacagtatgggtgtaccatcatttatttaaccattccctaaatggtagattatctattaattatgtttttaactgttatcaatgataataattttacattgtttttgtgcatgtaaaaatgcatttctgggacattatattctatttctgggaaagaaatagaattctaggtcaaagcagatatataagttaagtttttaaaatgccactgtgtccatggcattgtggcaatgttcttcatatgctgcatgagcagaaagtattataacacaaaacactggcaaaggctgtaaagggacaatgtgttccaagaagaaatagttgggcctggcagggtggctcacacctgcaatcccagtactttgggaggccgaggcaggcagatctcctgaggtcaggagttcaagaccagcctggccaacatggcaaaacacagtctctactaaaaatacaaatattagctgggcacactggcgcgtgcctgtaatcccagctacttgggaggctgaggcaggaaaatcgcttgaacctaagaggtggaggttgtagtgagccgaaatcatgccactgcactccagccttggtagcagaccaagactctgtctcaaaaaaaaaaaaaaaaagttagaatgcataaggaaaataaaaggattgattatgcagtctcaaaaaaaagaatgcaaataaaatgacgcaaaatgtttttctgtaatatttgcaaattaagaaaaataaaatccagagttttccaattttgagtaaacagatttatcaaaatactacttaaggagtttagggaatttgggtgaacaacttggccaatagattaaatctaaaacctgttattttcaccaaaaggcaaccattgtggagacaaagagacagacagaggaagggaaactagaggtagaattcagtgctccagactgaacaaatggaagtggctcccagggtcagctcccgggcatttgtgcagagcctgatggagaagctgaagttctcctcagggatatgagggccaaaggtgggatttaagaacagaattgtgagccaaggcaggtgccgatgggagtgttctggtgcctgcaaaggatgatttttgaatgtagaacagactttagcaagatttatttttggttttaaaaaagtgatgtcgaatttcttaaaattttaaaatccttgttctttaagtttttttttctttttttaaaattcaacttacaatgtctttttctatttataaatctagcaggtcttagctatcaagtctaagggacctttggaaatgtttaatcctggatttagttatttaagtaccttcaaatactttaaactacatatgtgatatattttattaactttccaagttcattgatttgttagtgaacaaacagaatgtgacaaacacttgtcaaacttgaacattcagaaaataaacatttaacttaaatgaacttctttcttaggttttttactaaggaagatttcaattaaggatctaaatcagttgtctcatacttttttcttttttttttttttttgagacagggtcttacattgtcacccagactggagtgtagtggtgaggtcatagcccactgcagccataaattcctgggctcaagcaatcctcccacttcagcttctcaagtagctaggactataggcgtgcacctccatacccagctaatatttgaatttttttgtagagacagggtttccatgtgttgtccagacttatcttgaacacctgacctcaagcaatcctcctgcctcggcctcctaaagggctgagatcacaagggtgagccactgagctcagccttacacattttaaagtgaagtttacaagaattatactcgaataggccaaattctcttaaaaactacaaacacaaaaggactattaaaatatcttcaaagttttattataatcttcctacaagagacacaaactagagctggccaattcaaaaattcactcttggcaggggatcttcataagagaaaagaaaaatgagatattcattgttagacttaatgtttttagaaaaatttaaaaattaaaaactcaatgaatgattattagacttcatgacttgatgtaagacattaagattctaagggtaaggttcttcctaagactgtcaactgatactgagtcttaaccctgttaaaattcatcataaatatgctctagtattttttttaacttgggaatgctatttttttctgagaaaagtgaaaattacaacacacagaagtttctgtccaggaccagttttgtgaccttttttctctttcagtaccatacttctttacccaaaaacattcataccatagttttgattattttaaacttttgatactgaatttggaaacttctgggcttaaaaattgcatgcctaaggaagacgtgtaatgtgctaagtgatgaagatttgaggctgtcagtgttggtgactgtggtggagcactttggcctctatgcgtggaagctcagacaaggtctccataacatccacagttggctgaccatgaaacccatatcactgtatcattggattcaaagaccaaatatgaatcctcaatgaattttccatttgcttaatacacattgatgaactcttacatttttctgtacttgtgggattatacaacttaagttttgcaataaaaagtttggtaggttaaatgattttatttggcttgcaatgataactaataaggtctttctactaaaagcaggcagagtctgaaattttctgacattagtagtaagaaagaggaagcaaccatgttaacttacacaggctcaggacacagaaaaactctgtcatgtgcaaaaaatgtaaactacaagagcagggcaggggcaaaggctgtcttctgggttaatctattttaaagatttcacaaactagaagcgaagagggattgaaaatagaattgacatctcctttcccattgggaatttgtagaataaatttgatatcattatgttaattgtgcaaacgtacatattttttctttagtgtaattttatttcaaattaatccatttgtcatattaagattccttttcctaccaaaaattatctttaaaaaaaatctaaactgacaactccacattgcataacagtgtctggaatcagtgcaaaatatgcaaagccccctaaccctcactttggcagaagtgatgcctcagatgtaggcttaggtatcacttttagggagatgatctggcatttgtttgaaggaggatgtgcagtgctctagagtacaggcttcagtgacaggtagtatgcttcaccttcctgactctgtcgctttgtacttggacaagttattcaccctcatctagtctcactttttaaatctgtaaaacaggggaaataataccattaaagcaacatcccagatgtgattgtgagcacatgtcaaagttttttcaagcttcttggccagggaaaagccttaaagaagccaagatcaaaatttcctcttggtggagatattttgtaggagaataggaaggaaaaaaaagtttggttaaaaattattaagatagtcttaaggctagtttaaggttattgtattttaaaatatgatctgccttaggtttttatgggatccccttgctcttgtgttgggaattaactgaaggggtcaagaacggaagctggaagaccagttagctgaaaattgtagttattctggtgagagatgcttgtggctcagactagaggagcatcggggtggggtgataagtggtgagagtcaggacagcttctgaaggcccagccagcaggaattgctcacatcttggatataggctatgagagaaggagagcatcttcaagtttcgggacctagatactggtaagaagggtattgccatcaactgtgatagcgaaaaacacaggtgaagcaggtggtgggggcagggtgagggaggagatcagaaagtcaggtttggttaaaggtaacaaggatcaaggtgagctggatgggtaaattgaatttttcagcagactttttatctcatgaaaatctatcaaaattgtacaaagattttatcaggaatgctagatattctcctgccttcccccccgctcaaaaaaaaaaaaagctctaagttgcatcatgcataagggttctgcttctgatccaattagaggacaattatctttctaagtacttaagcaataaagttgttagggcccaaaaatacagctcaatggacataagtaatcaaaaggaattgcattactgacttgcatccctaagtggccactaaagaacgtccaatttatggtctctatcttacttctccactcagagaaacctgagtttctcttccctctctcaattgctccttgcctgtggctgcacagaagaaggctctttttccactgttttctcacctcttaaaaaaaaaacacaaaagtgaggctcctttgcctgccctctttcctactgagctctgattgtgctgctcaagagcgtgcaggtaatagtaaatgggtgaaggccagcaaggctgtgacaaactgaagaggcttagctaacagagggctgcaccccagaaatgcctgtcattcattcactcaatctacaacaatttatagagtgcctaccttgcttcctactttgggtacgtcagtggaccaaacagacaacaagcagcgctcttatggagctaacgttcattttcagagaaacagacactgaatcataaactgatggataagcagagtatctagtgtgtcagaagataatacacactaaagacaaataaaatggcaggaaaagagattccagggaaacaatgaggaaggtttgcacattaaataacatgatggtggcaggcccctttgagaaggtgacacttgagcaggaacatgagctgagacatggggcatgtggacatctggggaaaaatgctttgggtagagagaattccagtgcaagaaccctgacaaggtagcattcttggtgtgctttaggaacaacaaagtcaacatggttggagcagatgtagaaaagggaaaagtgtaggggtgagttgagagtgttaaggggagcagatcaataagaactggaagatcattttaaggatgttgcttttaccctagataaaatagggagccagaggagacgcgtttaaaatgatctgccttaggtttttatagggtcccccttgctcttgtgttgggaattaactgaaggggtcaaggatggaagctgggagaccagttagttgataattgcagttattctggtgagtgatgcttgcatctcagactagaggaacatcaggggaggggtgataagtggtgagattcaggacagcttctgaaggcccagccggcaggaattgctcacatcttggatataagctatgagagaaggagaggaccttcaagtttaagaacctgggtactagtaaggagggtgttgacatcaactgtgatagtgaagaacacaggtaaagcaggtggtgggggcagggtgaaggaggagattggaaagtaatatctattagacacccacgtggagctgtccagcagacagctgcgtagaggagtctggagttcaggagcgaagactgaactcagatctaaacgttgaagtcactggtgtgtagccgtgagatttgctttgactttgctcagtaatcttatttttgctttaaaagaagccaaaaattcatatttcttctgtgaaactttacaaattaaaaacaaactgccagactgcatttccctgaactgtcttgattcctactgctttcatcacacttttcccaggcctcatccactccagctggaaacttcagcccggccccagttaaagctaagttacagagaaataaccactctgatcttcctgaaggaaagctgtgggggtccttttgttcttcttaaggctgacctagagagagcatgttctgctgaaagtgtgcttgccaggatgaaattggactccagtttacatactcagaaatgtctgtctctagtctacctagtggctcaatctcacaacatcctacaaaatcttatctctgctctgaagcagtttatttggctttctccattgctgtgcatttgcctttaaaaagaaatactttgtttcttcatatttcccatgaacagcaaaacacagtacaaaacaaccaccttgaggcccaaaccatgtacctctgtaggatggactgtgagcttaggtccatggaccactctagataaaccttttcactttatctattacctggattgtcaatagccccacctagcaatgatccttctcttttggaagaattttttatttggataaacattataaagacttttaaccctctgactttttttttctcctttcattcctatctcttttctttctttcaatcctttatctcatttcccttaagacaatgcacattctgcttttatacagaggctaacagcttccaatgtgtctgccacactatctaagtttttcctgggacacatcaccagggctttggggagtaagaggaaagccattgtgtccatgctgaaagctttctttgttaaacattgtgcaccaaaggaggtcacatccatccagatgcagttatagatgcaatatcgttaggattttagaagacagatgttcaatgtgtttatctcctagcaatttggattaagagccttacacctaaaagagtgagtgccctcacgcttaattcactctttccacttcccagttctatgatgggtctttttctgggttaatgtcttcgatgctcagtttatgccacgtagacagagaaagaaacaaaagcccagttaaaatgagctgattaaagaatgtggaaattatactcatgaaactgccccttttaaataagaaaattggtgtcatgtgtcttttatctcaagcgtcttctttacagatgagtttttctaatcacagtgtgcattgaaccaaaatgaaccaagcttgaaggcagctctactagtgctcatttattattattttttctttctcattctgggaaaactagatttttccttgctcaagtactcttttacccttccaggaatgcatcattggcttttctgagtgaccatagacaaatgagtttctagtaagttaataaagatgtagtttctacatttttatggtaaattgagtttatcattgtaaaacaaggtctgtgtgaggcatattaaatatgtgttctaagtgcccagatatttcttagagctttcccctaaacccttctcccaacatgccgaagtagattttgtaatcttttgttttaaaaacatttaaagtggggcaggtgccatgtggctcatgcctctaatcccagcactttgagaggccgaggcaggtggatcacctgaggtcaggagttccagaccagactggccaacccgtagtagagatggataaacctcatctctactaaaaatacaaaaattagctgggcatggtggcaggctcctgtaatcccagctactcgggaggctgaggcaggagaatcgctggaacccaggaggtggaggttgcagtgggctgagatcttgccactgcactccagcctgggtgacagagcaagactccatttcaaaaaaaaaaaaaaaaaactaaagtgcagaaaacgtttctttttctttttgtaattacaggattcttctttcttacccaaagttaaaattctgttagttgaatgtaagagaatcccagctcggactatcctaattgcattggggatttttctggaaaagggttaggctacttcacagcatctaatatatatgaaaatagccagctcttaggaagttcacgggtgcaatgaagtctcaaggacagcagggaccgaccacacagtgttggcatcccccttttttgctgcttgctgcatgtcagcatattttttgtttattctgtctctctttcactgcagacaaattttcttgtgtctcaaaacttgaccactgagaatgtctgggttttttattttatagtttcagccaccaaaaaaagtcaaccctgaactttcttggggcccaaaacaacaaaaaaaaaaactacagaataagcacctattgagtgtgctttgctcagtttttctttcttaaggcaatttcttgttttgttgggggagggcagcaataatactatcatttgctcatatggaaatctctgtttgtgtttacgtgtgtgctgtggggaggggatgggctggggcaaaaggaggtgtggaaaggtcatggaaaaactgggcagcttcagaagagaaaattatggcacaaggtaaactgcagaagaagcagtatttcagaagcagggagatgctgggatgtgaaaggaaacagcgtgtggggacagggggcattcaaaacagtgctagccccccaggatctcctgaggacatgcctggagaaagaaatccttactgggatgaggacatcaaggctctaagtttttggaacttccctcccagcacaggcatagagcaggacaggatctctgagttacccaagagaaaagcctgtggcctctgctgtccaccaagaccaggagagtgggtgggaataaaaaggaaaggtagaatttgaacagagagaggaccacttttttgtttgtttgtttgtttggttgttttgtgtgaatacatcccgtaacaaaactatgggtcctttatttaaatctttcctgtactttaggctatcgttgaataccataaagttatcaacaagcttttcccaaacataagccctgtcagcacaattgtatatttgctgtgctgagcagaaaatttctaatatgtctgaacatatgcaggaatattagtttctgggatttgaaacaatcattgctggaggctttcctacttatatagggcagtcagagtaaatcatcttacttttgcttgcctcagattcttagtggcttcacaatgaacccatttgttgtattatataccacttctgtaacttcattgcttgcaccctctctctttttaaattcgcggaatttattttcctgtactctctcaggccctataaagattgttttcaaaaattatggtatgtatcattgtttttactcttaatttcattcactgcatttactgagcaccaaccaggttatctcttaatggtggcagtataagaggtgcaaagaataacccaaaggcaccatgtagtaaaggggatttgaactcagatacatgtctccctaaagtctgtgatttctgtctggaagaaaaaaatgttacctccactcccattagcccaagtctaaagatttttcctttcaactatttttgaagtttataaagcctgtgttttattttgtggtgttcatgcttcgtatcttaaacttttacttaatctattataatcatgtttgtcctgttataatcatgtttgttataatcatgtttgttctgttataatcatgtttgtccacatcatttgttggagttttatgatagtccattaattttatgtactacagatttcctaagtaattttctaatgttggacacttatgttgattcaccattatgaatggcatcattgtgaataacactaattagcatatatatttttcatattttgaacaatagccttaagacaaggtcatctcagtgtgattgctgattctaattatataaatattttatggagtttttaatgtgtgtggtaaaaatatttttcagaatagccatgttattttgaccttaagtagtgaagcctttgttttaaggatagcatttacacttttacaaatgataaaatacccttgcattttagatgaacaaatatcatcttttctaacttcgtgttgtctttgtgcagtttaaaatagatacctggtcattccccaaaagagaagcatgaggacaatgacctcaattatctgcctctcctttaaaaatacaaaaccattaaaaaatgtaaaatgattatctttatacattttattttttagtaagtgaaaaaccttacaaattctgaccacttcaaattaactttaagtcaacatgaatttgcctcaatattaacatccttaacttaagtacttacatcagctttgcgactttcattgcgcagtaatgcaaggtgattctaccttttgtgctaaaactgtaatattcatactattttgatgtcattcaatctgccttaggtatgggagtatagcaaatcaatatctactattaattgaggcagttggatatgagacatttttgctttcccctttctgccaaatgatttggtttattttcttttcatttatgttttcttccattaggtgtttgccaaactactgtgaacatggaggaagctgctcccagtcctggactaccttctattgtaactgcagtgacacaagttacactggtgccacctgccacaactgtgagtagattgatcatttgcccctggtggcttggacaaaactccaggaacaccattgttaacttcaggatgtatttagcatggggcaggcatgttttattcactcattcagcatgtgtgttttaagaggttattatataccaaacactttgttgggctcagaggatgcatggatacaagccatattcttgtggagtttatggtctaccagcaagacaggcaggaaatgagatcatgacagtacagttgaataagtttaaggtggaagcaaaggaaggtgctgtaggcacacaagagggagctgttaagtcaattgcatagtcttgatgagttgttaggtggctataataaacaaactaacatctctgtggtctaagtaacaaggtccatgctatacctgtgtcacatacccatcatgcatgacaaaggcccttcttccaccttgtccttgttcttagatggtaacaaaattctattatctggaagattgctgtagtaagaggaaacacagggagggaagcacagggaaacatgggctagcttttcaaagcttctacttggaagtagcaaacattacttccactcacattccactggccaaataaagccacgtgggcacacccaacctcaataggggctgaagtgcaatcttgccgtggaatgggagaaaacagaacctgaatattggtgaaaagtgctaatgactgcctgtcaaccgcagtgttagggagacttcaaatagaagaactgagctgatcttgttgtagaaatatgggaggaaacaaaaacaagaaagaaacaaaaaggatactcagaagcaaagaaacaaatggagacataaagcacaggggtcctctgctctgtggaaaattggaattttcaaatagtttcagatggctggagggtgctgaaggtgaggaggagtgataagaggggagacagagataggctagggtgtacacaagataaggagtgagggatagaaaacaaataaagaatatgagccttgattttttatttgtttatttatttatttatttattttttgagagagagagttttgctcttgttgcccaggctggagtccagtggcacgatcttggctcactggaacctccgcctcctggtttcaagtgattctcctgcctcagcctcctgaatatctgggattacaggtgcacaccaccacaccgggctaaattttgtatttttggtggagatggggtttcaccgtgttggccaggctggcctcgaactcctgacctcgtgttccgcctgcctcagcctcccaaagcactgggattacaggcctgagccactgtgcccagcccagccctgatttttataattgtatagtcttattgagaccacgggtagggggaaacacatgaaaaagtatagaaagtttgccagtcagagaaatgtatgcccaactacggactataagtgtgattgagaaagataattctgaaatcactgtctggaattgcagagcatttcatgaaaaattagaaatttgaaattggcttagaaggtagaagggtaagataaacattttctagacgtaagagtgcagccaacgcctggagctcttctgaggactccagtgagaactatcgctcagggacagttctctccggtttttcttaagtgcctgctgtttttgggctggcacttggggatgcagaaagagcatggtagatgccaatagggctggaaccctgggattccagccaaggataagtaacgttgatattctcatctttaaagacctctcagccattccttagcctcttccattccttcaaagcaggattcactgatgatgtccatagggaagtctgatcaatttagagaagaactagtccactagtccactggtcatcagggagtgatgtggttattgctgttagttgcctgcagaaacaaaaaaaatattgtttggctttataaaaatatatctcattaaaacttttctactgataaatttagaaatcaaagtaactagaagagtatcattggattgttcataccacaaaggataaatgcttgaggggatgaatacccaattttctatgaagtgattattatgcattgtatgccggtaccaaaatatctcgtgtaccccataaacatatacacctactatgacccacaaaaattaaaaataaaaatacaattaaaaagaaatttagaacagtgaaaagaacaatagaataacagagattgaatttaaattttacctagatcctttttttttttttttttttttttttttttttttttttttttttgagatggagtcttgctctgtcacccaggctggagtgcagtggcgcgatctcggctcactgcaacctccgcctcccaggttcacgccattctcctgcctcagcctcccgagtagctgggactacaggtgcccaccaccacgcccagctaattttttatatttttagtagagacggggtttcaccgtgttagccagaatggtcttgatctcctgaactcgtgatcctcccgccttggcctcccaaagcgctgggattacaggcgtgagccaccacgcccggcctttacctagttcttctatgtgaatacgtataagattttatcaattgagggatcctttttttttttttgcagatcctaggaagaaaaactaatgaactcttgtgggtccatctaaggctaaaattatgtgtttttatctaagagtcccagtaaacaccaatctctaggttttaagtctggttccaaaaatattatcaccaaatagccaagaacaccatatacctatagagaaatgttgcaggacccccataaggctgtccagattgtaacgtcagtgctgctgtaagaagtcagagacaactgaaatggccatcaatttaatagcaagacaagggaaacatgaagatttaagtcaaaacaacccgaatttcagccaaatcacattacaacattcccgtgactgttaaagcttattccgctcactttctccaaaagtaatttaacaattttttgaggagttcatctctatggatactgttctcctttaatttacttcatccatcaggctaaaaatagaagatgtcgagctttaaaaaaaagtgtgaagttgaaaatcaatggaggtgaggtgctgatttttaaaggaacactgtcaagcctgatgagcaggagactcaacacacaaaaaccttaaaaatatcattttttaacaccttcctatttccttttctgtgaaattgctcaatgcctacactgtaggctgcaactttgtgaaactctatctttgcttctgggcactcagccaggacaaatcaaaatcccttgaatatttgtgacatttggcaagcacaccttggttccctgtgcaattcaaatatttgtcctccctctaactaatttccccctcccccagttgaatgaggaccattgtttttagtcattttgcaaaccaagtgatttcatcagcaagcttgtgcctcactctcagcaagcatgggtcccactcacaggccaggtgagagcttctgcagtgcagaagatggcacacagggcaccctttggcaaaaacaaaaacaaataggcctgaaattctgcacttgtggaaatgacagaatccttgctgtgtttgagggatgttttactgaaggaattgaccacagtcgaaacaagaaatacaaactctttggattaataaattatttataataatttcttgagtattctcttagttttgtcaagctcttcgaaaacagtcttttccccctcattgttggtgctttctagtaaatgtgaagcaagaggacagacttaggacagataggattaactttttttgtccagcctttgtggataagagaggtcctgggtgaggcgggcacaatggactctctaaaaaataacagaatggaaattcccaaagcgtgtagacacagcatgctgctgtcgaaagtagagatatcttcagtccgtcttaattttcttatccttacctgatgatacttaagggacttggatatgctaatttggtcacttttcaaacatacatcattcaaaactacctttttaagaaaaacatgatgaatgtgtgggcaatttctgtccaatctgtggcagctttcccatatgaagaggaaacctacctcataaagtgccattggagactattatatgatgtttgtaagttgttatggttagaaaatttctcccaaagtggtatcctattctccacaggagtaaccgaataaaaacagtgtttgcactccaccagatcaatccctggcaacccaaccaatgttcaatgccttccgactcccagagacagataccatggttattagtggaatataacgtgcaagttcagaagcctgtataatcaaaaccaagcttctaagtactcagggtatattttggtcatggtatgtcatatctactttattacaaatccaaattaagattaaaaggagcaggtttttgattgtgggatattagggcatagatgatagatagatagatagatagatagatagatagatagatagatagatatagatagatagataccattacaacatatcaataaagggatatgcatagtgttattatttccattttacagatgagaacattgaggcccagaaagcttatgtaaattccacaaggtctcatatctagtaaatggtagaagttgggctttaagccaagagaatctgcgtgttgatgccagatgctaaatcctgcatcttatttcttccttcaaacaagcaaggcatttgcaaacctctgtattacaaacttggtgatgggacattcatgacctcttttatattgcttaagacgcagtagaatagtgtgagatcataattgaaaatacagttctagaagactgagagatgagaaagtttttgtgttctagaataatcatgaaagcattatggaaggaagtagaatgacttggaggacatctaaaattgaagtagacaaaaggaaaagggaggtctgtcgaaaacagactgtcaagggctaagacatgatagtagacatacatgtgctgtattctgggacaatgcagaacttgcctggctcaaaaaaagaaaacatgaattgcactagtcattcattcctgaaggccaaatgagattcctataaagcactttcccctagagaatactgaagcacacttactattataaccagagcttttcacatgctactgcaacacctctaaatattattttaataactccaaattattttaataacaccaaaataagtagcccaagacgtttttgtttctatattcaaccatcttaatatttttctttgtctttcttattctggtgagagaggcagaggatctgttttgtttccaaatatttattattgtagccagcactatgttaagcatctttgtatttaagtattttctggccgggcgcggtggctcacgcctgtaatcccagccctttgggaggccgaggcgggcagatcatgaggtcaggagatcgagactatcctggctaacacggtgaaaccccgtctctactaaaaaaaatacaaaaaattaccctggcgtggcggcggacgcctgtagtcccagctaatcgggaggctgaggcagaagaatggcatgagcctgggaggcggagcttgcagtgagccaagatcgcgccactgcactccagcctgggcgacagagcgagactctgtctcaaaagaaaaaaatatatatatatatcttttttctaataccacaagttctatggtttacttaaacaaacctcagaaactgctttattgagtaaaaagttctgaatggttttaagaatcttgattcatatttccaacttgttttcctaaactcttattacggtttacactctgatcactactttctgagatcttgttttaccttctctgacattattgtttactacaacttgtaaaacgtttttacatgtatttttactaacacagtggcatattaaaatagagattattattgaccctcattgtgaattccagattaaaaaaagagatttttttcagatgacttgtattataggaataagattgcttccacaatcttttttcagatgacttgtattataggaataagattgcttccacagaattttcttttttcattcaacaagtactttttgaaagtacatctgattcattaaactgtgaatttagtgattactgtcacattgaacagatccagtaagtgatacaagcacttgtccttgatcttctcgatgtttatgtctgatgacactcacatgtgccctgttcaggatcttttcaccatttctcagcctttgccaatcccttttcaacagtgtaggctctctgacatcctaacaatgccctttagctcatttttcagctttgcagaaggatgtcagctttcttcctcttccaagcctgatgtagtgcttcttctatggagaagtcaatagccatgtattaatttgaagcatatcaagtcatctggctatcagatgttatagtaatcattgcagagggacaacacttgctttaacagtaggtaaatggtcctttgactgcatgtagttatgttaactaactactgagactataaacctatttaggtgagaaaacatgccttactcacacttgtaccagtcacattcaaggctttggtggcatataggctattatagaaatggtgagacagaagattaagcagaaaaagataatacagtgtgctcttagtggaaattccataagaacgggatgatatctgaatcttcccagggtctccagcctctgatctaatccctgacacatagtagatatccactctttgatgtataccaaaaacaaataaatgaatttatgaggcatgtgcacataacaatgtcaagttactgtagcaagagcattgttactttcttgagaaagtgagaaagtgctcaaaataattgaccttttagcagagatttgagggatgagaaagaggaagagcaccgacaacggccttgcaggaagagtgagctccatgagcaaaggcaaagtgacacgaatgtcaaacaacaaagtgggggctatgggacacctggcatagctagaattgaagatgaaatgggggaggcaggaaggagatgcaggaaatgcagccagggtagaaaaggcagacaatgaattgagaaggaacttacttctctgctggccaactaagagccagccacagtttgttggggatcgggttgctaatatttgtttgttgtttgctttgttcatcagtttcttttttttaatgtaatggtgatggtgctttggagcatatactgaagatggaaggtgtgggtactagggacagatactggatgcaatttgcaattttgtgggcagcaaataatgagaaccagcacaagctagaaagcagggacctgatatgaaaggcatatctaaaattggatcaagtatacttaaagaaaaattgaacacagtagagagaaggatgacttttagctttttaacttggaagacctcatggatggagaatggagtgactaagtcctgaggtctgtctcactctgacagcctagtgtcaaatgcaggctctacaagttacaagatatatgacctagggaaagaagccatgtgagctccatgtgctttaacttcctcacctgtcatatggggctaatgatagcaatcatttcaaagaagtattatgaggactgagtaaaacaatcttatttagcatggttcctgacaaatacaaatttcctgttccatgttagctgctgtttaaatagacagaggatgtgtagaaagaggaggagatttagtagttggacttcagtctagtttggggcacagtatttgcctggaaagtttcccactgtgcagaattagctggaaaactctggagggaggtccatagggaatatcagaatcagtgggtgtatagttgctgaagccttttgagtagatgaagtcaatcaggtgtggtaggccaagtgtgggaccttgaaagtaaaatattttaagagactcaagaagagatacaatcaagaaggaatgatagccaaaacatataaataaagtactacggaaagtgtaacctaggagtcagaagagggatgtttcaggaatagactattcacagagatgtctaggtacatggtatcccactgagtacttttttttcttttttctttttttttttttttttttttgagacagagtctcactctgtcacccacaggctagagtgcagtggtgcgatcttggctcactgcaacctccgcttcccaggttcaagcgattctcctacctcagcctcccgagtagctaggattacaggcacaggccaccacacaagctaatttttgtatttttagtagaaatggggtttcaccatgtagatcaggctggtctcgaactcctgacttcaggtgatccacccatctcagcctcccaaagtgctgggattacaggccgaatactctttcatcataatgattggtaattgttaaacgactggatagatgtttagggagaagatggaaaaaaagcacaataagggggaaaaatgaaataagcaaaccaataaaattcaacctgaggaagctaattcaaaaaaagaaagaaagaaatcagtaattttctgtcggcagcctaagactgtggcagtattggaatgcactggaatttgctgatccaagagaatttgtttgttgatgagtatcccagattttgtcaggatctaggtgattcaaaagcattcactgctgttgagaggatttcattctccttcaggagaaaaaactccaacctccttgaatccgttaatgaacagtgaatgcactgtgcaattgagtgcacaggactgcctgtaagggggaatgcttcttctgggagggagagatctgagcaggctgaactggatgtgagaaagtcttcttaaaaggaaacagcagatactggggtctacctgagggtggtggggtgggaggagtgagagaagcagaaaagatgagtattggttactgggcttaatacctgagtgatgaaataatctatacaacaaacccccatgacacgtgtttacctatggaacaaacctgcatgtgtacccccaaaccgaaaataaaatttaaaaaggaagaaagtcttcttaaagaagagattggacctgggcataaaggctggacttggggagtcagataggtgtcaggaggatgtttttcaagggtggatattaaaataagaaccaaaaataaggatgagcacaggggatgtttggggttcacccagtgctctagcctaaggggaaaggaatggacatttgttgagccctatgtaagtgccgtatgctttactcagtggtgaatacatgtcatctcacattctcagctctagccctgttagactccggcggctcttcaaacaactagaccttcagatttgcacatctcttggccacaaagacttcttaccactgtcttttcctgaagaaaatctgtcaactgatgcaagaaatctgagcggaccttttgcagctattacttctttttgctcctttagcattctctcacatagcacttattctaccgtataaaaattgtctgcttcttgtttttccttgcaaactgccacttttctatgcatttctccttgcatatttggcacctagttacacatagtagacaatcactgaatgtaaacattcttttatggccaaaatgcttaaagccacagaaccggtggagtttgaccttagttctagatggcttgaaaacactttctcttcacattacaacatcttaagtgcattgaagagcactcttaaatattttatggaacacagaaggatttaaaagcaaaactaatccaaagacttcttatcagagaaaggaaggaatgcagggtgtatattcaccttggattgattttcttccttttgaatacatctcagtgatttgagagtttccctcagtcatatcctacatgtcaattggttccatttcttctttccttcctctttatctatgtctttctctccatcttcctccaaccccttgttaattgaggatacagtaaagccaacttcaaatatttacactgggttgataaagagcaagaaatgtaatcacaagttttagctttgttccaaacccctacaagcaacaaaagattccaaaatgtaagtgaagataattaactgaatataatttaattgctgatgttgcttccattggagaatcattgatatttactttgaataccaagcaagaaaaattagcacctatttttaatgtatttcaatcaacagaagattaattgccagaaaaatacaaagctctagtatgtcccatgagtaagaagttatctggaatatacatacataaaaaattcaatatatgaagacacagttttcatttgtgcctccactttgaatccagacagatggaggttatcaatagctctctggtatcagacaaattatttaacttctttcagccttggttgtttttggtctctaaaataacagtaactcctttacacaattgttatgtggattaaaggcaagaaacagacaacatctagcacaatatttgaaatttggcatttccaggttaaatggtatctattacatatatataaagttattgccataaaagtttagaaatactttttcatataagagacatcctttctatgctgctaggtcatatggctgttttctactatggatttctactatacattttttatactatagactaccaaatagaggttaggttttggcataggtgttgccatcagtagaaaaaccaagaggcaaaacgtcaccagtagaaccccggtggcaggttgcgggggggacgggggatactcctgcatgagtcagatcctctctgccacaaatgaccttaggcaagtcacttactttttgtgatccatgattcctcatgaatactgtgtggattatacgtggattatacatggtcactaaggaaaactgttttgatttgctctagcagcatgactcagaataagaatgtgatataatctcactcaatagtttctatttcttatcttagccattttataatattctagcctaaaataacaattacataaaccacatagtccacatcttgtctatagaaagcactaagtattaatttacactgttacctcaaataggcttttaaaataaaacaggttaaaacatgaggaatgttctgcaagcatcacagctctttcagcttccccttgaagtatttggtatagtttaattacttgggttttcatttggaatgagtcaactcaaacagtaataagagtagtgagcaataataaaacgaaggcatcatgtgattgttcagtataatttatcagtattttttaaaactatgactgacttgactaagttgtcatgaaatgaaggaatttccagtgtgttcattccgattcatgcaaatatattttgactatgtaattcagagacaaaagtcagaatacatttccctagtcattaaaattctataacacaataacactgtgacttatgtatagcaagttatttcagcaatgtgagcctcatttgtgccatattcaagggaaaataatagaatctgcccctcagtgctgttgggataaattcatgaatcaatgggcgtgaaatctctctgacaagtatgatcataaccctttcttatagatttcttctcatgtatttacatcatttttttcccactgcaaccttgatgagggacgaggcaagtacgctttaatgtacagaggaaagtcatgagatgtacaatggtttaatatggagagcccaaggacattcaggtacaacagcccagcaggacacaagcctgaatattgtgactctttccaagattcttcagatatatcatgctctagacaaggtcagttgttagggaaaatccagggttcttttaaaatatagtttctgttgtttcctaaaagtgactttgattatatcattgcccaacttcaaattctttagtggctctctataatcttattgaagaaaaccctttactatttgatctcagtaagtgaggcctttcattatttggaacgctcttgggtcacaaaccattttcagtcatggccctgtatgtgtccactttatagcagttgtgatccactattcattccctgagcatgttccgtttttcttatctttccagtattttggccttgaagttatttctcctggaatgttcttcctgacttgttttccaaataattgtctattctctattctactctatgctctgctctagtatcacctccacgtatacaggtggctgcaataattgacttttgatctttctctggcattaggttgagctccttgaggtcatgcactttggcttttcttgttttttgaatgtgttcccaactcctaaaccaggtctggaatattactcttgcaaaataggtattgagagaatggagttctaattttcaaattgttggcactaccttgaaatatacttatatccattccttattgagggaaggtgaaagatagcaaatcagataacaggccacaacctccgttaggctttcccttttagcaatcaggtaggaaaacttcccatttttaatttgatggaagaattgaggatcctgctttttatttaaagagtatttcttaaagatcctcacactacgtccccatttgctctcaaactagcttgtaaatgattcttcacttggcatagctgtagttccagattttaagatattagcataaataggatttttggatggctgtatatatctatatctatatctatatctatatctatatatatgtgcagaaaacatgaaaaggagataaaattttccattgtcatagcgggacatgcaactgagtttattagtctgttaacggaggagttgtcaaagtcagttttcagtggcacagatttcctgctggcagctaatgtgatgatgaagaccctggcaatcattcccttgttcctgtctgcttgattttgctgtcgtgatgcctggaagagggagctaatatttctgtctgctaacattttatttcattactgcatgtttactaaatgggcattcaatggaataactgttacataacatatgcagattagggatacctgcagctcacaggccatcagaggagaagctgggctctctggcttctactttaacagaagtcttccatctaatgacatcactgggggaatagtcaaaactacagaaaacaaacccgttctgtatttggttttgtgtttaatggcaatgcagtatgaaaaaggaattgtttttgaagattaggctgccctgggttaaattccaggctctaacaattactaattgagtgacctgtgggaaattattcaccttctcagaacgttagttctctcatctctaaatatagggatagtgatatctatgtcttaaaattttttaataaataagagattatgcttagagtggtggatgcagtgcctatataggaagtgcctgattaagtttacttattttacttcgtcagtcctctacacttctacattttctggccatctgtgcgtagcttttggactagtagcaagttctgatttctatgtttggaagggacttttaagtgcaagtatgttttcttgcagacttcttcaaatcgatgctctagaaacggactgataaatacctcctgttatcactgtagttctccagtagctataagatttatttcttttaggtagtaaaatgtaccttctaactttccttagttagttttattttggctctcaatgatcctactatggacttgccattttttccgcagcactatcatcacgtctcagtcgcttgacatgaagtacactggtgggctccatagctcctgaaatcactggattcagaacatacctaggaacaatcagagtgagaaattgcctttacttattttaattagcatgtagtttacttatcattacattataatacatccctaaatcagtgaaagtagctgattccacagtttattttggctgttgttatgacataatttcattgagatatttatttttattcaacaccaattcttgtacatctctcctattttggggtcacccattcatgcaacacacatttgtatcaggcatgtataaatatctattcagggttcaacagtcaaccaaatattgtgggtgacacttgtgcaattgaaggtctgcttcctgttctcaaggactttaaaattagcaggaatgtgggcagaagggagatgggttatatactaagaaaataatgcaagattgtacatggtcagaagctaaattgaatataggaaatggccaaaatataggcaccaaacaaggagaaggagatgagccgtaaagggaagggatgctggataatgctggacttgagccaaaccctgtggcatacatgggatctgcacagacagagaatatgacagagggtcaagaatcaagactgacattaacttggttggagttggggtcagagggatatggacttgaatagttcggggattcttattaatggagagaaataatgatgatagacaaaactggtatcagccagagttcagagaacagaaccagtggaaaaatacatgacaacaatggtcacattgttatcctgaattgaccaagatgctgaacatggccgggcacggtggctcatgcctgtaatcccagcactttgggaggccgaggtgggtggatcacctgaggtcaggagttcgagaccagcctggccaacatggtgaaacctccgtctccactaaaaatacaaaaaaaaaaaaaaaaaaaaaaaattagccgggcatggtggcaggcacctgtaatcccagctacctgggaggctgagacaggagaatggcttgaactcgggaggcataggctgcagtgagctgagatggaaccactgcactccagtctgggggacaagagcgagactttgtctcaaaaaaaaaaaaaaaaaagatgctgaacatgtgaaaaaaaactgcccttgctttctacattgcaacaaaacttggggattcataatcttacagctcaaaagggtctccccacagtcttggaactgtacacccactggaaaccacaggataaagctcaccagggaattttctccccagagggagacagcatccctacttcagaaggccgaggcggtggatcacttgagctcaggagtttgagaccagcttgggcaatacagtgaaactttatctctaccgaaaactaaaaaaattagccaagcacggtggtgcacgcctatagtcccagctccttgtggggactgaggtgggaggatcatttgagcccaggatgttgagtctgcagtgagctaagatcacaccactgcattccagcctgtgtaacagagtgagaccctgtctcaaaaataaataagtaaataaataaataaataaataaataaatgagacaacagcatctttgatgtggacagctttttcccaggatcatagatcaagacttctctattatcatgacactctttgtttttcaatttttttttctttgcttatgcctctatgaaagatagaagtgacaagggagtctgttgtgcacactcaagggatacacttttatttgtgaaagatttttcagctagctttaaacatgcataaccttataccttgatagatgggagatgaagggccagtgtgggtgagaaaattttatggtacatatgttgcctcataatcagtcagaaacagacattgttttactcctcttaacatatgtaatggatcaaaaataatgctgccaggaggtcttcgctcttctagaatggcatcatttgttaggtcctttttaccatgatttggagtaaatgaggcaatgattagaaattcattcctcatgataggctctatagtagattctattgtaaaggatatggttacacaaaatattttatattctcccataaaagttatgctaaataatagaattgctctaaattacttacttactggataaacagaaaagtatctgtgcagctgctggaacttcttgttgtccatggagaaatacatcacatcaggtattatagagattcagttgtaggagattaacgtagagactgcttagctaaaacaagtagactcttcatctagctcattctttgatctattttatcttagttggtttggtttatggggaccctccaaactcttggtattatcccccgatagtcataatagtagtctccctggtgcactgtattttttcaaaagttttaaatgtttgcatgcagccttctctagaatgtgaaatgatctgtcttcaactgggatgacaagagctgaaaaaaatgagtgatcgtgagggcaccataacctgtgaataacatgctgagaccagaaaccctaaatgatggtcactgagagtggtgctaaggccctaagttttggtcacactctcacctaagtgagaaaatgaccaaaaggagggagtttttaagcaaaataatgggaagcaattgttttggactgagttcatgcactaggttccaacagaccagaccaaaccaaagtgtagtcacttatgctaaatgtgacataatcaaactaagactttaaggaaatacatagatcctagaacaggccaggttttgttctttgtttgtttgtttgttccatcataaggaggcaccctctactctaactttcacagaaaataacctgaaatcctgtccccaccttacaaaactcactattctgctatttcccagtgggtttcaagactaaataagtacattgacaatggtgacaatgacatcaatgactaaagttctggtcagtctctcaaaattgagaggataaccaaaagcggggaattgttaaatcaagtttagcctaaagctgcctctttacatattttaagttcagcctaaaggcttctctgtaagttgtcaactataacctaaacagagttgtaaacagactgtagccactcactgagttttggccaatcaaaggtggtcaactgttcaaaccatgttcaaataaggcagatgccaagctgtaaccaatttggttgtttctgtacctcacttccactttctgtccacatattttcttctaccacgtggctgcactggtgtctctgagacaagtctgactcaggaagctgcaaaattcacgaatcgttctttgctcaattaaacacttaaatgtaatttggctacagtttttcttttaacaagtgcttggccccctcctccttacagcctccacaatgcataacagttacgtttggtcatgatgcccagaagggtgcagtctccgtctctctctctcagctgtccatccccatctctcaatatctgtttatatagacctatgcatgtgtgtatctgttcgccttaacaaggtgagaggacaaaacctatgcatatggagtgatttgcatgacagtacttgattctttgctgaatgataaaatagatataaaggagaagttcagaacaatatgggatgtcctaagtttggggaatctttatacagggagtgaggagaagcgaggccttacaggatgcaggtatttgcataatgtgtggagcacagggggaacgggagtcattggaagtagagggaatgcctggctcctcaaaggctctcactgaaggattatagaatgtgatggatatgatagggaagagcacagatcgtgggcttggggccaatgaggaaaccaggggaataggtggatcacaatgaagtatctgctggagaggcggtaggaaacaaggctggaagtcactaacccttggagagagaatatcctgttttatgctttcaaattcttcaaaattcttctccgaacatgagtctttattagcaaagatcatttcaggtttcttaattttaaattaaaatcatgccaaggtgggaataaaagtgaaacagggaaaaaagtaaaagttgaaataatgcctttgtaatagtctctagtctcctcatttttctttctttaaaaagtccaatcctctaattagaagacaaagaataaaagtgagtgcatagattcccttatgtgattcttctactaagaaatcaaagctctttcattttcaattttctagcacgacaacataaaacaatctcattaaggactttgtcgaatattggtaaaggttagacagagttcaggcggcagggactgagaaaaagtgtttgagagtttgagcaaaaattggaaaacttcagatttaagttttcaggaagctgaaatggaacaaaaagagaaagcccacaggtaatgatcagtcaagagaccctcccttatacccaaagacctagccagcacagagatgaaccagtgtcctgaaatgcaaacttaataggaagaaatgtgaggtgaagcccgttgagatcccagcctgctgaggaaagaaatcctattgtatatgcacatgacgcatccccaggaagagaaagactacctgcattacaccattctccaaaagcggccgtcatattgcagtgtcgatggtacctcagggaacctattctcaagtcaaagacagaggaacattcttaagctggtgctgtttcacaaacacggaggcaggggcttagagtaggagtttaaattacttattaaaacagatggtgaaatctctctctactttaaatctgcgttaaaatgaatcttgaaagactgaaatccaagtgatctggaaagactacaaatggaagttgctgtgtaaatctggtgaacttttcagtgtaaagcgattccatgccatttagcaggagcttgatttctttggatcggaaggcctcggtggctgtgtctcgtgtctgtcattttgcaggcatgtggttgggaattggatggcacaggcaggcacaaagcagcctcatcggacagtattcaagtggcagtagttgttgctcacctggctttactcactccagaaaccaggatttgactcaaagaggcagctgatttcccctgtcaattgtctgtttataatagtttctcaaaagagattgaactcaagatttctgataaggacaaaaataaaaataaaaaagcaaactcagagcctagaagtcaaaaggcaggataaagatccctggacactaagcaaactctaaatcaagagtccagggctcttgcctacctgggctagcagctgggacacatccctgcaaaagggggctgccagcttgtctggatgaccttggaaatgatccagttctgatggcctgctcaggctctgtgcactgagctggggcagaccaagtttcaaagggctcaaaatttatataatccatgaaagtttttttttcctaaattatttttggaatgagaaaagaagtcactacaaattactaacattttaggaaaaagacaataccacagatatttgcaaattttagaacaacataatgttttaattaacttcttgacacaattttataacacttttatttccttacaacttttgcctagtgtttgattgcttccttatatgatgattttgtttaaaaaattgcagaaaataaataagtaattcagtttttcctctagtatggttgataaaatcatttcttaaaaaattatattcataatttaaaaaaggcttttttttccagcttgacacctcattattggtgatgccacataaacttttataactgtgattgaattggggatatccatgtgaagttccatagattagatagtaagatttattagaatttccacagaccagcttctgcttctgtacatttcacaccttgcttccctacacgacctacactcttccattgctggtgctacaggagacatctctagggagacatgacctctggccctgcaccatttttctctgatgctggatgactttgcatagcaaggagcaggaatactcagggaagcaactcctcaaatgcaatggctaacaatccatgtacatagccgggaacgatatggttatatgctaccaatgtaaactaaatatgtatccacagcatcatttcccctcactggatcttaaaagtttctgtggcctctccaatgccacctggcttgagaagtgtaacagtgggaagggcaggggaaagagacagtagtattaacccattgcagttcaatattttgtttttactgattgccattaaaataacttttgtgaagtttaatagctttataatgtgtcaacacaatttgactgaactaaattccaaagcatttcctttcctgtatatttcgacttaggggaaaaccacaggaaagatacttttgggaggtttggaagggggaagggaggctgcagtccttatgtgtttcacatccactacatccactgttgctggctttttgactcatctcaccggtgaggcagtgtctgggcctggaactgctccaccttcctctggatcctgcttcagcatctctaccttctgggtcaggtgtgtgtgtttagctctgtgacaaagccccccagcttttccagaatactcacatcaccaaggtcaatgacaacaggaagttccatgggttgcagtctgtcttcctggccccagcatgtcctcatgggtttcaatttaacctagctcccgcacctcctcacatccaccttctcctctccactgtggtcttcaaactccagcatctgatgagaagacaacagctttccagagatcacttcacctgctcccacaatagcatcaggtcaaatccttataataaatacaggtatacctccaaacagcctacttctctgacagcctacacacaccagcccttactgacacacatagtttacaaaatgcataatgttgtaaacacattgctcgggttttgcaagaagatcttgaagctgcagcttccggagctttaaaataaattcatctctagcccagagctttctgcctcggttttcctgctggtggtcatgaagtttcatgacaattagtattctctcatcactgtggtgataaggaacttaactataagcatgatctagtaggaagaattacaacgtgatttgtatttaatctggaaatgggtatctcatattgcattaacataaaatgtcctgggtaacagaagtaaatatcctctaagtgtagctcatggcatatttgttcatcttttcctcaaacctcatgtgaactgcacaagctaaaggacacagatttttcatcgtaaaatatccttctcacagcttgaaaaatagacattcaccaattcacacagaaagaccactctttaatggtatgcaaatgcaaaaatgtttattatattaccaccatggcctctgcacaaagaattctggactcgttaaaacaatgacagtgaaatatagacaaataaatactgtataattatttccaaggatgccttcaaataacttccactaggatagcccttattactctgtctagttgaaaccagttttgaacacttatgaccacaatataactgttttatgagttttttgttttccgcatttagaggcgaaagcatggagcgtagagtcaagaacaaacatcagatttacagatagagcccttactaatgggggtggctttggggaaagctctcacattgtatgagctcatttgcattattcataaataggaatacttgttagcaggctctttccccagaaggcttcaggaaccgtgcttaagtttagggagcaagcatgtaggctaaggtggtaaatgaccctaacctgtcagtggcttagcaaaggaaaagtttctgtttttctcactcacactgcaggatggctggtacatgaagctgtacaggggctcaatcagcttctatgttatcactccatttcctttcaggtcctggggaggctcttttcagctgatagagagagaagaaaatgagaatcacatgggaagttctaagggttatgcctgaaagtggggcacgtgtctcactcagtttttacttgagcaacactaaactacccttagttcagaagcttgcatactatcctggcaaaacagggatgggagtggagagaggaattctgttgaggggcatcaaagtctaacaggaagaatggatggatccaggaacagagatcaacttgtaaatagttctctttggaatttgaatgagcctaggagacaggatctgttcaaagtgtggttacattcttggtcttacagggaggggaagaaaaaacaattgttctttattgtgggtccagacattaggcatataaaggaacttcagagaacaacttcattctggcttagggacagtgagtcagggagagcttgaagcttttttttttttttttttttttttgagttagcatgtggaagagtagtacttggggtattggtttctgagccccaaccttacaaatcttctgaagcagatcttttagtacccttcaaagaaaacagaaccttggaacagtaatgaggccaggtttataaaactcataaatagcaaagccaggattttaattaaaacctccttggctaaaacacttctctcttttttactgcacaccacgaactcaactctcaacaacagtatcacttggttgtgaggtcaaggcttacaaatatgaaacaaagtgtgaacctcctcacacaggatatggatctgcttctcaatatatggtcctgaccaggagctataaagaaagaggactggagaaggtgggtctggaataagcctcaggcaacttcctatagtaggacttctcatatatactatttaatacctggagaaaagaggcaggacttcctcacttagactccctgctcactagatggcgatttcaataccaaagccaaggatcaacgaatgagctgtgctatcttatctttagagattattttctagttgtatgactcaactggcaatttgtactgatgatttgatctgttcaagtccccaaattttctgagttattgaggttttgttccatgtaatataacaacaatggcatgagtcagggtcgctgagcccctgtaagcatgaggacagcttagctactatccagcggagccaggagcgggtgctggcctgcctgcaggacacatgattttacctctctgagcttcaggttgagttgctttcctgtttttgtttttagcttttttatgtataaaatgaagaatacaataatatcctcatcttcaaattcttaaaagtcatttcttatttaaactttcacctctttacctttttagcttagagataggttagatgatgtgatcaagtcagaggcctcagagaaataaaagaacaaataatgttatccatggggagggtgtgtcaagagtgaagtatcacagcaatctaaaggctttctttgctatgcatcaagctagaaagttgcaattgggtggatagatccttccagggcaacctccaactgtgtttggaagctaactacagggaacatttgaaagtttgtaaagatttcctggagactctgatactgaaataagtctctgaatatcatatccgattttttatattaaatgtacctgggtaagatgcatgagctcctacctctgtgaaggggaaaatacgcagagcaaagcctggcctgggttcagataccagcttcctgctgaatggtgagtggacttggacaagtcagagtcctgttctgagcctccttttacttccctgtaaaaatgaagctcaaccctgttgtatgagattcctgactgtatgtgagtcaggcactataggatcaaatggtaaccactaactcaagttgtaactatagtatcaaatgctaactattgttatcagatggtagctactatgattttgtctttagttccatgtgctataatcatctgttccatgaccatctccctgtgctgaatacatttctccccctcattatatactgtattgtgtagcatcctcaatttattctgagtctttggataatttgaaatggattacaatgacagatgcatttaaggcttaaatcttaccatagtattgaatcaacttgtaaacaattttttgccccagaaggaagaaatatttatatttttctttgatgtctgattgtttccatatgttatacccagatatatggagtccaagataaggtatagaatagttgtctccaaattctagtgtgcataaatatgtccctctgccaaacttaggtctcttttttaaaagatctcttattgcctctttctggctcagatctttattcttcctcagggggattgttgcaatagtctcctcgtcttttggggcctttgtatagctagttccactctggcttccagaaaggtctctcagaaggccacgtctttataaatcatcagtgatgcttgaattcagagtaatcagcctccaaaaattatttctggaaagacctcaggtggtaagatgataaaatcactagtcggagcagaattattgaataagtgagttgggaaacattcttaacttacatagttacatgatgactatttcccctaaaaaaaagtaagattactaggaaaaacaaaagaggagagaagaaatatatatagagacttagggttctgggaaaaggtaaatttattgttttgactagtggtatgttgatacatattggaaacttgagttttcagcaatgggtttaaaagtgtaaaaatctcaggcctgtcacgatttaataagagttaattttcaaagtttcctttcccttccctttctctttctttctttcttttcttccttccttccctccttttccttccttccttttccttccttccttccttccttccttttccttccttccttccttccttctttctttctttctttctttctttctttctttctttctttctttctttctttctttcttctttctttatttcctctttcttcttcttttctttctacaatgcttctgaaattttaacttgcaaaagaattacctgacactattatgaaatgcaacttccagatccctatccccagagattctggtttaataggtcaggatggggcccaataatttgcatgcctatcttgaaagctcagagtatgccaattgtcgtcggtctgaggaacatactcagggaaccaatactttagaaggtgtgtgtgcccactgagaaggttcaagccttgccgtatctttacataccaacgactttacttccaggcatctgatggcctagactcaattcagctttgaattactgggacagtttatattgagcttgcttatgtatttatattttaaatataaaccttattattatgtaaatctcatagattaatgtatcagatcatggagggtcagggtgacgtcaatgtaataagaatgttagtcacaacaacattctctacttatatttagcaactgttgctacgttttatcttaactaaaatgtgtggtggtttttaagaagaaaatgaagtacagatgccggcttgggtggtggtgaagctctaggcaggcacagtgctttctttgcctttctcacagagccagaggtcatctggctcctgtgttgccctaatcagacaccacaggccaaatcaagcagacaccaggctctggtgcagtgtgtcccgggagcctgaaacatcttttgggacctgacctacaacataacatcccatcctttaactttttttcaggtttattgaagcatatttcatagaccatacatttctcctatttaaagtgtacaggttagtggtttgtagcatactcacctggctgtgcaagccttcttcactatcttaattgtagaacatttcgatgccccaaaaagtgaccccatacatggtaagtcattcctcatctcccctccaccacccccagcccctgcagtcactaatgtactttctgtctctataggcttgtctaatttggacatttaacataaatggaatcatacaatatatgctctcctatgactggcttctttcatttagcacgttttcacgatttatctgtgttgtagcatgtctcattccttttcactgcctagtaatatttcatggtatggaaataccacatttgtttatccattcattggttggtaggcttttgggttgtttccactttttgactattatgaataatggacatgcatatgtcagcttttatttgggcacatgtgttcatttctcttaaatatatacctgcaagtgagattgctgacttaacctcctgcctcctttttcgactttgtaccttgacataatttatagtaaactttgaacaaaaaaaagcactgtgaggttctgtgtaccccagtttcccctgtgctaatatcttacgtatttatggcacgatatttaaaaggaaattgatgtcggtatactatatggagcttactcagattgtatcctttttacgtgaactcagttgtgtgtgtgtttagttccatggaattttaaccacatgtagacttgcacaatcactgccataatcaagaagcagaatagtttcatcatgaggattcctcctgctatccttgctgtggtttgaatgtgttccccaaagttcacatgttgaaaacttaatgcttaatgcagcagtgttgggaggtgggacctttaagaggtgattaggccatgagtgctctgacttcctgaatgggttaatgctgttattatgggagtgggttagttactatgtttctcatcaaaggatgagttttcccctccctctctctctctgtctccctgccattccaccttctaccaacggatgatataggaagaaggtcctcactagatgcagtcccctggaccttggacttgcaagcttctagaaccataaaaaaataaaactttgtactttataaattactaggtctcacataccctattatagcagacagcgaactaagacaatcctgttatggccgcacctgcactctcctatctccatttgtaacctgtagcaaccactaatctggttccatctctaccaatctccttttaggtaatgaaaatgttacagaacctatgtctattttcagcctgtaccagctatgtgcagactgggacaccaaaagatctattttctaatttaatccccagacacattgtttgaactaatttcagcactcccattagttttaacatatttatttttcttttcttcactgaaataaggccaaggcaaagtccctcaaacctaccgcacaaggggtttgataaacttaattaaataaatggctgctaaatgcaaaatgcttcacaagcatttacttaattactagaattaatttgatcctattgatgtccgtaggctgtgcatggagatctgtaactaaatatgcagtcatgtggtaaatattatattgctggggacataggaacaaaggaagaaacaggactgatacatttttaaggccttaaaaatatgtactcagcttcttgtctatttctatagttttacaataggaatataaatggcagtgcagaaacaccacatctctgaccttgatacttgaaaaggtgaggtctaaataaaactatttcgctgtctgaatactatcattatctttaatgagagtgggcatcacaaggacatttcaaattgtaccttaggcaataaattagctgccagaactatattcagactattttcctcaaaaatgaaaacactgatccatctgctctgtccagctacattatacatctgttcacattaatataaaaatctattctgaagagacttaatatgtctatcgttgtccttttcattgaagagcacatatctttctgagtacccctaataccagaccttcaaatgcaacaataggtttactagttactgttttttctaatggagacaaatcttgttactgataatgtttattttgcttttccttcacactcccatcttcttcccaacagaaaatgtgatgatttcctcaaagatgaccttcaatgctaatttagagcttgtgtaagatgtagcaagtcatttcatatacagtggatggtaatctctgtcttgagctttactaggtattgcagagaacaaagatattgccatacaatttttaagtttagctcaatttaacctttaccaaaggttaaacaagagagatcaaaatgctaatccaaggatttccatacatagcagtggagaaagagaaaggaagtctacctaactcagactgatgatatggaaaggctttctggaggaaggaagccttggatttagtcttgatgaacatacatattacaccgatatgtcaccatgttgcacccttgttgcactgttgctgttctatactgagaaggagccaccctgcactcatatagtgaacacctactcatattttaaagcttaccttaatggtgggaacatttatggtgtcttctctacctctgcagaaaagattactttataattacaagcagttcaaaaaatgcttgtttatggaacaatgtaaaaccaacaaaataagtcttcatcaaacaagtcttgcttttattcttattccttcttcctcttcctttccattctctatacataacctttataaaaatgctgttttcttaaaaaagataagcaaatacaaataagttcatacccccatttattagataaacattagcatagtatacatgcattgtctgtgcttttctctcatagctatatattcagaagctcagcttgtagtgttacgtgtggggatgcttcattcctgttcaaagctgaactatattccatgagtgcaacatagtttattcaactagtcctcaattgatgaacaccgaggatgatttctgtctttttgcaagcacaaatggtgtttttaaaaaaatatggaaacatcttttttcccccattttttaccagtgtttcttggagcagatcactagacatggtgtttctgggtcaaagtttaaatgtatctgtaattttgctagatattgctaaattccacatttaggatttgtatgatttttgcattccctctcagccacatatatatatgtatacgtgtgtatatatatatgtgtgtgtgtgtgtgtgtatcaaaataaaaggttaaatggacaaatatttatatataattagcaatgatccaatatctatgctcatgatatgagtgaccactcatagaaaaataaatgcaaataaatctacaacacataaaaacatgtctgaccttgcttataggaaaaaaaaatgctaaagaaaatgacattgaaatccaatttttcacatatcaaattagcaatgatccaaaagattgacaacactccactgctaagcctgctagggaaaaggcctttcccctataatataactaatattctcattttcattagcacttatttttctataagtaacgtcagacatcttttatgtgttttagatttatttgcatttatttttctatgagtctccactcatatcatcagcatatattcctataggttgctacctattgtgtctttatttttaacttgtaaaagtatattagaaatgttagtgctttgtgatgcaaattgtaatttttcccagtttgtccatttgccctttttttgtttattgtatcttttgccattcaaaaatgtttgtttatttttttaatttattttgaatattaggaaatttatctatatttttgttcattgcttctggattttgaatcattgttagtaatacttttgctgcttctaatttacatagaaattcagccttgtttttctctagtacatgtatgtattctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaatatttaaatctctgattcaattaaaatttgatcgtggtctgcagtatgaggagtggatttaatttcatctttttccatatagtttcccaattatctcaataccacatgtaattttttttgtttttctactgatttgagttgcctttatcaacaaatatctatagttgtgaattatttatttaaatatttagataaattattaaatattgaacctctcttgattttttggattaaacattcccttggccattatgtaattttaaaatacgttatttagttctgtttgctgacactatatttaaaattttgtgattgatattcatgagtgattctataattttggttttctttctttatgatgtttgtcaggttaaggatcagctttgcatttactttacataacaaatgtggaagatgggaagatatctttcttcttctgttctttggagaaatagaagtaccagtgagatgatttgttctttaaaaggttcatttgagaaaccatttactctcacaatattacaatcttactctattatctcagggagtttttttgtttttgtttttgtttttggagatggagtattacttactcagtgacccaggctggaatgcaatggcaaaaatgtggcttattgcagcctcaaactcatgggttggggggagctccttaaatacttttcctattttttataggaacaggtcgatttaaattttgtgtcagattgaggttaatgttggtaagtttaagacgctgaataacttgagatttagaaccatgtcttttttttttgcatgtgattttctcagagcttaccttagattagtgaaaaacaagtgcattctcaataaacgtgtgtggagtatttgttccataatgtgttaggcaagcaatgtaggccgaataatttagtaaacaaaagtgtatgcttgtacttcctgaaacagttggtgaattgcacatgtgtgtttaactttgtttccttacactcctcatgaagaatagtaaatggttttttttttatttttattttttaatggctctgtaagccagcagcaaatcagaggaactctttgtcgtttaccatctccaaaacagcaacttcagtgatggggtgctcataggagactgaaaattcacctggctagaaattaggctagaaatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatgaaatgtaagatagagaccaaaacaaaacacacaacaattaaagcaattaaccaaacaagcacagcttaaagggaacagcctatacggagcaaagaaaggatcaaaggtactgtaatatgattaatattcttagagacatgaatgaagtattgcgtcaatgagtcaagcatcacgtgctattagagaaaataatattcaaaggaaaaaaaccaatcttctataattttaaaaatactacaactgaaatagcttaaaacggaaacaacccaaatgttcttcagtggattaattattaaactgtagtatgtccatgttatgaaatactactcagcagtgaaactggaattgacaactgatacatcacaaagcttgaatggatctcaagggaattatttttagtgaaaaaggccagttttaaaaggaatatccagcttgagggtgaggagatgctttggggagacaactgtaaccagacgggtagctcaatatcccgtattacagcaagtcagaagaatccagaagatacttttgattttcaaacacattttcaaacatatgaaaaagataaaatcggccaggcgcggtggctcacacctgtaatcccagcactttgggaggccgaggcgggtggatcacgacgtcaggagttcgagaccagcctggccaacaggtgaaacctcatctctatgaaaaatacaaaaagtagctgggcatagtggcatgtgcctgtaatcccagctactcgggaggctgaggcaggagaatagcttgaaccaggaagtcggaggttgtagtgagccaagatcatgccactgcactccagcctggcgacagagcaagacttcaccaaaaaaaaaaaaaaaaaaaaaagaataaaggcaatatcatgtaattgtcccacatgtatccttcattcaggctcaacagttatcaatattctctcatttttatttcgactatcccctcctcacttgtttgatgcaacatcttatttatttgtttgtttgtgtttttttaaactgagacagggtcttgctctgtcacccaggctggagtgcagtggcttaatcatagctcactgcaggctcaaactcttggactcaagctactcttctgcttcagcctcctgggtagctgagactataggcacaagctacgcacccagctaattttaaattttttgtaaaaacggggatctaactatgttgctcaggctggtctcgagctctcagcctcaagtgattgtgccacctcagcctcccaaaatgttggaattacaggtgtgaaccactgtgcccagctgatggagaattttagaaacaaattgtggacatataattttactacaactacagtattcatagtgaacaactctctaacacaggacaactcatcttttaaaacataatcacactgccataattgtaactatcaaaattaaaaatacttaatataatctgttataaaatctgatctataatttttgtggttatcttaaaacatcttccctctctccctccctccctccctccctcccttctttccttcctaccttccttccttccttcttcttttcttcctttctttctttctcatcttttctttaatgtgtttgaattagggtctaaacaagatctaagcatagtgtttgactgactgatatatcttttgcatttcaactccatttttgccatttttgttgaagaaactaagtgaaacattccagtattgtagatttaactaattgcattcttacagtgtggctgggcatgtgggcctctttctgtaaattggtgtttagatcttggggctcgaatacatttatcttcaatttttgtggcaagaatgtgttttagatggtgttacatatgtcttattgtgccacattagaggcaccctgataatcacttttcatgatgttaagattgacccatgagttcaggtgttaattgaatccactgactaaaatatcccattaatgtttcaactaatggtttggcagtccttgatgatcattgtttaatcctttatctcactgggcattactaaaggatgattttcaaattctattattcttttgcagattctggtttggttattctctaaagacttttttcatggactgttaagttgcattcaaatacatttatacaagaaagacaggatatgatctctgttctttctaatattcaggacatgacttcattctctattaaacttcagaggggaccaatggacttgagtagagagacaagatagatgctacgtaggtagatagatagataaataaatacatacatacatatatacatacatacctacatacatacatgcatacatatataaattgattgatggatagatagaaactaataaattgtatatatttaacaatcaaagtgactattattttttatgcccaaattgtcccatcaaactaactcctgggctgttttgagataattccagtctttaataaaagtcttgtttttaggcaaagcaagacattccactttcattctgtacttttcatggtcccaaaattgactcagtaaaatcttttttccttttatgtgttaacttttatttagagacaactctctgtgcattaatttgcttcttgcactttcagtggtccaaatgtgaaaatgcatcattttttgaaagcattaaattataagcttaagcttattaccaattctaagatatattgcagaattttatctgtttgcattttatattttatcttttatgataagtaatttagtttctgttgataagacaattattagctttttcttgctatgtttaatagtttcataatataatagcaatatcgtttaaaatgaggttattaaatgtatttttatattttaaatttttttggtaggatacatcctactagtcaaactactgtttcaatatcaaatatgtttaaatctatacattcataataatactaaaaatattttcatccgttactttggggcaccctagggaaacatttcagcatttcgaaactgatgaattaaagtgaaagcatcaaccatgtaactcgcttttcccaaataatcttgtagtttagggaaatcaaacgatgaaggttgtttcagttttgtaaaacattcccattaataaatcaggaagggatgatagcattagattaaccacctacaagctggtttgtctttgggcaaagtacttatattttatgaactcatttacagtgtccataaatggcaatgctgttaccaggctttgccctcagagatctcccagttactgagccagcatttaaggaacaagtatatcaataacagtaggttaactaagatggtaaatcaccccaagatctcaatgacttagtgaaataaacatttattttatgttcacatcccatgctgtgtgacctgttcaatgaagtcaaacaatgataaaatccatgtctaccctattgatccatttcatttagcttcttgggatttttttctgagaattttggatgcctcactgatttgccttgggcaatggggcatcagcaaacatcatgcaagcagaggcctgacaagtactttgtttcttgctgttctgggaggctgtaccatgtaaactcccctgctacagtgtgagaggccacgtgggccgaagcaaagaactacagcttaccaccacccagcctggctgacccagcagctgactgcagatgcatgaactgcccagccaatcccagactaaatggctggcctgcagaatcatggcttagtcatgacttaaagtcaaatttggagttttatgtgtgtttgtttttatacagcaaaagaactgatgcactgaggatatagatgatggaagattagcaatatactgggagttgctgaagctggttgtgatgctagcaggatcctctctgtgctctttgtatttgaaagtttctgcaatgagaaagttaaaaagaaaatattaaatttcaatattgctttaaataattcctggttaaattatcttgttttcattttctttcaatgtttaagaactattattctaggctgagtgtggtggctcacacctgtaatccctgcactttgggaggctgaggcaggtggatcacacggtcaggaatttgagaccagcttgactaacatggtgaaaccctgtctctactaaaaacagaaaaaattagccagatgcggtggtgtgtgcctgtagtcccagctactcgggaggctgaggcaggagaattgcttggacctggcggaggttgcagtgaggcaagagcatgccactgcattccagcctgggtgaccgagcaagactctgtcaaaaaaaaaaaaaaaaaaaaaaaagaaggaaagaaagaaagaaagaatagaaagaattattatatttaacttttaaaaattattgaaaatagttttatggtttcaaaattaaaaatataagacattcagaaatgtctcactttcatctttgtcccctcccacatttttctctctctccatagttatcctcttatgttaattcttacctgaacattttggtagatattttagatagttgttagtaaatttggagttaaattagcaatttatatgtagaaaactaggcaaatgagaaaatatgacaattttaaatttcaagaaaaactaaattttgttcagaaaagaaaaagtaatcacattataatatgtagttaatctatgaatagcatttacaatgtcatatcaccaaaatagtaatcattgatgtagctaaaattattatacaactagactggatggatgggggaatggaaagttgtttttattttggggatggggggataaaaagggctaaattcccattttccaactgttaaataaatagataacttgtaaaagtaaaaaaaaaataagaagtaacaatatagacatgctatttagtcattccagtcaataacagaaaaatgaactaagaatgaaaagttatttctgtgcagaagggaagttggagctactgatcttttataccaaggcttgtggtttatgatgaaaattgaaaaaaaaaatcaggtatacaaaaactgtattagtccgttttcacgctgctgataaaaacatacctgagactgcgcaatttacaaaagaaagaggtttaattggactcacagttccccatggctgggaaaacctcacaatcatggcagagggcaaggaggaacaattcacatcttaagtggatggcggcaggcaaagaaaaaagagctggtgcagggaaactctcccttttaaaaatgatcagatctcttgagactcgttaactatcatgagagcagctcaggaaagacccgccccctaattcaattacctcgcaccaggttcctcccacaacacatgggaattgtgggagttacaattcaagacgagatttggatgaggacacagcgaaaccatattaaaaactcataaaaaaaggagaggcaacaagtcatgaaacaacactactactattaataatataggctcatattaatcaagcactttctatgtgccatatgtggattgtgtctttgaatccttactacaacagtatgagggaggctctttttgagttactgtagtctaatgagacaatttatacttcgagagttgattagctacctattgtaatgaaggattctaaaacaacacctggaaacaacagacattatcatctcagagtgtctctgggaccgtaagcaacttagctaggtggttctgtcttggtctctcatgcagctgcaaaaaagatgtccacagggctgctttcgttttaaggcttgatatggggatcttgctttggtgcccattctcagggcatgctaccaaaacttccaggctcactcctgtgggcctcttgcaagggctgccttgttacattggagttggcttctaccaccgtgagtgacctagaacacccaagatggaagtcactgttgttttataatctaatcttggaaatggtatctaccacactatcatattctatttgttagagcaagccagtaagtccagcccacttggagggaggatgtgattttgtcagcagaacatgaatcccaggaagtatctgtccatcacgggaattaccttagaggttgcctagcacaggtggggtagcttgtccacgcttccacagggagaaaggggtagccctgccaggaaaaaccacccattctgattccaaggtttatgttcttaactactatgcaactgctcacatgctgtggggtggtgtttcccttttgtgggacaacagcaactccttccacatagctgtcatcccgggaatgtgggagtggttgggaggtcaacatagacaacagctgattttcacctttgtgacaaacacccaagggcattatcaggtttaggcaaacaaaaataatctgtacattatgctcacaatgtggggcacagattgtggcactcccacatacctcctgctgcggaaagtttgctggaatgcaagagagaatgccatgagaacaaggataaccttgagttcactctaatttataaaaagtcaaaccctctcaggcttcataactttcctggtaataaattatttgagccacccctcacatttgatcatgacaaactgcagcttcctcttcctgggatgggacattagtcacaaggggcaggagttggctaggagaggagttggtactatatcttgaaagctgttgggagccactgaaatgtttaaagcatcatagggtgacatgattggagatgtagctgctgctctgagcaacagcattttgtctgaagcatcagacaacattctatattctcatatatgagacagtagatgtctcctttatacccccaacagatttattcatgttagcctaataaaatttatatatttcccaaacttgcagatttatcaaagctccctatctcaggacacctgaacctgcctctatctgagcatgcagacttttgtggctgccaatcaagctgtgagctttctggggtagagatttattgcctcctccatggttccatcctctggtggcaacctcatctgttgacacgtattaggaactcagtaaatgcttattaagtcaaaataaactgaacttcgttgtgcacttactacatgttatgtactatacttagtactaggtacataaaaataagacagtctgggccaggcgcagtggttcacacatgtaatcccagcactttgggaggctgaggtgggtggatcacgaggtcaggagttcgagaccagcctgatcaatatggtgaaaccccgtctctactaaaaatataaaaattagctgggcgtggtggcatgtgcctgtaatctcagctactcaggagtccgaggcaggagaatctcttgaacccgggaggcgagtttgtagtgagccaagatcaagccacggcactccagcctgggcaacagagcagactctacctcaagaaaaaaaaaaaaagaaaaagtctttaattagtaaaaagccatactgtatgtaagcagtaatttttttaattcatgagtcaaacattggctcaggccctgctgtgattgttgcactctgctagatgctggggcacaacatcaaatgacacgtgaccactactcttacaggttctgtaacccattgaaagagacacaatggtatttggatgatccaagctcagtatacagtgggagcaaggaggaaggtcatagagataagcaaagaggagggccatgtaagaggtgaggggccacattttgagaggcattacctctgcactgattttaaaagaatgaatgaatttaaataaatggaaaataaggctgggcctggcggatcatgcctataatcccagcagcttgagagactgaggcaggagaatcagttgaggctaggagttcaagaccaacctggataacagagtgagaccccatctctataaacatttttttaaaaaaattagtcagggtggtggctcacacctatactcccagctactcgggagactgaagtgggagatcacttgagcctgggagtttgaggctgcaatgtgccgtgagccgtgatcgtgctactgcagtctaaaacaaataataataaaaagagagagagagagagatgaatggaaaatctgaatgtcaaacatcagtatcaagccactggtactggtgtgttaaggcttggggaaaaagtcaaggatatagaaggagggaaatgaatacacatagagcaaatctaagtaggagttactgattcctgcaaagggatatgcagagccaagcaaagttttatctctgctgcctttgtctttccagccatctacgagcaatcctgcgaggtgtacaggcaccaggggaatacagccggcttcttctacatcgactcagatggcagcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactcaaaaacagaaagaaaaggtaaataagcaaacaaacaaacaaaactccaaatcagtgggaagccctgactcaggaagctggaaagcttgattccactctggccccaagggatgcatgacccttaggtgaatactatagtttctctgagctttatcagtgaaatgagaataatagtggctacccccagagctgtgagaattagatacaatcatgtgtattggagcagctagccaggctggttgttcttagatgcctaaccaaaacaaaacaaaatgaaaaggtgagttttttcatttttctctggaaatttcttgatagcttaaacttatttctcaaatgcagaaggacatggtaagaggcaatcattacatgggcttagaaatgacatatgatccttaatttaccatgaaatacatttccacaaaaccaaatcttgaggtaatcattatttaaaaatccagctatgcagccaggtgcgatggctcacgcctgtaatcccagcactttgggaggcctaggcaggcagaccacgaggtcaggagatccagaccatcctggccaacacggtgaaaccctgtctctactaaaaatacaaaaattagctgggtgcggtggcatgtgactaatcccaactactcccgaggctgaggcacgagactcgcttgaacccgggagacggaggttgcagtcagccgagatcgtgccactgcactccagcctgcgacagggcgagacaccgtctcaaaaaaaaaaaaaaaaatccagctatgcaagcactcctattatgagcatcattaattggcacacgcacattttttgtttgtttgtttgtttcaagcactggtcttcagagatgccagctgcatcatgtaatgaagcaggaacgtaggggcctctttaggctcattgagccttcaggcctcaggattttctgcaacaaagcaaccacatttatggagtgctttctgtaggcagacactgttttagatacagagggtatgaaaagtaagacacagtggctgttgttcatgaggcagtaaagtcaggaacactaccgtgaggtatctccagctaaatgcaagaaaactattggaaagaaatggtgagtaaggaagcacagtaatttgcccatctggatacaaagtcctatgctgtctgcgtagaaaatgctggtgacctggcattgggtgccacgtccttgcatttccgtaataactttctttatctctccaaaatggttgtatgatagctgcttttcaaaagccctgtaacataattagaaattgtgctcctgttgtcttttcatggttgtggtaacctatagtgttcaacaacctggtcaaaaactaggcttctcagtggatctcggttattttaaaaatgtaattaacatatggactcttgctaaaaaggcagatttcccagccccagaaattccaattcagtaaatgcacttttactgagcttttcaagtgattctgatgcaaattgtccctgttccacttttccaaaaaacagggaaagtaatttggctgcaaataaggcaaaagagataaatgcccactgctgagtggccaggtgtgacttgtaataataagagtggtataatggacagcaattactgagcttcgactctctctgggaattgagctgggagtttacaaataccatctcttttcatcctcacaacaaaaatcagaggcagacattttttttatctccatctaacgtagaagggaagagaatatgagcatttcatgactggctcaaggtaaattctgtgactaacagtcaagacttaggaagcgggcatagccttctggttcagtaataattcatatcactaaaatgttaattggatatgttctattacatacattttgtttttaaagtgttgttttattgttagaaaattttgtaacaataattgaagaaattttgagggaaaaaagtatgaaggaaatattaaagccaactgtaatccgcaatccagagattgccattgttattaaattattagaatttcctcaagacattttaaaatgaatgtttatgtgtgtttttgctatgaatgtgtatgttatatatatacatacagacacagaaatatacatatacatttaaattataaattttaattttaatgtgttgtgtagattttccctattaaaatatatattgaaattaagataaatatagcttagaaatgttaaactcttcaaaataatgcaaggacaaggacttagagagtctgactgatacataggtttcatgtacatgaaactctctgcctcaccatccaacagccttctcccagggtttatgtttgatcatttgtccaagaatggctaaaggtgagtgtgtacttgtatttaaaggttactgttttgctgatatgatcctgaagaaatcagagcctctgaattgtgtcccgagttgatcagcttgatgcgtatggtggggtatttattttgaatatgatttttttgggtcatattcagctgcacgatgtctaactttctgtttttgttttttaaaatacctgcaaaaataaaagcagaccaggcatagtgattcatgcctgtaatcccaacactttgggagaccaaggcaggaggatcatttgaggtcaggagttcgagaccagcctgaccaacatggtgaaaacccatctctactaaaaatacaaaaattagccaggtattgtggtgcatgcatgtagtcccagctacttggaggctgaggcaggagaatcacatgaacctgggaggcagagattgcagtgagccgagattgtgccactgcactccagcctgggtgacagagtaagactctgtctcaaataaataaataaacaaataaaaataaaataaaagcaaagctctgtgtaggctgaactacacaactctcatatttaaatggaaaacaattttctgatacatacatgtaatgatgatcaaatatgcatctttctatttgaaaattttataagttgaatgttgttaaaacatgagtgacttatcacagtatgaaaagtgtgacacagtggtccagggaagagagtcaggaagaagggagagaagaaacagaaggaaacttgtgctatctttaacactgggataatcccagaatgggtgtccagagcaccagaaggcaggaaaaccaagctctctttctgcaccttgtgcctgtcagctcagttaagtgcctggggcccaagcccacatctgtaaaattaagatctgggtcctctggcttccacagcctttcctcgttgagaattctctgagcttttctttgaggttccagagaaaagagacttttcttctaagaagtctacagatacttgcaaatggatgtcatgggactgaagatggacaggtttccattgtagaaagcaatagtacatttgagtcccagctgtctcctcttacagtgcaccctggggaacgttagctcccccttcctatatgcaaagtagtccctaacctgtcctgggagatgtaagtctgtgcatctcacctgcacacagggcagtcttcaggaggggagttccccaaatgctcaaccagcaaccaccctatgtaatgtaaaaagccataatctctgtgaaaggaaattaacttaagggagatgattaagcttactgataaagtggactgaatctggacctccgcacacttttgacggggtgccatccttggaactatgttctaagttgcttcaccacagggctatcagatgggagacggggagagcacaatttttggttggagaattgagtgaagtgatggataaggaagttaaagagtaagcttccagaggaacacacacttgtcagacttttaacaatttttttaagtgatttacaataaggttcagccaatataattttactcaatataaatttgggcattgtgggcactgtgaaagtgctgtagttttaatagtgtgtctatattagtttcctagggctctataacaaactacataacactggttttatttcacaccactgcaataaaatgagtatcacaataaagcaagtcacatgaattttctggtttccaagtattaccgcaaaggggtcctgatccagaccccaagagaaagttcttggacttcactcaagaaagaatttggggagagtctatacagtaaagttaaagcaagtttattaagaaagtaaaagaataaagaatagctattccataggcagagcagccccatcggttgctggttggccatttttatggttatttctggattatatgctaaacaaggggggatttatcatgagttttccaggaaagtggtgggcagttcccaggactgagggtttctcccctttttagaccatgtatgataacttcctgatgttgccatgacatttgtagactgtcatggctctggcgggagtgtctcttagcatgctgaggctattattattagtgtataatgagcagtgaggatgaccagaggtcagttttgtcaccatctcggttttggtggtatttggccagcttctttgcagcatcctgttttatcagcaaggtctttgtgaccagtatcttgtgccaccctcctatcacatcctgtgactaagaatgccttaacctcctgaggatgcagcccagtaggtctcagccttattttacccagtccctattcaagacggagtcactctggtttaaatgtctctgacacaagttcatataaaagttatgtttacactacatggtaaactattaattgtgcaatagcattatatcaaaaaaaaaaaaaaccaaagtctatgtcttaattaaaaaaatactttactgctaaaaaatgctaacaaccttctgagccttcagtgagtcttaagagaccccatcatttttgctggtggaggaaaaagatgttagtggctgctaactgattaggatggtggttgctgaaggttggggtggctgcggcaatttcttaaaataagactacaataaagaatgtcacataattgactatttcttttatgaaggatttctgtgtagtgtgtaattttgtttgatagcatttcacccacagtagaacttctttcaaaattgaagtcaatcattccaaattctgccactgctttagcaactaagcttgtggaatattctaaaccttttgttgtcattttaacaatgtttacagcctcttcaccaagagtagattccatctcaagaagccactttatttgttcatccataagaagcaactcctcatccgttaaaattttatcatgagaatatagcagttcagtcacattttcaggttccacttctaattctagttctgttgctatttccaccaaatctgcagttactccctccactgaagtaatgaacttctcaaaatcatccatgaggactggaatcaacttcttccagtctcctgtttgatattttggcctctcccataaatcatgaatgttcttaatgagatctacaatggcaaatgctttccagaaggtcttcaatttactttgcccagacacatgggaggaattactatctatggcatttgtagacttataaactgtatttcttaagtaataagactgaaaagtcaaaattactccttgatccatgagctgcagagtaaatgtgatagcaggcaggaaaacaacattaacctctttgtagatctccatcagagctcttgagtgacctggttcattgtccataagcagtaatattttgaaagaaatcctttttttgttgtttatggacaggagttctcaatggtgggcttaaaatattcagtaaaccatgctgtcaacaaatgtggtcccatccaggctttattattccatttagagagtacaggcagagtagatttagcataattcttatggatcctaggattttgagaatggcaaatgagcattagcacttgcattagtccctaccaagagatacagcctatccttggaagctttaaagataggcattgtctttcttctcttctctacctctgataatcttagatggcacctattgcttagtgtagccactttcatcaatgatctttgttataccttatgggtaacttacatcagcacttgctgcttcaccttaaacttttatgttacgaagatggcttctttaattaaacctcatgatccggcctctgctagcttcaaacttttcttctgcagcttcctcacctctctcagcctttatagaattgaagagggttagggccttgctctgggttaggctttggtttaacggaatgtcgtgcctggcttgatcttctattcagcagctaaaattttctccacatcacccagaaggctgttttgctttcttatcattcacatgttcactgaagtagcattttaattttcttcaagaacttttcctttgcattcacaacttggctaacttgcacaagaggcctagcttttggtctatctccactttcaacacaccttcctcattaaggttaatcatttccagcttttgatttaaaatgagagatgtgccactcttcctttcacttgaattcttagaggttattgtggggttactatttggcctaattttgatattgttccatctcagggagtagggaggcctaaggagaaggaaagagacagaaatcattggccagtagagcagtcagaacacacaatattggtcaattaagttcattgccttatatgggtgcagttcatgatgccccaaaacaattagaataataacattagtgaccactgatcgcagatcaccatagcaaatgtaataataataaacaatttgaaatattgcagtggtggattcgtggctcttgccaatgttcaggctctaaggatataacaatgataataatataatataataacgataattataataataatatacataaattaccaaaatgtaacacagagacatgaagtgagcacacaatattggaaaaatggtaccgacagacttgctcaacatagggttgccacaaatcttcactttttttttaatgaactatctgtgaagcacagtaaagtgaagttcaataaaacaagctatgcttgaaccagagactgggtgacttataaaacagaggtatattttctcacagttctagagcccagaaatccaaaagtacctgcagtgccacacttcctgttaaacctgtagggtgaatctcttcttgccacttcctagcttttgatggtttgctcaatccttggcactccttcacttgcagcctcagcactttaatctctgccttctagagattgctaccctgccttcatgtgatgttgtcacgtggccttctcctcccatgtgcctgtgtgtccatttcttttcttcttacaaggatacccttcatactggattaagcccaccctaatggagtgtgacttcatcttaacttgtttacgcctgtaaagaatctctttccaaatagattacattcacaggtacggagggttaggacttcaatatattatctttctggtgacaaaattcaacccttaatagtattatttcagtcttcttcacagactaatcaaggagatgacacagcagcaattaacgtataaggacaatgacaaggtgtgcatagtgcttgttgggagctcacaggagagaccctaacctagcctggtgtgcagtgggaaggctactgggcagcagataatgcctctgaaacctgaataggagtagaagctggtcaagagctgcaggaaagcatttccaggaagacagaatgaagggcaggaacaaaggaccagcatccctagaacctgcatgtttttaggagtcaccaacccactgagctgacttgataggttggaacccagaaaatctcataaagctgtgactgaacagaagagaaaggatcaaattgacttgagcagcagcaagcaaaggctgttgaagctctgtaatctgaactagagtttcccagcacaaacatctgctgtctcagattcaacagaatagaaaaggaggaatggctttatcatagatagctcttcagcatgtgagactatttagctggccctgaaaaaaattaaaaaaaaagatgagcaacagactaagaggtagcaacaagatgtcctcacagcatgcatggaccttagcactgaccccatatcttgaggacagtggatctctcgtatggcttgttcaaattagggactattcataaaggtgtgaatatataaaaggaatttatagtgtagggactatagcacagagatactaacagagtgggaaaaaggcacatgttcagaagctgtgcctctggagatctgtggccccctgtgtgggaagcagccagctcaatccagtgaccactttgacctcagtctctcgttgctccttctaggctcctttctatgctcccctctgatgaaacccaactagaatcgagaatgcaggagtgcgtattgatagaatgcttttagtcagccttcctgcgcacagagaaggctggagatgtgcagaaagtggaactggtggggcaagtggaagatttccatattgacctgcttaaaggactgaccaaaaacgtctggggaaaatgattaaaattcataagaattaaggatggtggtgagggtaggggctgtaagtggaattcacaaaccatccaaataaatgaagcgtagacttgttaaatcaattttaacctgaacaagaaaagaccactctttatgggttaaatggcactaaggttagaatgaatgtaagaaacacacactgaataagatatttagaaaatgacctactccaagatttaatacaggtactcaatttataaacaacctagaaacaagtaaataagtaagaaaaactgtgacatgcttaaacgtaatattttgtcaaaaggtagttctcggcttcatacctccatcggatgataaaaatctggaatggatgcagagcatttcagccaatgatgtaggagtttgtgatcatcctttgctgcaccaatctaattgggtcggtagggaaagatgcatttgagacaaccaggagtccactggggactaagaattgggtttctggatgaaaatgcacataaggagaccttgcaggatgggtgagatgtcaccaggaagaaaaggagttcttggaactgggtcccatataaaagaaatggagaaagagcaggtcacagtaactaattgaaatccgtgaacacctgaggtggctgtataggaagcttgggttgataaaacagaagaatcggcttctgaggtggggcgatctgcccttggggtgatggttaattttatgtatcaacttggctggaacatggtacctaatatgtgaacatactgtcctgaatgtttcctgtaaaagtgtttttggatgagataaacatttaaatcagtggactttgagcaaagcagattgacctccataatggggatggacctcatccaatcagttgaaggccttaatagaacaaacactaacctctcccaaatgaggaggaattctgaaagcagatgtctctggtctggaactgcagctacttcctgggtctcttgtctgccagcttcccctgcagattttgggcatactaaaccttcataatccaatttcctgaaaatcaatctccttctctcactgtctcattcatatatatatatatatatatatatatatatatatatatatatactccttctctcactgtctcattcatatatatatatatatatatatatatatgtagtgcacacacacacagtttagtttattcaggtagttctgtctctggacaaccctgactcatccatttgggtgtctcaagatgggtttaatgcccctactctgtgttctgctcatgacattaatcacactgcattataatgcagtgtttacctatgtgtccccacagggctgtgagctccttgttggaaaataaggaacagggtgtgatgaatctttggatctacttttatacacacttgaatgagtctagtgtaaattgaactctgagaaatcactgccaaattgaagactaatttctatctttcccgtttttttctttcctgtttccataatctatctttgactcaagccctgttccattaaatcaataacagtttgggatgttggaaacagcctcagtatttaatcttgactgagcttgagtcattcctactctttgcaatgccttctataagtccaagagtacagagtgcccatctgttcctcactgccttcatgactgtttgttgctgctcaacctctctccaagttgctgtttccttcaaacatagaaatgactaatgggtagaaatatgatttggagtcacactggagtttaaattctagcacattctagctgtatgaccttggataaatcatctaatatttctagatcttggtttttctagctggatggccttggataaatcatctaacatttctagatcttggtttttttatcagtagtgtggagacaataaaaaattggtgacatgtaagattgtgagaattagcatatatatatatgctacacacacacacacatgcacacacacacacacacacacacacacacatatatatgcaaactttctagccttaaaaagtagatggtcatttaatatgctaatgtaatgtcatggtgtgattattaattgtgtctacaaccactcttacagttgacatagtatgaatgatattacatagtcattctagtcatgaaagatagctatcacctttgccagcgatagaaatagaatctttacttgtataggcaccatgagatttcagaggctcttggagcctggagagagcatttctgctgggactccttcaatattgataaaacagaattataagggtgaggcaccctgacaagattttccttgaaacttgacattaaactgattctactcagtttacattgtgccttttttaatgttaacaggacacactgtcaatgtgttaaaagatatttcttagctgtatactgtttttcctttgtacagtacaattgtacattgatatgcaaaattgtttgtctagaatcactagcaaaaacacatttatttcttatcttgatggattcaatgccaatttcatgcatgtggatctgtaaggcaatcatcaggcattacaaggaatttgcaaggaacatttagtcaaatctctaaagcgaaacttattttccattctcaaacagctcataatccatttgcaaaccaacttacaagtctccatatcttgtcactctggctattatgatgctctgtttctcactcctttggcagcagcctctgttttcattaaaactcatcaaagcatgcataatggagtaggtagaaagctgcaattgaggtctctccaatatttctgcacataattgtgcagtgtgattgcagtaatagattatcatcccaggtattgacataaagaaagaaatgtatccatgtggtttggcctaaattggtagccttgcttcctgaagttagagcgatgtcagtgaatttacctgtgggctgcacccaggtctgccagtgtaggggaaatgagaatgatccatgacataaaatgggaccactggttatgaaacatttatttctccccagccttcttaggatgttgttaattttgccagctgtatcatatagcaaagtaagtagaatttagttgattacgtgatttgtatctgtaatacaatttggtactggtatctccttgcagattcctgtttgaaaacactctactttctttttttttcttcaacttttattttaagttcagtgctacatatgcacgatgtggaggttttttacataggtaaacgtgtgccgtgatggtttgctgcacagatcaccccatcacctagatattaagcccagcatccattagctattcttcctgatgctctcccacccccgaacccccaccctttgacaagctccagtgtgtgttgttccccctccatgtgtccatgtgttctcatcattcagttcccacttgtagatgagaacatgtggtgtttggttttcctgttcctatgttagtttgctgaggataatggcttccacctccatccatgtccctgcaaagacatgatctcatttctttttattgctgcatagtattccatggtgcatatgaactatattttctttatccagtctatcattggtgggcatttaggttgattccatgtctttactaatgtgaataatgttgcaatgaacatacacatgcatgtatttttataaaaggatgatttagattcctttgggtatataaccggtaacaggattgctgggtcaaatggtatatctgcctctaggtctttggggaattgccacactgtattccacaatgggcgaactaatttatactcccaccgacagtgtaaaagcattcctttttctccacagtgtcatcagcgtctgttgtttttactttttaattgtagccatcctgattggtgtgacacgatatctcattggaaaacactctactttcaaaacccacacacactcacacacacactcacacatgcacaagtgtcaacttccattgccctacttcaggcttatacaaaagcaagctgagttcaagttctgaagtttgcttttttatcacaagttgggtaatcatcattgcaaaagtattgttaccacaaagttgtcatttgattacagactgtaaaatattgcacagaatatctacagggtaccaagctagtacaacatgcattatgatgaagtagctggaataatttttattttataagtgcacgaatgaggctagtaagtactagaaacaggataccaattatagctgtctagagatgaagcttctgccctgtatgctgtgctttttatcaaagggtagtaaggcatgggtggcaacacttcctctactatgttgaatcaatattcattggttatctgttctggccaggcactgacaagccactgggaatatagaaatgattaagatatggtcctgcaagttcacagactttataatctcatgtccttgtgggaaaaaatgcccatgtcttcagctttccccatcgtgattcataattcacacaacagctaggctgatctttaaaaaacacagggatggccatgtctccccatcccttccacctctacctgaataaattcccatctcctacccatggcttacaatgtttgaagggcatggttgtgaatctttataagtttatatgcatcaatgaaaactcttagaacagtgcccataatcactacaccttctgaattactatattattgtctaattactttgtggggacatgagtaaaaccctccatctttatactttagtttctctgtctgtaaaaggagggtgatgatgacagctttttatggttgccacatagtcaattgaatgagttaacatgtaaacaatgtcagaaagtgacagtcacagagaaggtgggaaagaaagcctagatccttctccttatcttcttttgcctttccttggaaacacatccactgtctttagggacagcaggtttagttcatcctagggaggagctcacaagctgagtcccctggtggcacaagcattgtttcctggttgagactcactcatgggtgacatatgtgctgtggctcactggtagtttaatcagttggaataatacttgtattgttgcttatatttcagagggacaatttgctttctgtaaatgaagcttttccagaggactattttaggctgaagaatagtaatttaacagcttagaggtgggaatttttatttaagtgtctctcttttctctctaatgggtttatgatgttgaccaaagtgtggtgaccacatagggcttccagaaggctggtctcttaggcgaagctctggagctgctctgcgtgtgttgaagggctgagctttaaagtggtctctctggactagtggcagaaggcataatctcctgctaaattgggccattaaataaaactactaagtcataaagctgtagtattaccctgaaattaaagcattgtcacctttgagttgccaagaattttaacaggcacttagagaaattcctttcacatacccgttttagcacggccagttgactccaacccacatggatggtagcaggaggctcaggtgattgcagtgtgattttaattcatttacttgatcattcattcatccatccctccctttactaacttatttgctgctttcttgaattcctttattatcttctcatttatgtattcatttgttaattctctcatttatttacttcctcatttattttttcaggtttttaattacttacacattattcattaattcagtcactctgtcaattattcagttggtaattcagaaattaagtaattcaaataaacttttgaatattgactgaacttgacatcaagtttacaaaataaataaatctgttcttgtcctcaaggaattcacagtttggagaagatggacattgtaaatggatattttgcacagtgtggaaaatagaatagaagctggtagatggtacagaaatagtacaaaggaaacaggggttgaaagtacacaaggaggctgggggtggtgggcagagaagatgcccttgaagagctgccctctgagctgaattttgtagtagaagcagctaacatttatccagcagctgctggtattaggcaccatgctaggtattttatattcaagatgttatttgattttcttagcaatccatgttacagagataggcaccatctggagagactaagcaactagcccaaggtctcacaaggagcaaacggtaaagccaggaatggaagctatgggtgaggttgtgaggctgggttattaaggccaggtgacacagtctctgaaacagagaaagcctcctgtgtccaaacagaattcccctctggcctgcattgccctgtctcttgttcacagtcccttaactcaatgccatggtggaaaactcctccaggaagtagccttgaagggtgagggctccattatacccactttacctccgtgtccgtcactttcctcatctgtaatgtgggggaaatcatacccacttttccaggttttcctgagtatcatatggaaattatataaagcagaggttcacaaagcttagttttctaaagcatgagctgggatgaacatttaagacgctattttctaggcctattcccagcaatgtttattcagtaggtatagcatagtatacttactacagtatacatagtatagtatacatagtatagtagtgatcagaaatagcatgtttagcaagcacctgaagatactggactttgggatatatctatataaggtgattagcacagtgctcagtgcttaataagtccccatccttatgtatctccccacttccgaggggctcaggccagggcctagaatcgctgctcttctaagcactgaacacagggcttatcctgactccttccggatgggtcttttcatcttttactgcagataactggtgagtctcatttttggcatcaggggattgggagacagtccagtcaacaaagatttattgaggcactgcttgcgtaatgtaagctgctggtccacacacaaaggacctcacactgtaacaagaaaataaagccatccatctcttacagcaattttagctaggccattttatttattcgtacaactatcctgtagcaacttgacaatggaatcctggtcaagttgcctaacttttatgaggcttaatttcctcatctgtataatagaaatgatcacttattcttacctcaatgagttgtacaaaattagatagaattaaataagcaaatgtacccaacacacccagtacaatatctgacatgccctaagacctcctaaaataaaagtaatcacttttatttcagagccaacatcatagaatgatctagatgctaaaggaatttagagacaggaatagtcaaggaagcattatgggagacactaggcttgggtttgaccttggaagacaggtatcctggggtgtgttagtccactctcacattgctataaaagttatacctggtaagaaaggggccgagatggcagaaaagaaacagctctagcctgcagctcccagtgagacgaatgcagaacgtgggtgattactgcatttccaactgaggtacccagttcatctaattgggactgactaggtggtgggcttgacctacagagaatgagaagaagcagagtgggtcatcatttcacctgggagctgcactgagtgggtgtacctccccgctgagccaagggaaatggtgagggactgtgctacctgccaagggtactatgcttttcccatggatttttgccatctgtggatcaggagattccctcgtgagcctacaccaccagggctctcagtctcaagcacaaaactgggtggctgttcgagcaggcactgagctgcaagagtttttacatacatcgggggtgccttgagctccagtaagacaggagaacagtccactcccctggaaagggggctgtagccagggagccaagcaatctcgctcagcaggtcccacttccatgggcccagcaagctaagaaccactagcttgaaatccccgctgccagcacagcagtctggagttggcctgggaccactgagttcccggtgggaggagtgaccatcattactgtggctttagttttcccctgacagtgctaaggagactgggagatttggactgagcagaattcaccacagtgcagcaaaggagctgtggcagatcatggctagatggcttctttagatccctcctcactggagagggcctccctgtaggaaatctagcagctatagtcaaagacttacagaaagagctctcacctccctgagacccagcatctgcggggaggggaagccgtcatctcaggttcagcagacttaatctttcctgcctgccggctctgaaaaaatcagctgatccaaatgaggaggattccccccagcacagcacaccagctcccctaaggggcagactgtcttctcaagcggatccctgaccctgtgcctcctgactgggtgagacctcccaacaggggtcaccagaaaccacagacaggaaaatcccagcggacatcaggtcagtgtccctctaggatgaagcttccagaggaaggagcaggcagcaacctttgctgttctgcagcttgtactggtgatatccaggagaaaagggtctggagtggacccccagcaaaccacagcagacctgcagaagaaaggcctgttagaagaaaaacaaacagaaagcaacaacaacatcaaaaaaaaaaaaaaaagaccccacaaaaaccccatccaaagttatcaccctcaagatcaaaggtagataaatccatgaagatgaggaaaaaccaatgcagaaacactgaaaaatcccaaaagtcaaaatgcctcttctcctccaaatgattgcaacgtctccagcaaggtcacagaacggagctgaagctgagatggatgaactgacagaaatagacttcagaaagtgggtaataataaacatcactgagctaaaggattatgttttaacccaatgcaaaggagctaagaaccatgataaaagattacagcagctgttaactagaataaccagtttagagaggaacataaatgacctgatggagctgaaaaacacagcacaagacaatcataatgcaaacacaagtatcaatagccgaactgaccaagtggaagagaaatggcagagcttaaggactatcttgctaaaataaggcaggccaacaagattagagaaaacaaatgaaaaggaacaaacaaagcctccaagaattatggtgctatgtaaaaagactgagcctactactgattggagtatctttaagagatggggagaatggaaccaagttgtaaaacacacttcagtgtatcatccgggaggacttccccaacctagaaagacaagccaatattcaaattcagaaaacccagggaaccccaataagataatctatgaaaagatctaccccaggacataatcatcagattctccaaggttgaaatgaagcaaaaaaatgttaagagcagccagagagaaaggccaaatcacatacaaaaggaagcccatcagactgacagtggacctctcagtagaaactgtacaaaccagaagagcttgggggccaatattcaccattcttaacaaaaataaattccaacccagaatttcatatctggccaaactaaggtttatgagcaaagaaaaaagtaaaatctttttcagacacgcaaatgctgaggcattttttcaccagcaggcctgccttgcaagagctcctgaaggaagcactaaacatagataggaaaaaccattagcagccactacaaaaacacactgaagtacacagaccaacaacactactaaacaactacattaacaagtctgcaaaattaaccagttagcatcatgacagggtcaaattcacatataacaatatcaacattacattaaatgggctaaatgccccaaataaaagacacagaatggaaacctgggtactaagaccagacccatcagtgtgccatattaaagagacacatctcatgtccaaagatgcacatagaatcataataaagggatggaggaaaatttatcaagcaaacggaaagcagaaaaaagcaggagtagcaatcctagtttctgacaaaatagactttaagccaacaaaggtaaaaaaagacaaagaagggcattacatcatgctgaagcgttcaattcaacaaaaggagctatttaaaatatatatgcacccaatacaggaacacctagatttataaaacaagttcttagagacccacaaagagactcagacccccacacaatgatagtgggagactttaaaaccctactgtcagtattagatagatcacggagacagaaaattaacaaagatattcaaggcttgaatgcagctctaggccaagtggacctgatagatatctacagaactctctaccccaaagcaacagaatatacattttttcctggcaccacagggcacttactctaaaattgatcacataactgaaagtaaaacactcctcagcaaatgaagaacaactgaaattataacaaacaatctctcagatcactgtgcaattaaattagaactcaagattgaaaggtccactcaaaaccacacagctacttggaaattgaacaacctgctcctgaatgactcctgggtaaataatgaaatgaaggcagaaatcaagaagttctttgaaaccaatgagaacaaagagacaatttatcagaatctctgggacacagctaaagcagtattaagagagaaatttataggattaaatgctcacatcggaaagtgggaaagatctaaaattgataccctaccatcacaactaatagaactagagaaccaggagcaaacaaaccccagagctagcagaagacaaggaataaccaaactcagagtggaactggagatagatatatgaaaaacccttcaaataatcaatggatccaggagctgtttttttttttttttgaaaaaaccaataaaatagatagactgctagcaagactaacaagaagagagaagattcaaataaacacaatcagaaactataagggggataccaccattggccccacagaaatataaccatcagagaatactataaacacctctatgcaaaaaaaaaaaaaaaaaaactggaaaacctggaagaaatggataaattcctggacacatacaacctcccattctgaaccaggaataagttaaattcctgaatagaccaatatcaagttctgaaattgaggcagcaataaatagcctaccaaccaaaaaaaaaagaatcccaagtccagatagatttatagctgaactctaccagaggtacaaagaggagccggtaccatttcttctgaaacaattccaaacaattgaaaaggaatgactcctccctaactcattttatgacaccagcataatcctgattccaaaacctggcagagataaaacaaaaaagaaaacttcaggccaatatccctgatgaacattgatacaaaaatctccaacaaaatactggcaaaccaaacccagcagcacatcaaatagcttatccaccacgatcaagttggtttcatccctggcatgcaaggcttgttcaacatacacaaatcaataaatgtaattcatcacataaacagaactaaagataaaaaccacatgattatctcaatagacacagaaaaggccttcaataaaatttaacatctattcatgttaaaaactctcaataatctaggtattgaaggaacatacctcaaaataataagaaccatttatgaaaaacccacagccaacatcatactgaatggacaaaaactggaagcattccccttaaaaactggcacaagacaaggatgttcttcctcatcactcttattcaacatagtagtgttgggagttctggccagggcaatcaggcaagagaaagaaataaagggtattcaaataggaacagaggaaatcaatgtctttgttttagatgacataatcctgtatctagaaaaccccatcaactcaacccaaaagcttcttaagctgataagcaacttcagcaaagtcttgggacacaaaataagtgtgcagaaatcacaagcattcctatacaccaacaaaagacaagcagagagtcaaatcatgaatgagctcccattcacaattgccacaaagaacataaaatacttaggaatacagctaacaggagaagtgaaggacctcttcaaggaaaactaaaaaccactgatcaaggaaatcagacaggacacaagcagatggaaaaacactacatgctcatggataacaagaatcaatatcatgaaaatggccatacttcccaaagcaatgtatagattcagtgctatttccattaaactaccattgacgttcttcacaaaattacaaataactattttaaattcatatggaaccaaaaaaaaagctcgcatagccaagacaatcctaagcaaaaagaacaaagctggaggtatcatgctatataacttcaaactatactacaaggctgtagtaaacaaagcaatatggtattgctacaaaaacaggcatatagaccaatggaacagaatagagaattcagaaatgaaaccatacgtctacaaccatctcatctttgacaaacctcacaaaaacaagcaatggggaaaagattccctatttaataaggtgctgggagaactggctagccatatgcagaaaatcgaaactagatcccttccttacaccttatacaaaaatcaactcaagatggattaaagacttaagggcataacccaaagctaacaaaccctagaagagaatctaggcaataccattcaggacataggcaaggggaaagactttatgatgaaattgccaaaagcaattacaacaaaaccaaaaattgacaaatgggatctaattaaactaaagagtttctgcacagcaaatgaaactatcatcagagcaaacagacaacctacagaatgggagaacatttctgcaatttatccatcgacaaaggtctaatatccagaatctacaaggaacttaagcaaactcacaagaaaataaaaccattaaaaagtgggcaaaggatattaacagacacttctcagaaaaggcacacatgcggccaataaacatgaaaataaagctcaacatcactgatcattagagaaatacaaatcaaaaccacaatgagatactatctcacactcatcagaatggcattattaaaaagtcagatgctggcgaggttgcagagaaataggaatggttttatactcttggtgggaatctaaattagttcaaccattgtgcaagacagtgtggcaattcctcaaagacttagaactggaaataccatttgacccagcaatcccattactgggtatatgcccagtggaatgtaaattattctattataaagttacatgcgtgcatatgttcaatgcagcactattcacaatagcaaagacattggaatcaacccaaatgcccatcaataatagactggataaagaaaatgtggtacataaacagcacagaatactatgcagcaataaaaagaaacgagatcatgtcctttgcagggacacgaatgaagctgaaagctgttatcctcagcaaactaattcaggaacagaaaaccaaacactacatgttctcacttataagcaggagctgagcaatgagaatacgtgggcacagggaggggaacagcacttattggggcctgttaggggaggtgggggaggggagtgcattaggggaaaaatctaattcgtgctgggcttaatacctatgtgatgggttgataggtgcagcaaaccaccatgacacatgtttatgtatgttacaaacctgcacatcctgcacatgtaccctgtaacttgaaaaaaaaaacaataaaatgtttgtttaaaaatatacctgagactgggtaatttatttttaaaaagaggtttcattggctcatagttccacaggctgtacagggagcatgatgcttctggggaggcctcagaaaagtttcagtcatggcagaaagggaagcagaagcaggcatgtcttacatgtccaaagctgggggaagagaggcaggcagggaagtgctatacacttttaaacaatgagatctcatgagaactctatcatgagaacagcactaggagaatggtgctatttaaaaacccaccccatgatccagtcacttcccaccagaccccacttccaacattggggattacaattgaacaggagatttgggcagggacacagctccaaatcaaataattctgcctctagcccctccaaatctcatgtccttctcatatttcaaaatacaatcatgcctacccaacagtccccctaaattttaactcatgttaacattaactcaaaagtcctcaatccagtgtctcacttgagacaaggcaagtccctttcacctatgagcctgtaaaatgaaaaacaaatttgttactcccaagatacaatggggttataggcatttggtaaatagccttattccaaaacagagaaattggccaaaagaaagggggtacaggcaccatgaaactcagcagggcagtcattaccttaaagctccaaaataatctcttttgacttcatgtctcacctccagagcacattggtgcaaggggctagctcccaaggctttgggaagctctgcccctccggctttgcaaggtacagcctctgtggctgctttcacagactcacagtgcaagctgttagtggatctactatttgggggtctggaggatggtggccctcttctcatagctctactaggcagtgctccagtaaggactttgtgtgggggctccaactccacatttcccctccacactgccctagtagagcttcttcttgagggctctatccctggagcaggtttttgcctggacatacaggctttccaaataatttttgaaatctagctggagtctcccaagcctcaattcttgtactctgtgaaccctcagacttaacaccacctggaaaccaccaaggcttatggctcgcaccctttgaagcagcagctcaagctatatctgggtccctttaagccacactgaagctgaataggctaagatgcagggagcaatgtctccaggctacacagggcagtggggccctggtcccgacccatgaaaccattctgtcctcccaggcctccaggcttgtgatgggagaggctgccatggaggtctctgaaatgtctttgaggctttcccattgtcatggatattaatattctgctcctctttacttatgcaaatttctgcagccagcttgaatgctttccctgaaagtgggcttttcttttctaccacatggccaggctgcaaatttttcaaacctttacactctgctttccttttaaatataagttctagtttcaggtcatttctttgctcatgaatatgagcacatgctgttaaaagcaagcaggccacatcgtgaaagctctgctgcttagaaatgtctttctccagatactctaaatcatcactctcaaattcaaaattccacagatcccaagagcaggggcacaatgctaccatgttctttactaaagcatagtaaaagtgacctttgctccagttcctaataagtttctttttatatatgatgcacacacaggcacacacgtgtgtgtgtgtgtgtatacatatattttttaaatgaggcacggtatcactttgtcacctaggctggagtgcagtggcatgatcttggttcacagtagtgttgacatctgggttcaagtgattcttctgcctcagccccccaagtagctgggattacaggcatgcactaccatgcctggctaatttttttttgatagagatggagtttcaccatgttgctcaggctggtctcaaactcgtgagctcaagtgattcatccacctatgcttcccaaagtgttaggattacagatgtgagccactgtacctcacgtaataaatttcatatctccatctgaaatctcatcagcctggatattattgcccatatgactcagaattttggtcaaaacaatttaacaagtctctaggaagttccaaactttcctgcaccttcctgtagtcttctgagcccttcaaactgttgcaatatctgctgattacccaattccaaagttgcttccacatttccaggcatccttagagaaattccccattaccagtaccaattttctacagtagtccattcttgcactgctgtaaggaaatacttgagactgagtaatttatcaggaaaagaggtttaattagctaacagttccacaggctgtacaggaagtatgatggcttctggggaggcctcgggaaactttcaatcgtaatggaaagtgaatgaaaagcaggcatgacttacatggtgggagcaggagaaagagaggttgtagggagaggctacacacttttaaacaaccagatcccatgaaaactctatgatgagaacagtattcgggaggatagtgctaaaccattagaaattgccaccatgttccagtcacctcccaccaggattcatctctaacattggagatgacaattgaacatgagatttgggtaggaacacagatcaaaccatatcatggggctaggcaaagaagggaaaccggaggaaagacaagccttgttgagctcagcaggatcatgaatgcagagatgcaatgagaaggtccatcaagtcctcctgacttccctgggtgttctgatggtctgatgttggctgaatgaatacttttcctgtttggaagtggaaaataacaaatgggtgtcaaaggtgtctcccagaaagcctgcttgctcttgttcacttttgttctgagccccagtttccaaggagagatgatgaatcaaagtaagtctagacattccaaagaataaaagggccaagattgactgtggtccttgttctgggaagtaggcaggccaagcaccccttgcttgagagctttttcttactattcctcctgagcaggctcacgtcacaggaacaccaatcagcctgcattctcagtgtgcatgtgtttgagttctcatatttatgtctatttgtaaagagaagcaagtaggagacattgactgattgctgtccatagggacaatttcaacatgggttttccagtgctagctgtgagtagtctaacttttatgtcttacaggaagttttgctctccctctttagagtatgctgtcattttgttctcatgtaaagctcctttgaaagtcacaatttttatgcttgtaattgaaaaacatctaccaagttagttatttagagtgtgggcttggtaggaatcccagcactcacatttcctacttttggcaaattatttgacttagttgagttacccagcctccttatacctcagtttcttcctttataattaatcatagaatctatttataagtttgttgtgaagcttctatgaggtaatcgatgtaaactgcaagaaaaaagacttgacattacatatctaatgcatggtagatactgttagttattattttcattattctgtccccagaaatatagactctggtttcttggtgtttctggggacatggtgataaaaataatgactagtaactttttttgtgtgcataacacctgacacaatgaaagcactcatgaaaattaattcaacagagtgaataactacttatacttgaacatgaatgatctaccataatgtaaatggttaaatttaataatgattgtaatttagtttaaatttagtaatagctttctggtcattattttgccaattactccttaactctgtgtgtgtgtgtctgtgtgtgtctgtgtgtgtatgtgttggtgctgttataaaagcatgtgcatgtgaattttttggagcttagaataattttcagcacttactacatgtgaaactttctggcaaactatcttgttttcccagagttttattcctaaatgtccaaacctacagaaaagttgaaaaaataatgagtagccagatacccttcacgtttacgattctgccacatttgcaaatttgtgccctcctcatctctttctctttttctcctctcctcattttctcagacattttaaaaaaatttttacggaaccatttgaaagtaagttgtagacacagcgataatttaaatcgaaagactttaggttttatcttctaagaacaaatatattcttctatgtaaccagacataagaaaccattcataagaaaataagcattaattaaattaattatccaatatatagtccatgcaccaagaatccaaagtcctacaatgtgttttatagcagtgtctattttcatatttttattcataattcaagcagtgtctacaatttggaattgattgccacgacccttcaacctcctttaatctggaaggcccaactccctgaccccttctttttgcttttgttgttgttgttggttggttggttttcatgacattgatcttttctggagattaaaagacagttgttaaataaaatatcccatactttggatatttctgattatttaatcagtgtagaacattttggccagaaagtctcatgaacaatgcttgcctttttagtgcagcccgtgagcagacacatgacatcagtttgtcccgatactggggatgcttctcgctatcatttggctaacacagctctgccagatcgttgcattgtgaaggcagtttacaaccagtgagtgagttatctgtagtattacgtgagcacactatgtgaatgccctgttcctcaacatttcctcccaatatggtagggatcctgactcttttaagttattacactggaatctgtgacgtgttgcttttctaattctacaatttcctttcatatttattgctgccattctgaagtcttacctacagaagagatttttttccctttccctgactccatctccccttgtgtcgttatggactctaattcatggtccctttaattctgctccagtttcttttttacatgtgtctattaatattggagcattttcttgtgttcttgcatggaaagatattctcaatgtcaactagaactttccctaccctagaaccagactcagctcttttcctaaagaagcctacctcttttttgtagcaaatggtatttggaaaccaagacctagatgtttgtttgctcattgtttctgggccctttcagtgggcagaactaaaattgtgtgtgtgcatgtgtgtgtgtgcgtgtatgtgtgtgtgtgtgtttatgagttcataaggttatttacaaaacaaacctagttccattagattcttttctcatcattctgtcttctatatatatatgatatatatgagatatatataatacatatatatgatacatatatatgatacatatatatgtaacttctctcacagtgagaccttgtttcagcaatgtcagtatatttacccatttgctccattctgcagtatgcacacaatcatttcagaattacttcagcaatatcacatcaataacaatgtaaagttaaagatttccttgaattttaatttttatccttagaatttattctgccaagggtatatagtgagacagaatactatttgaaagttgcttaaattaacttttttcttttttatagttattttatcaatttaatgtacagctaggctttttagtttctgattaatattcaacttttggacttgccttttctttatccttttgattttaacagtgtaaagcattttcatgttacaaaagtcaaatacagacaaatatgcacacactggctgatcagagacattttgctctcattcctattgccttcatcttgttcttatccaacttttttagataactatttatatcagtttgtcctttctgtgtgtattcatttttctcttttgtaccttcacaaaatgtatcatactcttttgtgcatcaataccttgattttgtcactttacaatatacagtggaaatcattctggatcagtttacagagatcttatgtattatttattatggctgcattgtactttactgtgtcagttaacaatgctttattcgatcagacacctatggatgtgtatttaatttttttccaatattccgctatttgcaatatataacctcggctgcacagcggaatttcaagtatgtatctaaacatcctttcccaccatgtgtcactttcatgctgatttcaaaagctgtcactgaagtggataaaaattctggtagtccgttaagtgtttagtagtaagtgaatacctactttaggccatatgttagagacacggagatttctgagacaggttttcatatgtagtacttgcagtatagcatgggatactgaggaaacaggttgttgtaataccatgtaaatgcgacgagcacgggatgttggcaggactggaaaagaccacccgttggagaggccaccagcatcacacaatctcattcatcttgtgatgagctccagagtagagatgtcagctgaaagaaagatgagtaattctgctcttgtctctgagttttctttttgtcaatcccctccagaatcagaatataagctccatgagagcagagtaagtagatgctctcacccttagagaaggcgtctcttcttttctgacccggtacaaggagatataaatgctgcctttggatatctcttcaaaagacaaaggctagccctttgcaatcagctcactagctcatgacgtcctctgagttcaatactggctactttagatcttataaacagagggacaacaagtactattatacttatactattacagcacaacaaacacaagaactgtttattatgaacttgtgttccagtacattatgtacttatgtgggtccccagtcttatcctcagtgtgcaccaaaatagtttctatgaccatgatactcctaatgacctcataaagctttctaatggcaatcaaaacacttatcaacagcctcacagtcctctttccatcaggtgacttagacttagggcttcttttctccttttcctttgccccaaatgccaatacactgagtatggggggaatggtatcttgttcccacccactcccccctttgctgctgcagatactcttcccaacaggaatgcaacacaaggcagtctgccttcctagaaccagctgtgaactccctgagctcagggtccagcctgttagcgaaacttgcacccctcatccgacccctttccagtccctaacatagtgctctgcatacactaggtgtctaaattaaataataataataaactagtgaacaacaaataaacaaatatgatacagtgcacatagaatccgttccacaccactaccccctaagaccataaaacaaatttcccaggtctctttgatcatacctattttaaagcaagaaaaaagagaaaaattacccccctgaaaagatacataaaaagtaaaggctaaagtgaagtgtgaatataaatcagccaagtatgttgtctggaagtcgtaaagtgtggcccacgcaggcaggtggaaggcagtaatggacggagcccgccacgctgcggtgtctgcatggcactaatgcagagcgcatggtagccctaccagccaccctgaaccggtaatgcgcacacctccaaacagctgaaacccagacactaaaagcagccacgtctgccgtggttttagtgaggcacggatggattctcgcacagacagctgggctggtacacatgggagggaaaacagctcctgggggatttctgaagccttttaaaggaattggaaatcactttacaccaattgtctcccttccttttaaaggtcgggcggggggaaggtgcaatgtaccccctcagtaaaggttcccagaagtgtttctaataatgaaataatctcttcacatcctcccggcttcgcttcaacagaacggttcatagcagatcagctttgacttggagtcaggtaccaggtgaagggttaggaaggaggagcaggctgggcccggtggctcacgcttgtaatcccagcactttgggagaccgaggcaggaggattacctgaggttggagttcaagaccagcctaaccaacctggaaaaaccctgtctgtactaaaaaatacaaaattagctgggcgtggtggcgcatgactgtaatcccagctacttggaaggctgaggcaagagaattgcttgaacccgggaggcagaggttgcagtgagccgagattacgccattacactccagactgggcaacaagagcgaaactccatctcaaaaaaaaaaaaaaaaaaaaaagacaaaaaaaaggacggaggagcaccactcagagccagcaccacgctcagttcaaccctatgctttctattcagtgtttatgacaacactgcacaatgagttatgccgtttacagaggaggagactgaggctgggggaggtgataggtctcttgcatgtccaggaatccagtgggtggcagagctggcattggaagccagccctaatgatgacaaagctcaagcttcccctcatcacatctgcctccatgaaccatgaagccctttccaagcctatatttactagcagtcattacctatgatttaaatggagagataagggagaaacatatgaaaaattaaataactatcaatgcaaaatgacaagagatatcacaagattgccaatgagtagatggaaaatgagaggtagagacagtactttgaggattatttaaactgtctttacccttggcatagaaaattcactttgtcaacatagataactacagcagaagtgaccctggggaccttaatatagacttgctctattacaataggagtataagtgaattggcacactgttcaaaggatgagaagcagctccccacagatatttcagttcaattaagctgggtattgacaatctgtaggcttcccttccttccaagcacattgatataaaaattgcagtttttttctggctctgcaaagagacagatatgtgtgtagaatgaggtcttattaatcagagttatttcttgtgtctccttttttactttccttttgtttgctatttcttctgagttgtgatccccatggtaacagatggaattgcttacagcgtctgtaattactattattaataataatgatcatcataatcagaccaatctgatatgatgagagaaaaaatatgaaagaaaattaaattgtggctctgtatgtaaactgtttacggcttccaaaatgagagccagaggaacaaggtaggtcacacagagatgcactagtgaaggctgtctgggagcttttctggggtaatgaccagggaagattttaccacactgatgcgaatacaaaatgtttcagaatattccaccattactactctgctggctctttgtacagcctctttttcttttctctttttgttattgttgagtgtgcgtgtgtgtgtatgtgtgtgttttgatcttttaacttgagacttcttttcagtttggactattacataatacaggcttaaaagagcagcttcagaaatgccgaaactaagaacctgacagtatacaaaggactaattagtttcttcacttgacgaagccatccagaagtgctaactcaggtgctcagtcctagcttaggttctggtagcctgaggatgaaagaccactcttgaccttggaagttctcaaggaaaagagtgcacagacttcactgcgcagggctctctaataacctctacccatgaactttgccccagacagatctctggaaagcccctcttcctttacttgtagtctacagagtatttataacagcctcagacatttgtcattcttgtgtacacaactttctccccagatgatggtaggcttttggagaagttaacatattttcctccagtgtatgtactctggtggatagcagagcactaactgggcacatatttaaacacaaaaatgaattatgcatttcatgtcctaaaagatctcatagctttatgaagaaatgaacttgaaagctcaaaatcacaatgcaacttgggaaatactttactggtttatatatcaatacacagtctgcctttggaagccatggggcacagtatttgatggcccataactcatagttcctttctacatgaagaaggcatgatagctgctctggatctgaatcatgagatcattgacactcatgccaacccactgtgctgaatgcaactttaaaaaagccaatatttcacttagataactattactttcagggaaccagaatgcttagtgaagtggccctatttcctttcccagctaatgatgaacaggttcctgcctattcaaaaatctccaaatgcagtcctctcctaagtaaaagaattgatctgggttagtcaatacatgtatgcctttgagcagtgaaagagaagaggctatgtgtctaattgtgggattgggtagtggtgtgcagtagaagtaatgaaagagaaaaacaaactgggtagcaaaaagtagtatcagagggcaatatttttccaggtttctggctccatgagtactaaagagcaaattatcttgaaggaatttcaggaaatgcaaaggacacaaataaagacagagatacatagggcaattctatagtggaaaaaaaaaacttaacaaggtggtaataatttagtatatacaggagcagctatattacaagaaatcacagtccatcgcacttgttaacctcatttgcagagtatgttccccatcgcagtcctctaaggaatgaagtccaagccctcactctaatgttgtagaaaacttctaatgcttagagtctttactcatttgagtgccagacagtctatgtgcaccaaatcattatgatacttctatggatgcaaagattggtgtaaatatgaccattttccaatgaggaaacctcagaaatgttatgaaacttgccaaaagctttactgctgacatggagcagaacatagattccaatccgaataggattgtttctaaagccaacctgtttcatggtcttattggtgccattgctgcttttcaaatatgaccaataagaaaactgggcattgaagaagtaataatttcatcagggttgctcccacagttagtgttgtgctggcacacaaacccagatttgctgactccagagcccatactttgttcactaacctccactgtccaactaacttgaccatcttgaacatttaagtttgtgggtccaattttcattgaagtcatgtgtgagtccacttaaaagagaatctccacctcctcacccatctaaaggatggtcaaaatgaattttgcttgttaaaaaatcattcaaagatgactgtcacataaacctctccagctcaaaccacccttccctagcctagagcaggcatcaggagtatctgtcaccacagctgactttctttcagtggcattaacacctgacctttcaatatttagtcaggatgcagggctaaatctacacaaccaccaatgcagctgaggaagaaaagataggaagcgaggaaaaatattatggcaataatattagtggctttaagatgaaagattgactctctaatacaactttattttctttattgccaaaaacaatatgatattggtaaagcaattcaatgagtaaatgaataaggaaatcaataaatgaatgtatgaacaatcagatgaattaatatatggatatgaaaatctatgtttacttagaaggaaatataaatctatatgaattagtaaatatggagaccaattttggaatcagattggatgcactgagactggggacaagtctaagagacagatacagatgatacaggtggaaaaaatgatatacatttacttccttgtttcagtctttatcctgctgtctcccaggagaacagtaatcagaggacatagggcagattcaaaataaaagccaactcaggggctctaggtttcaagcaatcatttctcctgtccctcgtacagtgtttgaagctaagggttgtgatgtcagttatatatatcatatgatcacacacacatacacacacacacacacacacactgtgtgtggtggattattgtgagtactggagataatatatgctaaatgtgctggaataaaccagtagcacaacatttagtattatagattagacagggttttccttgtcttctttgtataaacatcatggacatttcaaaactgtccatctttatttctccctctacaatgtttcattattgatggataagatttttggttattttatcagcatttgtctatactggtatgaataacattttaaaagttctgggttaattgtttttataatattattatctttaccaacatgaattatgtcttatttttgtttttaaagtcaaaagcaaataacatcaacttgtttagactttatggaaaatataatcttaggttggatgcagtggctcatgtctataatcccagcactttggcaggttgtttgaggccaggagtttaagaccagcctgggcaatataatgagagcccatctctaaaaaactttttaaagattatctgagtgtgatagtacatacctgtggttctagctacttgggagtctgaggcaggaggatcgcttgagcccaggtggccaaggctgcagtgagccacgatcgtgccactgtcctccagcctgggcaacatagcaagcccctgtatctaaacaataaaatataaccttgcctcagtgaaacactggggacatgtgggttatcaatgggctggttttaggaaatagtcttaagacaagtcagaatgtttgagcacagtttaattttttgctgtgtattaggccatttttgcattgctaaatgggaatacctgaaactgggtaatttagaaagaaaaggagtttgattaattggctcatggttttgcaggatgtacaggaagcatggtgatggcatctatcatcagcttctggggaggtctcagggagcttagaatcatggtggaaggtgaagagggagcaggcagttcagacggcaagagcaggagcaagagagagagtgaatggaaggtgccatgcactttaaacaaccagatgtcactgtcgcaaagacagcaccaagccatgagggatccactcccaagacccaaacacctccctccaggtcccatctccaacactggggattacaattcaacttgagatttgggcagggacaaatatccaaaccatatcatgctggaagaagtattttcttttatagaattggaaaatcctttagaggtaattaaaatcatactctctttttctcctgcttctaatatgttgaaactaaggtttggaaagatgaaacgacatgtcccaagttgtgtacagagctagtgagggagaaaggattaaccaagggcacccaagtggcctattcttttctcttttcagctcagtcatgccaactgctgtgcttctgccttgtagctgtgctaattaatcgtggtgactttcagtgtatgtgctcatcattactgtttcatggatgtgcctcgggtcatttctttactttctggaccttagtttctccatttgtaaggctaagaggatggggagggaagaaaccacatgatttctatgctagattccttttcagctctcagaatttatgaagagtaatgatgtaattatgcgggcaagattctcagatgacaaaagcttttcaagtcttcctatttcctcttttgctgtatttgagaggatgttcagaattaaattgcatgtccaattgcagtaaatgttttagcctaggttattactacagagtgtctgatacatcccagatagagccttgcaactttgtatttgtggttgcttttccatattaccagtgctaccagggtattgctctcttgtttttgttgcaattgttgttgttttcttaactgactataaaactaagcttcagaaaagagaagggggctgggcacgctggctcatgcctgtggtaccagctacttgggaggctgaggtgggagaattgcttgagcccaggaatttgaagctacaatgagttatgatcaccctactgcactctagccagggcaacagagagagaccctgtctctttaaaaataaaaatttttttaataaaaggaagtgatttatccaagcttgttcttggcagatacaggcttcaaatacagatctcccatgttctaatgcccaaatatctcccctctctcactgccttaccttctttcgcctattaggcaaaatatgtccttccgtcatgatttaaaggtcctcatctttcattgtaaatcttcccaaatatttttggcaaagagaggtaatacggggaataaatactaaacaaaacaaaaccctacaattaacttcattgcatgcagagtgtggatcacacaatctcaaccttgttctctgagaaaatggttctctgaaaacatgctagtgtttctcttgtgaggaagtgtgtcagtagctttggagtcagacatcctaggctcaagtccttgcttagtcacttattaactgtgggatattgggtgagttgcctaattttctttcacattttcctcatttttgacatagcggtattgcttcacttccaacttaggcattgtcaattttaactgagatcatgggattaaatgcttactgtagagcctgtgggaaaagggctccgcaaattgagctcttaagattactgacccccatcctaactctggtggagctccatggggaaacacaatttctctgtcctactctccatacggtaccggagtgttgattaatgttgcacgctgagtggcccatcacactgctcacatgctccatttttgacattgcttctaacgtctcttgctttgtgttgtgttgtctgggcagaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccgggtaaggcctctgcatgcatgaccacagtgggatagatgggaccctcagacctggagtattaggcaaaggaaaatttgccaagaagggggctatagttacagttagtcactgtgcactcgagagaaacacaacaagaggggtctggttatgtagtaatcctggctctgaaattcagcatggaagctagagtgagttctgtcacctttcaaagttttctcctcatcataaagaaaacgattccaacacccaccctgcaacagttgtgagaatgaagaacatctgaagaggaatgggcctcaaagagggcatttgagcttgacatagaaagtgtggccatgggaaatgctagtttggggagagagaatagagcttgataaggcaccaggatctcagcacacccacccgagagggatgagttatgtctggggtggaggatgcctggatgcctaagggggcagtgttaggcagggaggccagcaagataggcagggcaaacctgtgggttcatggcatgaacggagcctgagaaataggggctttaggggaaatgactctttttataagtaaagtgtgcttctagaaaaaattaaactaacactgcatatgaatttatttattttcccatggttattttttacagtaaatggatgatttagttattaacatgctttgaaaaggaaaaaaaacaaaacaaaacacaacaacaaaaacaacttctagaactgcttactaagactcaagagtttctgtaaaatgtaagatagggttcatcaaaatttacatgtttcctgggagtcagtcatttttttgtgaatgtcagttcatcatttgtttcatgggagaaaaaaggacaaaagatctgaagtatctaagaaagggtgttataatctctagcctcaagaaacttacattccagcacttagaagttaagaactttgaaaggctggggaaaaaatggagaataaaatatcaacaaaggggaaatcatagaaacctaactaaattcaacagaatgcctccttgatctaggatcttcagggaagacgttgttccacgtaattgaattttccaggtaactgtcacttatccttttaagcaccaaaaatctttccaaagaatttttaactatttgaaatgaaaatctttctcaaatggattacacgcttccatgccttcttaaccagagaattctgaacataaaatgtaacctttcttggtgactcagcatcagcattgtgaaaatcaattattgtactctccttagattcagccaggcttgcagggctgattagatcagacgtactggttcgtgtccctttacccagcatcctcagagggtgctgccctgccagagtcaatgtttatatttatgtgtgtttctctctccatgtctgtcaagcctgcacgtgctacctcagcacagttctcagggtgcctgtctccagaaatgcccttccctcttctcattgcgttgtttctagtttttgaaggtttcggtttggccgaattgtaggactaatggcggggcatgttcattctgactatgggacttcttttaggatacgcactccgtgatatcaatttggctacaccattgactttgcaaatgtgttcttttcctaactcagctgcctcactgtccctggccttatttgagtgggagggcacgggtttggcagcaagtcatattgggagtaagggcttgatgctgtcatttaccagttatgtgactttgtgcaagttgctcaatttctatagtttcgatttcaccacctgaaaagtttgcatgaaaatcctgaacccatgcagttgatctgaggatggaagaaaaaatttagtctgaactccttgtgctatgcctggtacataataggtattcaacaaatactggtgtccttattcgtagcttccattgcagcagggaacatccaaaattgttccataatgggaaacaagcacaaagggaaattttatttctattttaacaatgtaaatagaataattgtcataattatgtagtaacagaattgattagaaaactcaacgtagataatctcatcccctgaagatggcaactttaacattcagatgtgaatccttccagacattcttccatgtgtatattctcaaaggcacaaggaagacacaccatatttttgtgcatgagggtcttcattaatcgtctttccccatgtgctctgaatcaaaaggagggagataaaggagaacaatgggtatgtaggctcagtgtctactttcttcttgtgagctggcttggagaatgtagcatgaaccacttcatcctcttggcttccacctccagactagacactgcttgtggggcaagagagtcctcatttacccagacagtcccgtagaggtgtgatttagcttcacactttcactgccaggacagaagccacctcgtcccccatgcatgtgagctcaccgtctggaaaagcaggaatgggaaaaacaatatataacatttgtagccacatggattcaacagccagcatccagggcatacacctacatgaatgttttcctggtccttattattattaagccactcattcccttcccaagaggaagcccaaggacagaagcagaggaggatagaggccatctcctccttacctatctaagattctggaagaagtttgtgcaagtttttcctttatcagatgaatctgtggtctatgctgggaagagattcccgaccctgtgatactcttttacagcctgtatttgtcacacacaggaaatgtacaaatacctttctttatcaataaatacaacttcatatcatcattttcattaactatagagtattttattatatggagctactccaatgaacaaatctcctatttggacctgtagattgtttccatttttttctctgttacacgtaatgctgcagaacagttttgcatttagatctttgtgaacataactgattatatcctcaggacaaattccttgaggtgccatttgcagggcagcgagtatgcatatttttaagactcttgccacattgaattctgcaatgcatcaaggttgtaccaattcatactcccaacgacactatgagactgagtgcccgtttcccagcgatagatactattatcttccttcaactttggtaatgtgataagtgcaaaggtggggagtcaaagatgattataaatagttttgttattaatttttaaaagcgtgcaggctgattaccatagcctactggctattgctaactagtagccagggtgagtagacgttatgaaaaattataaattatggctgcaggtgcatttaaatcaataagagaatgtgggggttgccttgtgggcatagattctcctatatactatgcacaatggttaataaatggatacaatataagaaggcaaaatgaaagacaaagaaatatttaaatggccaataatgactgagatttcttatgtttgaggatatgtgtggggtgagctactggaattatctctaacccagacaacagatctgcaccataagagtcattgtccccatctgatatttcaggaaacagaaactcagagagaataagatgcttgtttaatgccacacagaaaggggcagatctaactcttgcaaccaaaatctcctgaagtcagagcaaaagtgctatttctgatacatcacaaaagcggccaagagccaagagttacaagtaaatgaaggagtcagaaaaaacatgattttgtataaatttccttattgtgtaggaaaatggaaggagagagaagcgcaccaagcactgtctctgtgaaggccacggagttgtcagggttgcctgaactgggcacattcctgggcggcatcagagggtttgcatcatcctggcctagactcatcaccttccatggctcacgcaccccttcatgggaaggcctgtgtatccctacacagcatccccagagcctccttctgcctgctctcggctccagcaagggctctggttccattcatttagcagcggcagagggagaaggaagagacaggcaggataaggtcgtgcatgggtcaccactgggcctttttcattcagttggtgactgaaccatgacactgtcattttatgacagtctccttggatatttttttcccagaactactgataagtgccaaccaatggaatgcatcctccatctctgtagctgaaggtttatactagaaactctccaatgtctcaccaggacatccgtatcccagggaaagtgtctttgtgattctcatggatctttgtctttcccctcactctgcttgctgctttctactctgagctttctgcagggctggaggccctttgctacagtgcagcttccagtacagagcccagggggggagaatcaccacagcctgccagtactcacagtaccttgtcacagggaaggagacaacacttatccccactgaaaaaggctaccttggttgagcccagaccttttctctcttgtcagcaccttcataggcattttgcctgaggctagagtcctgaaggcgacatgtgatgagcatacgaaatgaaacaggaggacagaaaaataaatatcaaagccatagtctggaagattcttgaatcacatggccaattagctctataacccataactttcccctggaaggaggacaagatggagaggggtatagcaagtgaccgcatggggaaactgagtgcccagatctctgctgggaatgggcattggaaggcctccctatcccacaattctcttgcaatagtctccatggtgccttgaaagtcccccgccactggattccgtcattagggtgtcagtatccggtgtaggcatcctcttgcactcaccactccaagtaatggaaatctgtttgtggaaaccctcttcagtaaagctgtgacctcttgcaggcagagggaagaagtcaatattgaaacacgtgaaagcactggaaattcagactccattactttgaaatctaatggctgtaggacagcctgagctggaatttactttgatttttctgaacagaaagcatttgcggagcaaatcagtcatggaagcaagattgccgtgaggattgtgtaagttcttcaggagccctaagaatccagagccctacagcatcacagaacctctgtttacctaccagtaacatgctggttaaaagccattcctattaattcattcatgcagctgagagtggtttctacctgcagtcaattgctttacctagtcatgttacaatggaatttaaagggacagcatgctatttattttaaagtattttaaaattctgaattttttctttaattactgatactttagtgagcatacagctaactgactatatataccatacataataatctagactatataatacatagtatatagtatggataaatatatatgtgtctgtatgatagtatatagtatatagtatatagtatggataaatatacatatatacaatatatgatgtatatactatatagtatatgctatgtcatatttgtccataatgctatatacattcatcacgtactctttatgtgtccaaacagctctgtaaatacacttgtgcatattaattctgtttatttgcaatattccccttcacatgtgaaaaattaatgatttagtttagaaatctgagtaaggaattgtgatgtagaaaagtcaaattacaggtagaaaagaaacagtatgtcaagatactctggggttcacaaaactaaaaatgctttcttctcaatacttgtaccacccaagatcaattagcagaattaacatttttctttcatacactaggcatttttgagtatctgttttgtgccaggcactggggagtgaaaataaaacactgaaaaaacagagttcttgcctgcatacttgtagtagggaagacagaaacatgcccccactgcccccaaccccccccccccgccacacacacacaatcagtgcatgttgaaagtgatgctgaaaggtccagaaggacaaatgactagagtatcagtggatgtggggagctgcatctcacatgaggtggtgggaaagtcctcccagtgtgcaggagctatccagcaggaccctgagtgaagggacaggatgaggcaggtgcctttttggggcagaagattccaggctgaagaatagccaaaaggccagtgtggctagaggaggagcaagggtgggaggaaaatgatggaaagtggtatccagaggccagattttacaaagcctgggactgcaaattttattctaagagtaaagggaagtcactggaagattttaagcagaggattctctttctgtttcaaatccaaagggtaatgtcagtttatgtaagtcaggctaaaccaggtatgaatattttcatatgaataatttgctaagcacatagacattttaagtcatctcctatgcctagtgaactggaaaaaggtatgagctccctgaaggaagaaacatgtcttatatcactctgtaacctcacattctaattcggggctgtgtgtggaaggctgtgaccaccttggatcccctctgattcatggtggtgattctgttctttctcacccaattaactgagctgcgattgctttggctacttcacccgctatgttcttgctgcggcccactttcaccatgctcacaaagcttggaggtccgcgtcagagagctgcaatctttgcagtctatggcaccacctctgctcccatatttctttcctttcttaattccctctttctttcatctttttctttgtccttccttctttcttaaccaccccccgcctccacagacacacgcctaaacatacacaaatatgtgggtagaactgatccccagtgtctaccgttcttccacaccagaattaaaaccacaaacttacatcatgacatctggaagacaaaatatcagggtagtatttgactttttttttttacttatttcttaaattatgctccctatcatctttttattattattattgttattattattattatactttaggttctgggatacatgtgcagaatgtgcatgtttgttacacaggcatacatgtgccatggtgtttttctgcacctatcaacccgccatctaggttttaagtccagcatgcattaggtatttgtcctaatgctctctgtcccctttcccctaaccctctgatgagccccagtgtgtgatgtttccctccctgtgtccatgtgttctcattgttcaattcccacttatgagtgggaacatgtggtgtttggttttctgttcttgtgttactttgctgagaatgttggttttcagcttcatccatgtccctgcaaaggacatgaactcattcttttttatggctgcatagtattccatggtgtatatgtgccacattttcttaatccagtctatcactgatggacatttaggttggtcccaagtctttgttactgtaaatagtgctgcaataaacgtacgtgtgcatgtgtctttatagcagaatgatttataatcctttgggttatatacccagtaatgggatttctgcatcaaatgattatatatatatatatatatatatttaccaaaaagctatttctactttatgtacaacaagaatataataaacccaggtggactgggtgccatggcttacacctttaatcccagagttttgagacgccgaggtgggaggatggcttgagaacaggagttggagatcagcttgggcaacaaagcaagaccttgaccctacaaaagatatttaaaaagttatccaggtgtggtggggcacacttgtagtcctatctcctctagaggctgaagtggaaggattgcttgatcccaggagttctaggctgcagtgagctataattgtgctactgcactccagcctcaacaacacgtgagacctcaactggaaagaaaagaaagaaagacagaaagagagagagagagagagagagagaaagaaagaaagaaagaaagaaagaaagaaagaaagaaagaaagaaagaaaaaaggaaggaaggaaggaaggaagggagggcacaccttggtgacagaataagactttatctcaaaaaaaaaaaaaaaagaaaaagtcactgccactagcccacattccaggggagggaaatctgcttctatcttctaatggaacaggtatacagacatgttttaaatgacaatgtcatcttcaaaattttacatgaatagtcaactaccctaagaaatgcagtgaatacagggcagagtcgagagtcaaaccaagctctttctaactcaaagtctaggcccttagactctggtgtctaagtcagttataattcatgttggaaatgggtttggccctccattttttcccgtgagggacttttgttacccttaaagtgatacagctaaaatgtgtttttaagcgtttgccacagctttcaaaaataaagagatcatcacatgaatcaagccagtgcaatttacagtgcatgaaagccaaagccatctttcctaatgtcctagtaatttactcttggtatttcactggggacttgaagtcaaaattagaagtgggtgggtcttaccaacaaggtggataacttaatcaagctaaagatgttgatatgaatctgaggaaaaataaaaactatcctatgtaaagtcaacagatggtatatatctgaccacaattgagttgctgttcagaccatgaattatttaaataatcaaagttgattgcccaagaatcaacactcagacactacataaaataaaatatgcatttttcccatcactttatgaaagcccatgtccacttcctttatctcaaggataaaggaatgcacatgtaggaagaagaatacaatgttctaatattaagatacggtacagtggcagcacaatggaaagaacatggattttcttcactgttttctcttcctttattaattgtgagaccttaagtaagttaaatgggccttctgagcctcagttttcttatgtgtgacatttaatgagacagatgccatgtctggcacagagtaggccctctggacactgctgttattttagccagtattttatcacattatccagcggcaaggagaacattaggtcccttaggtactgatagagggtctcccaatctcatagtgtggccattcaaagagttcagttgtggagcttgcctcttcatagcttgggggcacacctactttctaaattgcacttcatttatttgtaacttatggcatttacctactcctggtagcactgttgaaagtgtagagttaggtctatgttcctctccccatttctgccaaatacccaaatccactcatctgcttatctttctcatttcagtaaatgctaccttcatctactgagttttttaagaccaaaacctacgattccttcctcttcaccatctccattccccattcagtatattctccagtctcttctctctaattccacatcaaccacctccattcacaccctcatcatctcctcaccatactagacaagtgcagtagattcctgcttcctgtcttccaccatcccatgccccatttccccacagcggatatcccagcctgcagccagagtgataatcttttcaaaattagattatataaccatggctccaaacctttccctctggcctggaagcaaaacccagactcctaactgtagcctgcagagctctgccagccacaggcctctgccagcccctgttctcccattaatacagtgaacttggccccactttgctttttgttgcttcttgcccagcttgccccacctctcagacctgatacactgactgctctctctacccagaagccttgttcctctctccatgcttagctgtctctgattttacgtacaactaaagtattcacttcattactgttaactgcttcatccttcctgaatagtctgcattgaagttgtttctatcagataccttcttcttgcttatttgttcactatctgcctctgtcaatagaatgtgagcttcttgtaagaggggccttctttgtctcattctttattcccaaaatgcttagaatagtacctggcacctagggacaattgagtgaatagttgttgaatgaataaagggtctcttctcagtagtaagtatcaccagtagtcatatgatgtcaaaggacagatgacaacacacgtgcacttggccaagcctgtcacacagaccctggtgggaggagagcaacttcacagagcaagaggctaggcttgtggggagctgccctctgactcccagctttgccattgattctctgtaaccttgagatgttactgatgttttatgggccacaggtttctcctctttgatactagaggcttatatttaatgttctctgagtgtccttttcactctggcactccatgtctctatattcaccacacaaagttagttaaaacacatgtcagagtttattacttttttgtcacagtaaggaacttgtcggggttagtaaaacaaacaaaccaaaaaaaaaaaaaagacttttgtcagcctctcaagcttatgaaatgtgctaatatagttatgtaataggtgatattttttgacaccttcatacacctactctcctcagaacatactttccttaccgtggcatagattgtgcaaagaaggtatgaaacttccctagggtcatacataacaagtcaagaatagcaagaaaaacaatttattactgtagcatatgtttgtgtgtattaccgtagaatatgtatgcatgtattttctttataaacaaacatatttggtggcttacggggtagatatggaaacgaaattataccaactacacagatgaggttaatgggtctgcataggtgttaggctataatggcacctctgagcttgcttttcagggggccatggctagatactagactttcttcacacctgagtcctcactggaaccttcccaaagagaaggctccagagttctggtgatgagctcacttacatgttgcatcagttgctttggttcaagcacttgctccactcctaccgccatgtgaccttagatgaggtactcaccatctctaagcctcagtttcctcaactctaagaatgaagatgagaaaaataacattaatgatacccacatcattggaagaataaaaagtgtttgaaaatttcactcttcataactttttagtttacctaagttgttttgaaattacaggggtgcctttctgaacataattttcattgtcttattatttgctgagaagagggagtgggttttctgtgtgtgtgtttacgtgtgtgtgtcagatcagatgaggaaataccaaatgtgctttctatatggtagcggtgatttcacagcgaagatatgaagcttcctaaaactggtaaatcattatcttggaaagagacagtggaaatgttttagcctctgaataaaaaaataaaaaaataaacacaacataattcccccactctgccacttatttttggagtagccatcatcaggaaaggtaatctgaatctgcatttcattttcttctctgcgaaatagctaacatattgacctcacttgcatctcattttcttctctgcgaaatagctaacatattgacctcacttgcatctcattttcttctctgcaaaatagttaacatgttgacctaacactatgcatgcgtagtatggggctggactagtggctattattatttaaggagcctatccccctacaggcagaactagagactatatgtacatgtgagcaaggtatacagggctctgaaaaggagaaactacttctagttaggtgaacacctttccagaggttttctatggaaaagcacctcttctttgtggacacaacatgggtagaagtcattctgagttgagggaagtgatggggaaaggcatgaagggaagactgaccctcagagaatgggggagacattgtaggaataaaacagttaaaagttcttgctgcttatttcagataaggagtcacagaggatggaaagaaaaaaggaagaaaggaggaaggaaggaaggaagaaaggaaggaaggaaggaaggaaggaaggaaggaaggaagggagggagataggaaggaagatggagatctttctatgtttcagatacttcccagcatgctcctatagattaactcaccttctttcactgaatgaagacatttgaactggagaaggttaaccatgtggatggaggtagagagaacgcactgagtctgaaggagagcacagagagaggctaggtaggcatctatcttagcggtctagggaagagttaaaaagcatggaggtgatgcgtcataggaatagaaagataaagaaagacactaacacttagatgaaagcactagtacaggctggtgagttactggtttcaatgaaccaagtagtatctaaaacagtgctgtccaatgaaaatatagcacaagccacatgggcaatttaaaattttctaatagccccatgttaaatataaaaagaaataggtgaaattaattttaataatatgttatttttatgccaagatatccaaagcaataccattttaacatgtaattagtaaagaaaaaccctaatacactgttttacattattttttataccaaatcttcaaaattgggtgcgttttttgcatttacagcacattttaattcacagcctgttgctgtactgaatactgtaggcaactataatacaatggtaaatatttttacatctaaacatacctaaatatgaaacaggaatagtaaaaatacaagacaaaagatacaaaaatgagctgggcactgtggctcaaacctgtaatcccagctactaaggaggctgaggcacaagaatcacttgaacccggaaggcagaggttgcagtgagccaagattttgccactgcactccagtctgggcaacagagtgagactgggtctcaaaaaaaaaaaaaaaaaaagaaaaagaaaaaaaaatttacgctgtgtagggcacttaccatgaacagagctttcaggactaaaagttgaaagttgctctgggtgaggcagagagggaatgatgtgtgaatgtgaaggtctaggaaattacaaggtgccactgtacactttataaacactgcacacttaggctacactacatttaaaaaaatattttttcttcaataacaaattaacattaatttactgaaacttttttactctataaacatttgcatttttaacatttttactcttttataataacacaactgaaaacacacattgcacatctgtacaaaaatattttctctcttctaccttcattctataagcttttttctatttttaatcttttaatcttatttttactttgaaactttttttgttaaaaataaagacaaatacacatactaaactgggcccgcaaagaatcaggattatcatcatcactgtcttctatctccacatcttgtcccattggtaggttttcagaggcaataacatacatgaagctgttgtctcttattataacaatgcctttttctggaattcccccgaagggcctgcctgaggctgtttcacttttttttttaataagtagaaatggtacactctaaaatactgataaaaatagtataataaatgcataaaccaggaacatagtcatttattattattataaagtattatgtactgtacataattaaatgtgccatactttcataaaactggcaacaaagtagatttgtttacaccagtatgtacacattagtaattcattgcacaataacttgaaaaggactactacatcactgggcaatacaaattttttagctccattataatcttttataaattttatagctccattataatctttttttaatatatatattatactttaagttctaggttacatgtgcagaacatgcaggtatacatgtgccatggtggtttgctgcaccagtcagtccatcatctacattaggtatttctcctaatgctatccctccccttgtctcccaccccccgataggcctcggtgtgtgatcttcccctccctgtgtccatgtgttctcattgttcaactcccacttatgagtgagaacatgcagtgttttgctgagaatgatggtttccagcttcatccatgtccctgaaaaggacatgaactcatccttttttatggctgcatagaattatatggtatatatgtgccacattttctttatccagtctattattgatgggcatgtgggtttgttccaagtctttgctattgtgaacagtgctgtgataaacatacgtgtgcatgtgtctttatagtagaatgatttataatcctttgggtatatacccaataatagggttgttgggtcaaatgatatttctggttctagatccttgaggaatcagctccattataatcttatggggccacccttgtacatgagatctgttgttgacccaaatgccattctgcagcacatgactgtatacatgtatttatataaatgtgtgtgtattacaacagccgttaaatatgatcttgttagtccagttatataaatgaggaaatggacacttagaggtgaagtaaattgcctgaagtcttacacaaaggatgggattctaggcagatctaatttcaaagcccatacaaagtcacagacacatgtcaagagagaatgaaggtaaagcaggatcaggagaccttgagtccaaatacttttgctctatgtgatggttctgccaaatgaggagggagatgtttgccaactagaacatactatacgtagttgattacaaatgtcatatgtatccacatgtcaaataaactcttacctatatattattgcatatgatacaaatatatgtacatatatgcactttacatgttttttctggttcctaaataatctttatggaggaaacacttaaaatatggaaatagaaaaaggaaagctgttaacattagcccagcttttgattgtaacagctgaaatgggccaggctttgtggtaagtattttcagttcctagtacacacaaattacaaaaccatctgagttaatccttcgaatcccgtgaggtgtaggttattaccaaggaacaaacgcatgttcaaagaggttaagtaaagtaagaaccatgtgaccctatctgtaactgtaggattacacaccaatctagtaaaacctgttacggttaaatcccgctgcatggaaagacaaaaacaatccttgcttaaatcagccatgtcgccagctgcccagacgccagttagacattcgcttgaactgtgccaaacctagactggattttagctagtaaactagtattatatagacataatctgaagtcactcaaaagctatctgagtaatcattccataagttgccccccaaaaataaaaagctaaatatttctgtgaatgcatcattgacaaggaaaaggaataagataagaagaaaatcagaaacaaagttgccgacactgtaaaaatttatctgtatattcagcacaatttttgcattagaatttagaaaggataaaacattaggatattggagtagttgcagaatccattttgggagtatggaggttgggggctagggagaaagagagagaggaaaggagggaaaatcctttggggaattgcctctgagttagaaacctgtactctgcttcattttttatcttgagtaaatgaagagagattctcaacatggagacatgatcttaggtacataaccctttgtgatcttcccaagggccatacattatgatgctgaaaaacaagagtccatgataatgacccacagctatttaaaatagcaacattccacaatgaattcctcccttcttaaaggaagacagggatatggtggcaatgggagctcagagttggcaatttcttggcagctaagaagctcaacagggatgaattctttggtggtaaaattgaaatacaaattcctttttcaagtggaacttttctaactctctgagttttcaaaaacagtaactgggtcatatttatttctgaatacctctagagccattttagtgactggcacaaagtaggtctccctcccaaattttcttggatatgaaaatcctgtgagaatatgatccaaaaaagtactttgaagacaataattggaattctcatatgagacacaaaaaggtgacagggcttggtggctcacacatttaatcccagcacttcgggaggctgaggtgggatgactgcttgagcccaagtggtcaaggctccagtgagctatgattgtgccactgcactccagtctgggcgacagagtgagaccctgtctcaagaaaaaaaaaaaaaaaaaaggaaagaaaaagcttaagtgtggtgcaataacaacaaggtaaaaacaaacaaaacccagaaacagaacatcttaatggcttaaaacagcatcctttcatttctcaagtaggccagatatgtttcatgaattggcttggggctctgtgttaagttttctcctcccagcacccggagtgatagagtagcacttctctcaagtgttactggtcaccttggcagatgcaaagagggctctggagtacgtcaaacctgctgcagtctgggaatgacacatgtcacttctgcttacagcacattgccctgaatgaaatacatgcaatccgcaggggacaaagaagttttgtttgtttgtttcttttgagacggagttttgctcttatcacccaggctggaggacaatggcgcaatcttgtctcactgcaacttctgcctcccaggttcaagcgattcttctgcttcagcctcccgagtagctgggattacaggcatgtgccaccatgcccacctcatttttgtatttttagtagagatggggtttcaccatgttggccaggctggtctcgatctcctgacgtcaggtgatccacccgccttggcctcccaaagtgctgggattataggcgtgagccactgcacctggccaggaagtttaatcctaccgtgtgctcagaaggtgacgagacagaagtaattggtgcatagccttaacgtctatcagccagtgagaacacaatgaacaaaccaacaaacaaaaggcaaaaacaggaaaaaaagaaaaaaagaaaaatatcatacccaatagaagaattgaaatcaaagggtatatttacaatattgtctttccctttttatcttctatctactataaagtgaatcgttccttaatgcatggcacaccaaagaaaaatccatcagacctctgaagtactatgaactatttttaaatttgtaactctatttatagatcctcatgtaatcatgaatatgaatatcctgaattttagtttcagctaacatcaaatatttggttaacgtcaaaattagctttactatttagttaatattatagtttcagtgttagttcaagctaatgtcaacatcaactgacgagcaaatatttggaaagcattattttattcccttttttagaaaaagcaaagcaaattttcaaaattaactttgtgattagtcacaaagccctcacatacgtgtggataaaactgtctccatatatatgttgatgtgtagctaaaaaatattggccaggcgtggtggcttatgcctgtaatcccagcactttgggaggccgagaccggcagatcacaaggtcaggagatcgagaccatcctggctaacacggtgaaaccccgtctctactaaaaatacaaaaaattagccgggcgtggtggcgggcacctgtagtcccagctgcttaggaggctgaggcaggagaatggcgggaacccgggaggaagagcttgcagtgagccgagatcaagccactgcactccggcctgggcgacagagcaagactccgtctcaaaaaaaaaaaaaattatacatatttattgatacagcatcccatttaatgctgcttttataaatctgtggcctctgaaatagtgttcatacatgtgtttttgtgtacatgtatttttaaaggaaaaaacaaactgtaaaatactttaaagagatttattctgagctaatatgagtgaccgtgacctgggtaaaatataacccaaagaagccctgagtaagtagtcctgaagcggttgggttacagtttggttttatacattttagggagacagaagttacaggcaaacacacatatcaatccatggaaagtatacattgatttggcccagaaagttggggcatcttgagtcaggggcttagaggttataggtggattaaaagattctttaatttgccatgggttaaaggagtaaagctttgtctaaaaatttggagtcagcagaaaaaaatatttaagataaggaggtctgttaaccagtacactgggtgagagtgacttgtagaggtgtgtgacttaacccttgtctggcagagccttaggtcttatttattagtatcttattgtcacaaagagtttgttttgttagtctttgtaatattaatgctggtcagctgtgcctaaactccaacagagaggtgtcatcacaaggcatgtctgatctcccttcccatcatgacagggaattcgctttttcagatttctctagagtccccttggccaaggggcgaggggtctcttcagagatgaggggatcttagggttttatttttgtttacagtataaaatggtacaccactatgcactgttgacatatttttcctcatcccctaaatactgtcctattctctggcagctggccagtgagggccatcacctcactctgcaagtgcccatggctgcaagtattcttttgagccatcctgcagggagcgcatcccagcagcttgcgtttctttcccatactgacctcttctgctgctgcatattttgtgcttgaaattgctgtttggattcctcaagactttcaaagatgttcaggatggtgcataactacagcaaagaactaaagggagactattactctggacattaaatacacattttatgatagcttgatgtgctttaagaagaacgatgggggaaacatgagcaatgattgggcagttagagatgggtagaagtccattgatattataaaggactttaaacatcttggtagctgggaaagattaaccaaggaatgagctagaagaacagattgccccagggcagtttatgactgcatgcaatttgaatgcacctcagtagggtgtgctaagaccattatagtcctgattgattagcaccagaaaagtatttctacttcctgctaaatggaggatggctgctctgtgcaatctcagaggattgtttaatgtacacgtgtgtactccaggtgccacagaattctacagccttgatttgacaactcaggtctgtgctatcttcctgatattactcatttcacagtctgaatatgagagtatctttgtcactgaacaacagtgttcatgtatgtaaacctgctcattgcacctgctccttgccattttggtcaaggtaagtataatgcctcttgcagtcattcatcagtaccgttgggttttggtgggtgtgttcttccctgcctcagggcaatgctaatttcatttctcatcctccaccatgcctgaatacacagtttacctaaaggttaagaattgagtccaattaagaggatggagcaattccactacattaacattaatagtgcatggaaaacactccctatgtcttcattttttaagcagtagccattttcctgtctattctctctctcttattttttcttcctgcaccacttaatgaaaatctaatggtagcaatggcacctttgttgatgaaagagaaaaagtgataatcgttcctgcttgtctctttctcatttctcccgtaagggaagctaagagtggcatccttgagacaggtttgctttactgatcaaagacagtccttgggagaaacgacccagaggatgaggaattgtcaagaaagctttgccacagacgaatatgatggaactagttcatcaaatgataaaatgtgaactttcctttcatcctggaatggaaaagtcattacaggaaagagtgaatgttataaaggttaaacgtgagtgactgatgatgatgtatcagggaattccctggccctgtaaggctgtctggtatcaggctctcttggcctgtttcaatttatacacaaccatgagggccttacatccatctgttaaagcatgctgtagtcatacatttagctaggaaaaacctttggcatccggggcttctgcagggagcaggccaagagattccactaggttatggatctccttctccctgagggaggcataagtggcagagaagctgagagatcttaagcagctaacggaaaggtttgggaccagctgtttagcatgacaagcattccagaggcattgaggggcaaggaggaaattgagcatgtgttgaatcattactgtaaagaaataaattgccctggaaactgtgtatcagggagaggccttcataattactttatttaccaagccttgccaagctccatcctatcttcacacttgtttccctccacaggccctccctgctactctgtgcttgagtgcaggaattctcaaggtatgaaacacaggaaaggtttatgtgatgcatggatggaatttttgaaaacatcatttttttctattttaatgtgttataaaaaggtataccattagcacttaaaatttataatttcaaatctcttattactaagagagtagtgtaagttaaaaagaaattagtaattcacgtcaattaacttaaagagatttgaagtaagtggtcatttgggtagaaatggcaacaaactggaagatgcttctggaatgagggaaggaatgagggaaggttaggaagtgctagggcacttttccttcctcagacacatcctttaaggatgtggtgctatacctttaagccttactcactcactcctcttcccacttccagaggtgccttcttcctgcagtcctattggtaacattacattttgctttaccagctctgcctcctctgtgaagcccaccctgatttattcagaataattcagcatgtgttctttctgctccctttttatgtggttcatattttaattgcattattcactcactttcatttcagtcagttgcacacctaaagatgttatgcaaatggtattcatttttatatcctcagggacaggacctgcatttgggagatattaaatgattagttttgagcaaacaagttattcatatcctttcttatcaaagtttcatcaagctctacagccgccaaatcccatggcaatactaggagatcatttcttgattagtggcatttgacacagttgaccatgtcctattttgaaatacttgctttacttaacttctagaatgtgataccctccagtgtggtcttgcctctgactgtacttctgctaccttgtttgttggctccttccacgttaaacaagaagaaggtcttagggctcagcccagggctctcttcatcatctatgcattcttcttggattgccattcagtcacatgctggagaatctcaaatttagatctccagccaagattccttttctgaatacaagatgcatatatccacctgcctactggtcttatgatgtcccaaaataatttcctgatcttcttcctccaaatatgctcttccagcattctttcccaaactttgtaaatagcaagtcattcttccggacactcagaccaaaaaacctatgagttatccttggttcctctctttttcccatactttctgataaaaacgttcctaatccaactggctatcattgaaacagatgcaaaacttaagcactgtgttcgctaccttggccattcccaggcccaagatgcatcacctgtctttttgattactacgattgcttcttctcaaacacctctcagttatagagggacaaactgctcacaatatctatgtgtttcctcctgacttcagtgatccagtgtccatccccatccccatttcactactcacagcgagaccaggggccctcttagaccttccatgttctggaggcactggatctctctatattgtgctgacacttgcctgcctgccttcctttccttttccttccttctttccttccttccttccttccttccttccttccttccttccttcctccctctctttctctttctctctctttccttctttccctctttctttctttctttctttcttttctttctttctttcttaagagttatgttggtgaatatgaagcatatgtcattgtggttttgattttcattctctaataattaatgatgtcaggtatcttttcatgtacttgctggccatctgtgtgtcttctgtggaaaaatgtctactcagctcctttgaccttgtataattgagttgtttgtctttttgttgttgcactgtaaaagttctttatctcagatactagactgttatcaaacatatgactgcaaatatttttcccattctatcttttcactttattgacattgtcctttgatgtaaagtttctaattttgatgaagcccaattgaactattttcttgttgttgttgtttgtacttttgatgtcaaagctaaaatccaccttagaggtgttgcacttgttgttgttgtttgtacttttgatgtcaaagctaaaatccaccttagaggtgttgcacttgttgttcccctgattgcaaatctcttttccaatttaccacatgccttgctcgttcacctctttcaaaattccgtataaatagaaccttcttagcaagctttatttctgttcactctatttaaaattgcaatcttttctggacacagcaaacctgggccccttttttccactttatttttcctcagtatttattttcatatgatataatttactaacttatgtaagcatgtttttagacttaagcttcctaagtcagaggttagtgtctgttcatgtgtgattgtattttccatgcccagagcacagcttgctacagaggaggtgcccaatatacccaactggcaggggagttcagcctgtcgccacgggcctcattcttcctgtgtaaaagcagttttatctgcctttcctcacccatccttgacctcaactgttactttatcattggtataattattagcataatcatcactaccaagaaatgtttagaaagtttccacctcttcatggtgttaagctaagcataggcatagaagcacgtatctgggatttcccaagacaatcctgatttaaaaataagtttattagagaatgtaatctaatttttgttttcaaaaaacaaaggcataagaaacagcaattctacatttttgctcctgagctgagtgacattatagcaatggcatggtctttctgaaccacagttttctcacctgtaaaatggggttgttgtgaggattaaagaaaattatttttttaaagacaaaggaggaaaaaatgtaataatgtaatactcatggccctataatttaatttaagtgatctttcaagactttacaaaaagcagaattttctgaattctttgcttatctcttttgtttcaggaatgtgctatgaatgctaactttaatcttagagactcttatttttatttttagttatttatatttttgagatggggtctcactctgttgcccaggctggagtacaatggtgcaatcttggctcactgcaacttctgcctcccaggttcaagtgattctcttgattcagcctcccaagtacctgtgattacaggtgtgcaccaccatgcctggctagtttttgtatttttagtagagacagagtttcattatgttggccaggctggtctcaaattcctgacctcaggtgatcctcccgctttggcctcccaaagtgctgtaattacaggcatgagccaccatacctcgccaagactcttttaaagaaagcccaaaggccaccactttagatatacccagtgagacttgtgttcatgtgttaacgatgccatcacagggttccacaaactggtagcttacacaagagaaatttgttttacctcctcacatttctgaaggctggaaaccaagaccaaggtgtgagcaggattggtttattccaagacctctctttttggcttggaggtggccaccctcttctggtgtcttcacatgacctaccctctgtgtgtgtcactgtcctaatcttacaaggacaccagccatattaaataagggcccacccatttgccctcattttactttaattatgtctttgaaggctctttctccaaagacagttgcattctgaggcattgggtattagaaattcaatatatgaatttaggaagacacaggttagctcataacagtgaaaaaatatgcaggaggaaatttttgtaaaattttttactttattaatgcactgaaaagaaagaaatactgaaagtcaaaaaaagtgtaggagaatctaaatccatcattgaggttggcttctaccttgacagcatgtgcctaatacaggtgatcttgacctttggtcctcaaggcctttagggccccaaaagaagaggacatttcttagggcacagctaaggcaaggagtttaatgagagatgttaacttctcatactttataaaactgaaatttaaaggagaaacttgaaatcaattcccaagggaacacacggaaaatttcctgtaccaatcaggatggaataaaaatctctcctataaatatgttcaataagttggtgtacatgttaaaaagactaaaatatgagtaggaaactatttcaagtgaccaagaagatttaaagaaatataaataatttctcaaaattaaaaatgtaataattaaaactaaaagcacaagggataaacttaagagataattagaagtgactaaaaagagaattacagaactagaaaatatttctgaaaaaaattacccagaatgcatcacagagcaaagaaatagaaaacagaaaaaatatttaagtgatggagaataaaattgtaattgctaacatatatcaaattggcattttggtaagaaaatcattcctgagatgctgtgcaaaatgtaaattgtgtgcttaattttatttgctagtaaacctggcaaataatactttaaatggtagctattattagcagtattgagcttactactaacaataacagttctgtcttaagagtcgagtacacaatcttaaaacactacattctcttaaaaaaaacacatttaaaagcactaacatgttctcagaatgtgctttcctaatgaatttaatctggtgattgcagttgcagtgatggcactgatgacgatgactaaaatgagcaataatgaatgaggaatttgcaatttttgatagggcggtagtaacaccatgtcataaaaaatgttaaggtacttgagagttacagtttctttttttttttccctagctctcatcttgatttcctaggtattttagataacttacgtttcttgaaggcctcacacatgagggtatatgttaatatttccaacaggctttgtttttgggactcacttttgtacataataaattatctaccaggacaataaaagtggcatccttttattaaataactactctgtgtcagaaagccaggcctctaactatgggcattacgtaatttaataatcacgtattatttttctgattttatagagaagcatctaaggcatagagagaataagtaatttctgcagagtcctacagcattaaaaaaaaaaaaagagatcctctagacaatttttctgactccaatgccctcaaatattttcacgatgataaggtactcatttttaagttttattaagatatatttaataagacattaaatgtactcacaaaaatgtataatttactgtttttagtatattcagagttgcaaatatcaccacaatttaattttagaatactttaacactcccaaataatatcttctacatattttcagtcattccccattcctgctcccaccttgccgcattcaccacaatgtcccaaacccagcagtgatatatcctctttcatccctgttttagtgattttagtcttctctcttttttcttgctcaatcaagctaaaggtttatcaaatgttttgatcttctcaaataatctacttttagtcttattgatttttctctatagttttactattatctgtttcatttatttgtgtgtaatctttaatattccttctccttgattttggcttagtttgcgcttcttactctaagtttttaaggctaaaggtaaggttgttgatttgagaaccatccttccctccttccctccctccctcccttcttccctccctccctccttccctccctcctttgttctttctttccttccttccttccctccctccctcctcctctcctctccttcctttcctttcccttccttcctttccctccctccctccctctctccctctctacttcctttctttctttctctttctttctttctttctttctttctttctttctttctttcttcctttcttcctttctttctttcttttcatctcctcctactccttcttcttcttaaatacaggcatttacaacaatagattttcctctaggcctgttttcttgcatcccaaaaagtttgggtatgttctgcttttgttctcttttgtttcaaagtttttcttatttccattgtgatttctttttgaccaattggttatttggaagtgtactgttaaatttccacttatttgtaaccttttcaagtttaaattgttgatttttaatttaaatttaagaattttgggtaacatacttttaatgattttaatcgttataaattcattaaatcttgttttatttttaagcatatggtctatcttggataatttttattgtgtacttacaagattatgcattctgttgctatttggagttttctattgatgtatactgttttttaaatgttctatgttcttgatcttctgcctacttctatttatttttaacacaagagtgttggattctcaaccattattgctaaattgcccatttcttcaactttttttgtgcatatgtctcattactttagggctctgttgttagtcgtataaatgtttataatcgttttattttcctgatgattttctcttattattataaaatgtccttctttgtcattagtaacaattgatttcttaaaatttattttctccaacattattttgtggctaaaataatgttagctctcttttatagttatgcttgcatggtgtatcttttaccatccatttatttccaacatatttgtgtgtttgaatatgatgtatatctcatatagacaacatattccaatcatcatttaaatattctccattttttgtatcaatctctaccttatgattaatttaattcacttatatttaatgtaattatagatctgacaggattcccacttgccatttttctacttctttattggagtctatttttcaatttggttatcctgggaattacaattggcaccttatttttaaacaatcaagtttgcattaatcctaactcaatttcaatcgtatacaaaagcttttgtgcaacatattttatttcttctttcctccattctatattcattacaatgcaatttacatctgtatataagcccactaatacagtttagtatgtactgctttgtgcagttagttgtcttatttgtcgagatattgttgtcatattttcctttaattctttagagatatttttatttatttatttgaacatatttatgacagctgatttaaagtctttgtctaattagttcaacatttggtcttctttaggaacagtttttgttgacttttgttctgtgtatgggccataatttcctgtttatatctagtaatgtgtttcttgaaaataggacatttcagataatataatgtggaaattctgaaatacagatacaggtttgttttctgttgtttttattgtttctgatgatgtttaattgtttactggactaatgataaaatatctgtattcatttttgtgtgtggccactgaagattctgcttaattagcattgttttcagctaactattagattacatttcttaaatgccctgaaccaataagtctttcaggctttgctgagtgtctctgacttgtgttgtaacattacttaaatgcaagcagtttacaactcctccttagctttcacatcctgcttctgcaagtccttaagattagtgggatgtaagaaactaaggtttttttggttattttctgagcatgtgcacagccctgcacatgtgcatagcccttcaggtttaccagaaatatgctgaagcttatcaaaacccttattgtcataccattccccaatttttcctttaacagttttagtcaacttcttattcccaattggcatcactgcctcaggcagatgtgatattaaacaattgtcactgaaagatttcaacaaatgctatgggaatagggctgctcccatggactgatatctgagtgagactctggaaatggagcttcttagtgagatttgagaaaggtcaaatagtaaacattctctgtagctggggcatttgaggaggctaccaaactcattctgctcccttgcatagctgttaggctactgtacttgtgagggtgttggttttcgaggctgccatggagctaagtgaagaaggaagggagcagagcaagttaaagcaccataataagccttgccattcttactgagattcagctatttttattaaagactccttggatggttaaaagcctctattattttccagacatttgaaaaagttaatttttgacaattttgaatagtgctctcattgcttttatgaaggtgtagatttttggaggcccttcctccaccatctggaagtgcttctgttactgggaagtgtggagcatctcagttcttgacattttggaagacataatatgtccggaattgattccttctggtgggttcttggtctcactgacttcaagaataaagctgcagaccctcgtggtgagtgttatagttcttaaagatggtgtgtcctgagttcgttccttcagatgttcagatgtgtccagagtttcttccttccggtgggttcacggtctcactgacttcaggagtgaagctgcagaccttcacagtgagtgttacagctcttaaaggtggcgcgtctggggtagctttttcctcccagtgggttcatggtcttgctgacttcaggaatgaagccagagaaccctgtggtgagtgttacagctcataaaggtagtgtggacctaaagagtaagcagcagcaagatttagtgtgaagagtgaaagaacaaacattccacagcatggaaggggacctgagcaggttgctgctgctggctggggtggccagcttttattcccttatttggccccgcccacatcctgctgattggtccattttacagagtgctgattggtctgtttttatagagtactgattggtgtgtttacaaacctttagctagacacagagcactgattggtgcatttttacagagtgctgactggtgcatttacaatccttcagctagacacagagtgctgattggtgcgtttttagagtgctgattggtgtgtttacaatcctttagctagacacagagtgctgattggtgtggttttacagagcgctgattggtgcatttacaatcctttagctagacacagagtgctgattggtgcgtttacaatcctctagctagacagaaaagttctccaagtccccacccaacccagaagcccacctggcttcacctctcaataattcagccgagagaccaattagtaaagtaagcagaaaggtttattaagggaataaaagtacactccaagagaggagtgggctgacctggctaaaaacacccccaagaattctgcgttgcagtttttatcatgttgggcgtttctttaagttcccacatgtcttaagtctctgcctttttgtttgtctagttttccactgttgtcttacatccccatctttgttcccatctagttcccacccaggtttgtgggatcctcccttactgtcatttggtgcacatgcctggggtccagtgatcaataggaatccaacctaatgatgacattgttcatgactgcctccccaggaaggttgcatagcagttaaaactgtactgattgtgcctgagtatgtcaggaatttcccctttatcctttctcctttcttgtcagcatgtagctggctacattctgacaatttaaccacagaatgagcaattactgggtgtcttaagcggcatttcaggacgttcctgtctacataggtatcaccccttctctctgctaatacctaactacatgtttcaggtggtctctgaggcacaagattttccagagcttcctcaccgagagcattccttttctgctcttgtctgcctgcctgctctaaaaattccagaatgtgagggtttggacctagtgtaggacttgatgctcagctttattaaatgttatgtcctatgatgggagctgactggcccaaaaaggattcccgaggtgagggtagaaaagtgggaactacagcaaatggaaccccctgttatgaaaaggagaggccaggaaaggaatgcaccatttttgtcatggcctccttctccaactctccttgggctagatatttggcttctctgtgctcttccatgctcatacttatctttattccagatccaattgcctggtagcttaactgttgcttctgcttcttcaccagaagataaattctctcaagggcaagacaaatgtctgattgcctctttgcatccttgtggcttagcacaatgcttggcatgctataggcactcaataaatgtttatgaagtaaagtcaaccacaaacacctttcatttcagaatctcaaacataggataggcagggcatagtaaactctgcaacaaacctgtttcaggcaggaaagcagaaagggaactgtcagctccacccatatcttctttattagagggatgaatggccagagtcaaagtcacagaagacaggcaggcattgacaaggcagagaggtatgcagcaacttctggtttgagaggtgcctctgtggtaagcgagataaataaaactggtaaatgatggatctcctcaaggagatgaattgagccaagagctagccttggctgctggtgcacacatcaggaaagcagtatttgagatccgggagtcttgttctttattaataggaggatctggctatgcctcctcattttcattgcattgaaagtaatcactaacatcattatcatctcatcccttctgattctgaaggactttgacatttataaaacaatcacatatggtgaccctcatagaggacagacaccctttaatctctattttacaggtgaggaaactgaggcgctttttccaaatcactaattatgataagtgacagagttgatcctagaacccaaaatgctggctaattgtcccatatcttttttttttttggagcggggagtgggggacagggtctctgtcattcaggttggagtgcagtgatgcaatcactgcagcctccggctccctggctcaagttatcctcccacctcagcctcctgagcagctgggactgcaggcaccaccatgcctggctaatttttgtaatttttgtagaaacagggtctcgacatgttgcccaggctagtctcagactcctgggctcaagtgatctgcccacctcggcctccctaagtgctgggattacaggcatgagccacctcattggcctcatatcttattacggtttgtcttgagttcaaagcaaaatgcatttctttgctaatttctttgggtacatggctgtttgtcttctcaagaagttcgagacccccgcccccacaactctgcagcagtctctgtatttccatcgattttttatcctatggataccctgttttccacctttgtttgaaggaatagaaattataacctgaccctcaaatgagtatccagaaaaaagtgtaccacttctagtcagattccctcaaaagttctttgtcagattttaatttgtttgaaggtcaaccagattcctctttatccctcaaggttcagcataaatgtcatgtactctggaaggtcttcttgaattccccaggccaggttaggttcctcctttggaagtttccatggtattcagtacttttctttacagagacattagcataaccctctgcaaccacttctcaaaacagtgcatgtactgcccctctactggtctaagtcacctaagtgagtaccatgtcaaggaaagcgaagaacaattgtccccaactgcattcctgtggcttgcccaaattctgacacacagtgggctcccagcattttccaaatcacagactctgattatttcagttctcagacctgggtcccagaagggctgccttcactttggtttctctaggccagcagcttcttgtataccaagtccaaaatctggatctcctcaggggcatattctgttggctatatttccccccacccactatgtatagggcagaatttcttctttcactgcatgtctcataaatttttgttggaaattggtcattcaatttgcaatatactatatattattgtcattcaatgtcagtttgagataatgacttcttggtctgtacatataaacattgttgtaaggatgatgctaatgatgaaagcgcatgcaatatatatttttacataatttgggtatgaaccttttttgtgggggttggctaacgtagtaatagttggtaagattaaggggatgagggctattatagtagtggaagaatacatgtttgtaacttttatttggagttgcaccaatatttttgcttcctaagaccagtggatgactctaatcctttaaaagttgagaaagctgaccgggtgcggggctcatgcctgtaatcccagcactttgggaggtcgaggtgtgtggatcacctgaggtcaggagtttgagaccagcctggccaacatagtgaaacctcatctctactaaaaaaaataaataaataaaaatacaaaaattagccgggcatggtggtgggcgcctctaatcccagccactcaggatgctaaggcaggagaatcgcttgcacctggaaggcggaggttgtagtgagctgagatcgagccactgtactccagccctagcaacagtgtgagactccatctcaaaaaaaaaaaaaaaaaaaagttgagacagccatgttgtgggcatgggggcatatattatacagataatatcttgtaacaactcttttatcagatttctccacagcccagtgttcatggctgttgctggtttgttgctgtttttcttgttgttgcgtgttcatgtagtgaccttcctgaattaattctgtctattctgttttcctgggagtttgcagcttctaagttctcttctagctcttatttgtttttatttttgtttgtttgttttcttctgttttgagacggagtttcacactgtcgctcaggccggagtgcagtgctacgatctctgctcactgcaacttccacctccctggttcaagctattcgcctgcctcagcctcctgagtagctgggactacaggtgcatgccaccatggcaggctaattttttgtatttttattagagacgggtttcaccattttagccaggatggtctcgatctcctgacctcgtgatctgcccgcctcggccttcctaattgctgggattgcaggcatgaaccaccatgccaggcccttgtttttgttttttagttcttgtttttatttttcaatcctgattcctagtgattatgtctctgtcagtataatttagtggccagccaatgagtggtcagattttaaaaaatgctttgctatgtgtcttcctccctttgccaaagggacctatgtggataccttgaacttcaagcatcttacaagacagccttagcttttacttcctgcttgtgcagggcctcaaggtcagtcataggtgagtgattggtgctctcttctttccgaggtctttttcggcatgtacacatccatgcacatgaatgcaaccttgaagattcccaggagcatgtaggagattttcagagtctctctgatcttctccaaaatttgccattaaattccacaccaagctcttctttgctccagctaaaatcgcaaccttatgcagctgagaggtcatcaacaatgtgctgtcgttttggtcatgcgctggagttagccctgcttctccccaaaccagctgaggtctgacttcaattaaataaccaccacactgtgagaacagagatttgtcagggcaacatgactttaaacaaagtgttgactgtgctctaataatggtgcttttttaatggaacgtcaaaagttctcagatctttcaattgtctgcaagactgcaggcttctggccactggaccactggaccactggactgggaagaaggggaaaaatggaaacatcaaataccccacatcttcccgaggctcagtagtttctctcgggtagacaattttcagttcttcaatggcttaggttaattgctagaactctgaaatggttgattttatttattttgcctgtatttatgttgttttagagagagagagaatctaccaggttcctcaatctgcaattctggaagaggtagtgaatgtgtagttttgaacttgtgagtgttggtgggattttgaatgaatcgtgccaccttaccagctatggaaaaggatgttggctaattagtggcacaaaaataggatacaagcaatctaggaacttaaccaaaaaaattgttttaattactctgcaaatatttacttacacgtaaacaactgcagtgatcatcacacatttttcttatctatctaaagtgaatttttaggtttgtgttgttgcagttggtggccatggtaatgagttgtgtatgtcttgtgaacacttttttggggtaaagtcaactatttttagaaactgaaagcaataattttggtgtttactcctgttaatctcaattattgaggagtacacagagtgtggctgatgtatgaatctcagctgttgggggagccgtgtgccccactctcccatatactatgtagattcttttcagactgctttgttggcccattgctggattttattttttaatgttttattctgaagtaatttcatgacttatttggcattacaggaaacaagccagtggtaagaatatttaagtggttaggtaagcaaagctgaactgtaaaacttttttttattaaaacagtttttatttcagttttttttggggagaaaaggtggtatttggtttcatggataagttttttggtggttatttatgagattttatggcacccatcacccaagcagtgtacgctgtacccaatgtgtagtcttttgtctcttacctgcctcccacccttccccttgagtccacaaagtccattgtatcattcttatgcctttgcatccttatcattgctggctttttaaataagggaatctatgaggcatttcttactaattccattgatgtttatttttctgttccgttaatcactagaaacaagggaatatttgtggctttgctcatgttaacttttatctctcactgaattctggacacgctaagttatatatgtgctgcacttcacttttctaccctcttcaagacaaaaacagaaaaaaaagttttctagtcacaaaatgttaggcaactaacgtttattgcctgactaatcattttactttattgactgagtaatcattttatctacatgatgccactgggaggtagtaatttgtgaaataccaccttggacaattcattttctttctccgcacaaggcctggggatgcttcgagccagattgtgctaaagaatgtcatgtttccaaaggataaggtttatcttccatgaaacagaccatttgcaaaattaataggtaaattagcaaagtgcaacagcccattagacccactgtcagagtttagaatctgagttggggaaaggaagtaaaagctaaatgtgtaaacagaagtaccctgaaatgacagcagctgtcattctgtggtggagggttgcagctgcttaaacaaagccagcggagtgctgttaacatgcagtcctgtcaatatctgaatatacactcacagggcaaatgcatgggctataagaccagagctaggaatcatgcttactcagtgtatgttaaaaacattatactgcagggaaagagtcagagcttatatctaccaaccatttcttcatttatttgaaaagtttctattgaacactagctgtgctgaaattttaataatccttactctataccaaagctctgggtatggccatccttttctccctggagagctgactttctcttgtaaactggaaacagctgccttgatagccaaaaggttattgactattttggcttaagcatggactttacaatcaaatggactgtttgaaagctgtgtgaccttggaaggtttttgaggctttcattgtaaagtgaggaggatcccaccttgcggagtagtcttgtgatgattaagcgagaaaaatctatgcaatactcatcatagatagctcttatttaattattagtatgtgccaggcagtgtgctaggagatctacatatagcatgccatttaattctcacaacaaactgtaaggtggcaattattatgatccacagcttacatttggggaaactgatatttaagaggtcacacaagttgtccaaggtcactgagctagtgagtggtgaaagtggacttgagatccatgacatcaggccccaaagccttgacttttaatcaccaggccttcctatgcttacagatggtagccctcaacagatgctgggttccttctttgtccttattacccacttccacccctcatgcctgccataggaattaaaactcttcaaagtacttttctagatagcctctgaggtacacaatcttcacattggttaataaaggttgttgatcttcaaaatgtaaattgcttgtgagccgagacacccctggatgaaaatcccctcggatacttcttgtaattctgactgcaaaagtgcagggggttcatttcccttttccttctcatataaattaaagaagacacattatttccattttcctgtctcagatcttgccttctccactattttggaggctgtgcagaataaatactgtaaaatggctcatttctgcttacactttatttcttagtacccacatagatcatctcaatcacctatagaaatatttgtgtcaaaggctaaggcagctgataaaatattttccttgtaggttatgcatctgagtatcccagcatctcttcattgaaagaaaaatagttacatttggtgattgtgatgacttaaggtagtgaaaatatttttactgccaacaaaagcagttttatggtgctcaatcctgaatcactaaaatctggattttcagtagagcaaattgtactgcttataactgaggttttttaaaacgaatgcaatttattatctaggcagtcttctgtggcagatttgtctatgtggttaatgcctctaaagagtctgtagacacccaatatctaaagtaagtgtgtgtgtgtgtgtgtgtgtgcgcgcgcgtgttattgagcattcctgtgatagcgagggaatgaatggcacataagctaaaatgctgagctcctaatttatgtaagattcagaagcctcatgttataattctcttgagtcctcattttttttgctgttttttccctccgctttctaagtttcttattctataattaacttttcataaatttaggtcatcttcacaattttattatgaagacctcacagttgttttgaagcaattgaggtaatagaatgttggacatagaatttaacccttggcccatctaattccagaatttcttgtcatactaccttctgtagaaattggtgaacagtctcctactcttaaatagagacagtagtgtctggggtgagtgggagaattcaattcaatcttttatttattagtggcttactttttgctcagcactcagctgtgagctggcaactggggagaggtacacagacactagatagttcagacccaattcctttccttaagaaaattatcatatattttggaggagtggagtaaagaaggcagcatgatctcaagaaagatttaaaggacaacatgacacttatttgaacagcagaattctggaagcaaattagtcttgtggaaatttagaaaactgaactgaaggggtaggaggatactttgtggtagactgtgatttaatggatgtgctaaatactccccaaagatggctcacctatagaagaaaaggacctggtaccggagagagggaaagatccagcttcccctttgttccagatgagcccagccttgtcaacagtcctttcccacatgacagacatgggagtgaagttatcttggacattccaatcccagctgccatctgactgcagaagtttgggaagctccaagaaaaactagaaaaagaacatagtcaacctgcggagttgtgaaaaataataaaatagtgctttaaagccacagcatatttggggtggtttgttatgcagcaatagatatgtggagctttgaagatttgatataatctagacaagtcgaccagaattataagcaccagaagttgtgagaaataatatgaaatttattgacttccgatacaagttttaaatacatttttaaaaatcccaagtaaattctataaagcagcactgcccaatagaacttcctgaaacggtagaaatgttcttagctacactgtccaatatggcagccactagccctgtgggtgtagagcacttgaaatgcagtcattgcgaatgatctttttgcaatccacaagttgagttgataggagagaaattaccagagtttgtggctatgttccttctaggtttggcgtgtgattagttgggtacctggggctagagttgcaacggagagaagggccatagtgccactaattctctccatgccagtgtctctcaaatcatggtatgtaagattgggatacctgttaaaaatctcccacacaagttcttctgcttgaagagcctgagcactgcattataagagggagtctggattaggtagtgcaggtgcagtctctatactcaggtcttcacttaacaaccacccaatttatctagatgactgtgggtggtgttaacagctaggccttcctgaacagttattaagcatttcattagatatgtttaacattctttaagaccttttaaatattacctgttttttctttaatctgaaatgtgctactctgcaagtttcattatggttcatgggtttccttttcacacggaattacatttttcttaacttcctctcttgagtgcttggagaatattgatgtgaaaggtggttggtaatcacaggaagcaacttctatattcagaaaggatggtacttcctgatcatggaaactatggagaaacttgtacgtggcaagtagagagatctgattgaactacaaaaagtctgtaatgaaaaatagctattttcctttagaacatactttctctcaggcaaaaaccctgattttaatgaatatagaataatcatttgtaatattagttaccatgtacataaaattagggtaataaaatgtggaggtatgttatgtgtttttaatagattaaatttgccctgttttgttatactgaggtagacatttacttatcaaattatgtattcaaaaattgaagaatttattcaagtacattttactagtactaattctgaattgatagtgttcaaatttatgaaactcctgtagtcatcaaaagcaggtgagaatcctagggtcacaccccctccagaccttgctttatttccttgtagacattgaaggaagcattgctagctataagatagtctttcctgggatttttccataaattctctactgcaaatttcatactataacttaactctgtatcaattgccaacaacaaagacggcaagattctctaattggactttgttttgttgaaatacagctatgatagattcttttggcaataatatctttggaaatgctggaataaagtttttttaaaaaaacgaatagaatcctgagggcatatggggagtctagaccttattttttccttgaagatattggaggaaacattgctatctatgagatattatttgctgggatgtttccataaatcgctaccacttgaggtattattttcataaatttgctaaagggggcaaaattcagggaaaacatcagttagtctggatgactattttagaaaaaggaaaatgcagaggagtgagtcagatagaatgacgtagaattttaggataagtcatagaatgttgggttcatgaggaagcacatgataattcaattaatacaaaaaggaagaatccattgtacgattggaaatactatgaggctgagttcactcggggacatgcagttagctagcaagtgtctggggaaggggaggaattacaaagcagagctgtgaaatatctaatcagatggaccttttaagcaataatgtattgccaaactgatgaaaagtcattacctttgaataatagcccacatctgagagttaattattacagggtgagactatgggtgcctcatgcggacaaggtcaattatcttatacctattaaaatgtattatgaataattcacaggtaaaagttagctgtaaaacacgataaaaataaaaggtgaggaaaacattgaattcagtggtaatgtattttgataatagcaggcagataattatacaaggataatgttcacacataggatatgaagaattactagtcagattggtcttcttaaatgaacacaacaacccctgccattctcctgcttcagagaactgtcatgttattgcttttaatgtcactactgtttctactttgcatgccaccacgcccagctcagtagacatttatcaaatatttactctttccttgggtttatgtcaattcctggggattcagtggtaagaccagagcactgctccttggaaactcacagtctgatgcaggagataaatcagtaaacaaataattttaaacaaattaaccattatcgggatgaagatatttgtagaggcctagccctgggaatggattcttgagagagattaggactgagcaattcttggatcttggaaggtgaatgggaattgaccaagctaagatgaggtcggaggaggcatgtggctagaaggtgaagttgggtcatcagcaaaggctctgtaacataaaatagtatctggtatttgcatgtgtgtctctgcatgtatacatgtgtatgcacacatgtgtttgcctgtccacatatatgtatatgtgtgcacgtgtgtggatatgtgtgtttatatctgtgtatatgcatgtgtgcatttatgtgcacatatgtgtatgttcagatgtgtgaatgtgcatgtgtgtttatggtgcgtgtgtgtgtttgattgggtggggcaatggaatcagaggtgagtcagtatctctgcagcataggtcaaaaaacacttcaatctctatttataatcttcataatatttttattcttagttcagttggtcttgctgtgagcagaagtacagacttctgtaagaagtaaaattagcattacttcttttctctcccattttgcctgtgtgcccaatataggacaatgagtctttatacttttgtagaacaaagggaaagggggtgttcagaaggaaattgtaagagatgccaaaaggggaagttctgttctccctcacactctttctgttttacaactctttcatcttcacttacgggaaatttttttttgtaatgaatatacattacttttataacttgagaagaaacaagggatgctttaaaaaccttatgttaagcaccagtatgaattctcacttggagtgaaaagtaaaaaaaataaaatcatctatatctattaaaaacacattaagtatcagcacaaggtctattatagaaatgtgaaactattcagttcttgaatattaaattaattatttagattcattcagagtgcattttgattcaagtggtcttactacaagtcaacatgctttgtattagttatttatttgaggactcttcctcatgcatagtttttcctctaaaccagtctccagaagcagtgtttcccctcactgagcaacatgaatatacagacaatattcaaacgaattttttccccaaatcaccaccaattcttgtctgcaatacttaatagtcttctatcagatgtccctgtttccagttctttgtttcaccaatatctgttatgcaatgttgcttaaattcttacctaccaggtaaatgatagacatctgcccaagtcactcaaggccctctgtgaccctgctccctgctggctgggatctccagcctctctcctgctattcctctacacttcccctaaccatccaagctctttctagcctcttcacattttcacactgctccctctgcctagaatacccccatgtctggtacatcacttcaacccctccttaggcattaagatttcattctaatatggtctcctcctcaaagccttccttaatgtctccaagctaaattctcctgaatatattcccatggctctttgcttattcaaaaatttatcatgtcttagtgtaaaatttatcatgttgctatacgggcaaagggaaaacttcccctttaccctcaaggtttgcagaaaatcaatgacaaaaggcagattaataggagaaaaggcaaacaaatttacttgatcatacttttacacaatacagaagccttcagcgtgaaggcccaaaggtacaggggaaactccatttttatatttaggctcaacacaatatgaacaactgtgcagaaagatgattggacgagaaggctatgatctaatgcaaacagactgagttggaaaactcagaaaagcctgtctgttggcttttcagaagggtaagaatttaagcaacatttttcttggcttctctgcgtagcattcttccttctgggtgtaggggttttatgacctataatcatacaaggtaggtcagatcatttctttatggccagtttttatacaaaaagttggtgggtaaagttagagtaatgcttttaggttttatggctggctttggagaaaagggattctgatttctattgtctgccttgaggaagagggattctagtttctatgcctagccttaggggagaataagaggccagaaacagcagggcaggagatggtcacaggacaatgttggctttctgaggacttcatttcatttagggatatcgttttctgatcctcagtattgttgaaattattttgtttcaggctcatttatctcatattgtcttgtaaattcaaagaggaagatgcttctgtgtttgtaaccctggcaccatagcacagtcgctggcacctattgaaaactcagtcagcgtttcatgggtgaattaatcattccatgcgctcagtggtcccagttttcttcaattagaccatgaacttctgtgatctggaacttctgcacacactattgtactagataaaacatgtgatgtgataaatgcaatgaggggttgtctgtgaggatgtccaccagcaattccttccatccctgtctgtgcactctgctcttcttattaagagacaaaatcgttttccttccccatgagcctaggctgccttgccactatgatttgctttgaacacgtagctctgggccagtcctctgtcttggcattaggagatatatcggcttttacttttgtgctcttggtatctaacagccatgtaaagaagcacgaattagattattggatgataagagaccacatgggcaaagaaaggatgaaaaagttctcagttcttccaactaccctagttgaggtgccagacacatgagtgaagccctttggggatgttccagcaccagatgagtgtggtcacagtgaatatcacattagaaagcaacagcccaggaaattctgagaaatagttaactattttcaaccagaggtcagcaaacaatagctcatgtggcccactgtttgtttttgtaaataaaggtttattggaatacagctaagtgtattcagttacatattgactatagctacttttgcactactgaggggagttgagtagttgtgtctgagaccatatggcttgcaaagcttaaaatatatacaatctggccttttacagaaaaatgtatggactctgttttaaggcactaagtttgatcaagtttgttaaacagcaaaagatcactgaaacaactgctctcagatttcagcttatccatggaggttggaagggggaaggaaagatgtcacaagtgatatgaggtcaggccttaatgtgcatgcactgatgagagtccaggacatgaaggttggtacaaacagaaatcgatctctttttagctccagattttttctccccctttcttactaattttgagaaagaaaatactagcacagactaagcaaagttaagtaaaacatattccccaattatatgcagatgatgggattagagttgctgaaggtattatcttccctcattaccaaaagaaactgcacagtgaactgttgaaaggccaggagaatgagcgccaatggtctctgggggaaggtcctggctgatgagttggcctcttcttgttcagcttctttaactccctcccagcttgtgattccccaaagggcacatccatctgttcttcagaaatcaaagaattctttgtgttttttttcctgtgacatatgaatcttttctggtaaattctgaaatttttttacccacaaatttcagttaatagaaaggtggcagcatggcttggtagcaagagtgtgagtttcagagacacacagatacgggttcaaatcttggcttcactatttttttttccccgtttgggcctggaccaagtgctttaaccttcctgtgcaccactttccacaaagtgtggacaaaaatggaaacatagttggcacagaataaatgcctttttgttatttttataatcaaaatgtattctttgactatgctctgagatgatctcattcaatgttcaaaataaaaatcccaggaatatcactgcttacccagaagagtttaacagtaatcaccatttgtttgggaacataatgtgtccaagacattgtgcaaagttctgaaataacaaagatgaatatcataagtcatagaaacctctttagtatgaggattcagaggtgttaacagtcagacctactgggatagagggctaggctgagttttattcgtttttctgaaattagaatggtaaccattgatatccattaagtgcttaccatgtgcctaattttaagtactttacacgtgttagttactctgttcctgacgcccctgtggaggccgtggctgagacacagatgtaccataatgagctgtcctttccctactgggctccactgccctactttaacatcgcaggcatgggccagtttatttttcaatagagtggaaatgtgaagatgtttaagcctatatcatattaaatggtgtcataaggcaaaataaaacaaaagaaaaaacaaaagaaagcaaaaaaaaaaggcaaaaaaaaaaaaaaccaaccaaccagcttgactgttgtgtttcttcacagctggctctaaccagcacaagctgacaaggggcagtgagctttgaatgtccattatctgacctagctgaagacacttgcctgacccatgaacaatgggatttcgtataaacaacaatgggatttcgtataaacaactgtgtacacacttatgggctcattctgttttgtctgagtgctggtgttcattgctgagttggcacagctccatgacctcccacttctaactttaaaactcctgagcttccccctctttagtgacctactcagtaagtttcttcaaatgaatgctttcaggcctaggtagtaaacaaacttgacattttaattatttaaaaaaatagttttgtcttatttttaaactctagtcatttttatttagttctttgatgaggcatagagtgaataagtaatttgctgactccagcttgtagttggcaaagctgacatttgaacccaagcaggctgtccctagaacctgcattcctgccatcttatgctgctcgcctgcatagagtcaaatactgagcaccaggctcttttctatagtgaaatatcaggtgcttaaacatagtctgaaatgatcttcatagctgtgtggtttggcagaatattggtaaagaccttaatgatataaaaaataaaaatcactgattataatacatgtaaacacataggcacaggtttttagtgtccctagtgttttaatggtaatgtttaataacaaggtctccaaaaaaatgtgaatgtgtctagatacaagcttattataaatttactggcatagaggatgcagagcaatttacaaataatagtaaaaatgcatgctattcttactgtacattccacatgggcattttattctcacagaatgtattcattgattttttttccaaatcctggcattcatagtcaacctacagttaacaattgttgaaagcatataaacacaagtaccagtcagtattttcatttacatcagtgagtaagacaaaagtgaaacaatgaaggcatatgctaaagctttgcttgtttgtcaatgatggaagctgcttctttggcgagtcaaataatagctttagaatactagtagaatatttcctaaattgtgtgtgtgtgtgtgtgtgtgtgtgtgttacaatgtaatggaagcaacatgacacacttttaagtttaaatctatattactagtattttctccatcgctttcttcagtccagagaatcgataaaacaatacatcaggccatgatttgtataataacagtgtatagtttctgtggtgtgaataatcgcaccatggccaatcttaccgtaccaccatgcagttcctgaaggtggacctgagcagaagtgtgcagtagcacagcacttgcagttacaatagatataaacaatctcaagatcacagacatttgtgaaatgcagtcaaaggacagaaaatcatgagttgagtattgtctttgtttttaatatgattcatcagttgtaagtttgtgtaatttatcttttaataacaactatgtttcacagccaattcacaaaatttctgaatatttagcaagcagctcccctgaactagtataagctgtctgcagaacaccaatgggtgtacatgaagaatttgtgtacagggaaaatacaatcactgttttgagttagacttcaaaatatgcacctaaactctcagacattttcatatcatttataatagaggaaatgtcttccaaacttaagtgggatgcaaagggtatgttaacatatctcaagaaagtctgtgttaatcgaaaggaatctggtcagctgaagcagcagcaatctacattgggtccagatggagggagctaggactgatagacagctcataccgatgtccccattgcccaggctgtcctcatacagcaggtggagagaagcatcactctgttgtcttctgggtgatcattgcagagtgaagagtgctcggcacctgtcccaggttccttgtgcatatttttgcttgtaattgttaaaacaaatttcccctaggtagtagcattgcttctagttttaaaaccatgaaactgaggttgaagacttgtgaagtaattttctcaaaatcacttgtctgttaagaggtggagtcagaatgtcaacctggagaagaaccccaaagctttccctcttttatcctgaagattcaaataaataaaaaatacttagagctgagaatcacctcggatgttggtaaaggtcatgatgctgctggaggttgttcagaggatccagacaatgatggctggaatgattcctattaaaagtgaagaaatgttactggagtgaagtttggaatatttcagagcatatgttttcccccagtagcaagaattcttttgctggtaagttaaagaggcaggaaacaatgcagtgatattttctgctttcccttatgccttctgcacttttatcccagaacttcaagtgcaaattaaataaaaaggcttgtgatcttttctatcctagagaaataactccttaaacatccattctcttagttttacttatcttttcttaccttctgcctctcagtgagaagtagtctttaaatgaccagtgaaaggctgattcctgtctagtggccatagtcagccctgccttctctccctggagctactcggtgcctgtctaagtcactgagtcatatgtccctgaaaaggaacaaggaagttatgttcatttaataatctcttaaaatatggccttcgtcaaataaatcaatgaacttaagaaaacccagaactcagggcgacttgccttctgactgtgtgacttttgaagcatctaaggtgagcgtgtcaaataatacatgacgatcttcaattctcaaacgtatgcccagtcctgacaccatcaccactaaacacacattcacacacacacatacgtatccataagtacatttttcttgtaacttccaggttaagatttggttcaataaagcagatctggtatagctagtgtatcacttatggattggggcttttatttctctttttaaattcatggaattttataactttgtgggaaagtaagttttgtttctttcagccttttcattgcatgagaatacagtgtctcaggaaggttaattgacttcatttgagtcatacaaacatggatccacttaataataaatctgcttatacaactcagatgccttgatttttttaaaaaaaatctttatttgttttagaattttttaaatttacggaaatactgagacaatactatggagttcccatatacactgtacccagtttcttcattattcacattgtacatttgtgtggtgcacttattgcaattaatgggcccatattgataaatggtcattaactgaagtccagagttacttggattaccttagttcctacccaatgtcttttttctcttctgagattccatccaggatgccatgttacagttacatgtcatgcctccttaggctcctcttggctctgacagtttcttagacattcctcgttgaaaaccttgacagctttgaggagcactggtcacatgttttgtagaatgatcccctcatttttaatccagtgttatctctctgtttattcaatacttgactttttttctctaggaacttcaacaaggccttatcttaccttaagtgagcaatgtgaatgagtaatttgatgaaaagatctgaaaggacatcccttagtttgaaaaaaaaaaaaaaaaagctgtacccttccagaagcctggcataaggccagcacatccttcactagagacttcttcatgcaggagtgccctccggagtgcagacgctgcctgagcagaagcaacacaccaatgcttcatcatctgttaatatccttgcacaattactttatatatatatttgcaaacatctacctgctatatactaggcactgttctatgaacttgcattaattaattattacattatttcagcacccttatcagatagattctattattatcctcattttgtataagaaaaccaaggtacacaattaggatgtaatgtgcaccaagacccagaggggagacagaggatggactcatagaaaagtagaagacattttagcatgaagaggtgtgagtggtatatgatggggccacatcctggaagccctttttggccatgctaagaccatagattttttccccaaataatgatataatacagaaagattataaaaaggggtatgatctgctcagattcatattttaagggaattcctttcctgcagcatgcaaaatgggtttgaggtggactagactggatcagagaggctgttagatcttatgggtgagagagataatctgcataaaggctgaggaaaggggaatatttcttggtctctgaaattttgcttcaaacaggcctcattctctgcagatactcagagatgcaactgcaaaactcaagattttaatatgcccaagtagacgagaggatacacacacacacacacacacacacacacacacgtttgcttatttatatgtatatatttagttatttatcataaattgattggtagcaggtactaaatcttttttcttaaacttttgtaagcaagaaatagaacatttttgtattttgttcctatcaaattgaatctgaatctgagctgagatgcaatcttggtgatgattgggtcattctacctgggcatgaggactctggaaggctcacatagtaccctgaactgggggaggtcttctatgcttctgctcatcatggtcgacactggcattcccattgtccaggcaggtgctttccactgctgactcctgagagatgtaggccaaagcccttgtctctgccccaagtgccaaggtgtgtggttggccatcctagcccctggggagcctcccactctgaggatttcccaccccctaggccattagaaaacctgcatgagagactcactctgccctctttccacagagggacacttcctctcttttcctcagtgtctctgcctctgatccttcgaagagtggcagcccagtgtgaggaatggaattctgtatgatgatggacatgttctattctgcattttccagaattgtagccactaaccatcatttgaaatatggctagtgcaaatgagcgatttaatatttaattttatgtaatttaaattgaagtttaaatagcctctatggctgacagctacaatactgtatagtgagagagagggagaagccaggaaggaagttgatttaagcagctgtgctttctgccttgcaatgcaaatcacccctaagaagattacgtgcacaggggctttgtggtctgcttagaatggggagggaaatatacagaaattcttatctcaatacatcatcctgacacagatacattcactttcatgcttatatgctttggatgcgttgcctgtttgtaggttgcagggaggggctcagattggtaattgaagcaatactggaaaactcccccagaatattttctgctttcctttctcaccctacagtctacccattggaagcatggccaaagtcagggaggttcaggacattcaatgctgagcgaggtcagcttcagccttgcttcactcagcagagtcaagtgaacaggctgtgctgggaaatgggatttctcagactctcaaggttgtgcggatgtgccaccacccaccaacctctcccttggctgtccctcactgcttcagtaacccatacttagaaagcacattcaccatgaatgctcttagcaatcctgggaggttaattgatggaggtggtcaagacaaagaggcatttggtcatgcctagaagtcactgccaggctctcccacaattctcagtttcagagtcctataatttgttctttctcctttctttcttttctttctttctttctctttctttctttctttccttctctttctttcttctcttcttagatataattcatatatcataaaattcatcgttttaaagtgtttgtttcagtggttcttagtatattcacaaggttgtacaactatcaccactatgtgatcttaaatacgttcatcaacccaaaatgaaaccctgtacttgttagcaacttctctccattctcttctcctctaagcctttggcaaccattaacactaatctattaactttctgtctttatggatttgcctattctggatcatttatatgaataaaaccactcaataaatggtcatttgtttctggcttcttccacttaatagaatgttttcatgatttgtccatgttgtagtatatttcagtacttccttcctttttaaggctgagtaatattccattgtgtatacatatcacattttgtttacccgttcctcaattaacaaacatttggattatttatactatttggatcttatgaataatgctgctatgaatatcactacaagtttttgtaaatatgtttttaattttcttgagtgcatacctaggagtggaatggctggatcatatggtaattctatgtttacatttttaagaatcaccaaacttttttccatagaagctgcaccattttacatttttattaggagtacttgaagagtctaatttctccacaaccttgccaacacttgtcattgtctttttattatagttatcctagtgggtgtgaaatggcatctcattactgtttgatttgcattttcctcctcaccaatggcattgaacatcctttcatggtaaaggatttgtcattttatttaaattgcattacttttctttgtgttgttgatttgcaagaggtttttttatgtaatctatatactaggcccttgtctgatatatcatttgaaaatatgttcttcaattctatgagttttcttttttgtatttttacaatatatttaatagtatatatttaaggtatacaaaacatgatattatgagatacatatagatattaggttggtgcaaatgcaattgcgttttttgccactatttttaatggcaaaaaccacaaatacatttgcaccaacctaatagtaaaaaggttattatactgaggcaaattaacgtatctatcatctcacatagttacgcattttttttgtttgtttttgtggcaagagcagccaaatctactagtttagcatgaatcccatacacagtacgctcttattacctgtatggtcctcataatgtaccttagatctctagacttggtcctcctgcatggctgctgctttgtgtcctctgacctatatattcccatttcctatgcattttctaccctcctctgtcaaccctggtaaccaatgtgttgttctcgatctctgtatatttgaattattattttttaggatctacctataagtgagatcatgcaatagtttcttttctgtgtctggctcatttcacttaccctcgtgtcctccatgctcatctatgttgtgacaaatggcaagatctcactcagttttagggctgaataatattccattgtatatatgtacctcagtttctttattcatgccttcaatgatggatgcttacgttgttttcatatattgggtattgtgaataatgctgctgtaagcatgggagatcagacatctttatgagatggtgattccatttcttttgggggtatgcattgaatagggatcactaggttgtatggtagttttatttttaatttcttcataattccccatactgctttctagaacaatctacattcctgtgaacaaggtacaagagttcccttctatccacacccttgccaacatttgttattttttgacttcttgataatagtcatcttaaatatgaagtgatatctcatagtggttttgatttgcatttccttgatgatgaatgatgctgagcacctttacatatgcctgctggcctttttatgtcttctttggtgaagaaatgtctatttacatgtttttgcccatattttaattgagttatttgttttttcttttactttctcttatgattgacctaagggggattttttgtcttatttttttcccaacattttactggaaaattttcaaatatatataaaatttaaaaattgtgtagtgaacgtcaatatactcattacctaattctacaattaatattttctctttatgacttatcagatatctatttttattttccttcaacttttctgagtatttctggtgcaacctccttctccttaaacttcaaaaattctttttctcatcacctaccaaggctttgatccattcagggctagcggaaaaagaataacacaacaaaaccaaattcttctgcccaaaatgaggatctttatatggaacatctgtatttgagtggtcaaatttgttgtcatccgatttacattaagcataagtacttctgttctgcaaatcatttaaaatgaagaattatgatgtccttctgtgaaactatgaacacttttttttttttttttttttttttttttttttttttttttttttttttttgctagtgaagaacttcaaggaggacaaatgcctttaatgccactctcaacttggtgtgtcctcaatagatatagtaatcctttagggatgtggacattgctttccccctaagacttagtgagtgagaggttatcttctctattgccttattttatgtccctgagtttaatagtgccaattccatggctgttgagtttacctgctttatttgctctaaagagaaagttcagcagaatttcagaaggggctggagaattgcatgccaagcagtgtctgccctatatcaattttgtacagcacgaggaaaagagaattgaaaccaaatttcccattatgtaaaagtagctattaaaaagatacaactgaatttaagatgattgtcaacagagtgggatacagcattaaagggaggtagggacacagttaaaggatttatttgcccttttctctcattttctgttcctcattttgtcatttacttcagaggacatcaaaaagtactattttaagaccaatctgaatttctggaacataaccatctgatatgcttatttcaacacatgaacatgaacagatgtttactttataatgttaaatgtgccagctgttctcatgtcagaataagcatctaggcattttgtttaaaagtgaaacaaagattttaaacctctgttcataaacctccatatgaattcagctttccttccttccttcctccctccctccctccctgtctccctccctcccttctttcctccctttcttcctttagccctttcttcctcctctccttctttccttccttccttctccctctctttcttcttccttccttcctcctccctttctttcttcttccttcctgccttcctgtctgccttccttccttattttgaaagaatcattggtttttagaacaatatttgctatttctggatgtatcatagcatgaatatcatatatattttattggctaatatcttcatgtcatatattacaggtctatacttgctcagcttgcatatcttctactttttaacctctgatccaatagtgatactttaacaatgaagaaagtacgagtatcataaaagaagtagcataaaaatctaggcaaagttttttatgttcaaacacctagatgctgcctagctttgtaattaattaagtcaacccttagcacatcgcacttaactacctggtcaccttgtgcgatggctagtttgaatataccataggcatttggtatattcaaaccatttggcttcttccctctaactactgatcttcccaggcaaagggaggctttaagacatcattctgcccaggtctcatctcttctacctgcattgcagctgctgagccccaaagacgataatcatagaaggtcaatgcctgatgacatcagagaagtcagtgaatgaagatcataatcatagaaggtcaatgcctgatgacatcagccaagtcagtgaatgacacactcttatcattgagcacaggactaaatggggtttaaagaaagtgtcctagatttagatatgagtttttaaatttccatccacagatgtaagaggctggctacattccttttggcaaacatccatgaattttggtagctgtcaccattcgaacagcattgcctattaggctttttattttttcctgttgtggcacaaaaacacagaaggtcaaggatttcccacattaaattgctttagttctgtattctttatgaagataacataccggatttaaatctgtactccaaagattgcactgggagtggggcgacctaacccacaaagatagaactggtggcctcagcttagacttttctctattgttgcaagcacaggtgctccccagggggcccgcagaggggctttgccatctggacaagtagatcagccttgaaaaaatcattaacacctaagtgaagtgttcttttttttctttcttctgattttttaaaagagattaaacaaacataataaaagagtgtttggacataaggtgtgaaactcgttatatcactattccaggaacatgccaggaactatatctgtttacttattcctgtccattggaaggaaaaatagaatagtatgcagtccttaaatatgtttatgcagaatgtgttatatcatagggaagtgattttaaaatatcattaattgatgagacagagtacttcttatatgtttaatgttatatcaactctttaaaaatgtttgcctatgtataaaaagaaaaaataattctggaggaaaaatgccagaatgtttacagctatttcctggttacagtggtctttgcaggagcctgtaaatcctgacatcatccggctgccagtctccctacccccaacttctaccacctcacctccccctacaccccagttaaaccatgtgctttctattccccatctctcagcttagcatctttgtgccagctgatgccactgcctttccctgtattcaactgcttagttaattcccttaccccttcaagtttgactaaaataccactttttctaggaggcctgtgctcatggagacactcctatgtagtcttgctgctgcctattcctttccccatgcccaatctccctcagtgtctcctatttttgctttttttcttagtactttccacttaattgtgtactttataatcatattatgcaacatatatatagttaaatgtatacatatagttatgtattacacacacactttttttaatagagtgtagcgtatgtacaagcacatgtgtctgtgtaactctcctttccataatgtaaattccatgagggcaaattacatttgctgtatttaaatccaatgcttggccaggtgaggtggctcacacctgtaatcccagcactttgggaggccgaggcagggggatcacctgaggtcaggagttcgagaccagcctggccaacctgatgagacctcgtctctactaaaaataaaataattaggcgggtgtggtggcatgtgcctgtaatcccagctactagggagactgaggcaggagaattgcttgaacccgggaggcggaggttgcagtgaaccaagattataccactgcactacagcctgagtgacagagagagactccatctcaaaaaaataaaaataataaataaataaacaaatccaatgcttacaatagtatcttgcatatagtaggcactttaaataaatgttgaattaatgggggttgacattatggatgatttataataagaagaacataatacaattccataaaacaaatgattttttaatagcaaagagagtatgaatagcataaaaatgagtagcgtaaaaatctgagcaaagtattttagcaccataggaaaagtaaaaaaaaaaaaaaatctgaataaagttttaagatgttcaaatacctagacactgaatggtcttgaaattaataaagcaaactgttaaatttcaggttaacccttggttcatcatgctttaccacctggtcaccttgtgtgatgtttagtttgaaaataactgtggacatccactgtttctccttcactctaggcctctgatcatcacaggcaaagggaaaacctaacagctcattctgcccaggtctcatctctcctacctgaattgctgttgttgggtccagaagaaactaatgaatctatgcagatttgaccttggcactagagaattatgaagtagcagctctgattctaggttactgctccacaccatctccagcaaagggacttacccaaaagacgagtgttccctttccaaatgttagaaataattagttttgtaaggcttggggtcaatgtccattggtttgaaaagaaaaaaaaagacagaatttaaagatttctgcagtgtcaactcttttgtgtcttgcagccacagctaaagcatgatgcaaaatattaattcagggaaattttattttggaaaattttacattgatgtgaatttctgataatatgtgtattttctcccaaaacatttcttattagttcattgcttatttgtcatgatttctgtgtccctcagtgtatcctgaggctgggcatggtggctcgtgcctctaatcccagaactttgggaggccgaggcaggtgaatcacttgaggtcaggagttcaagaccagcttggccaaagtggtgaaaccccatctctataaaatatacaaaaattagcggctcatggtggtacatgcctgtagtcccagctactcaggaggctgaggcaggagaatgacttgaacctgggaggtggaggttgcagtgagctgagattataccactacattccaccctgagtgacagagtgagactctgtttcaagaagaagaagaagaagaagaagaagaagaagaagaagaagaagaagaaggaggaggaggaggaggaggaggaggaggaagaggaggagggggaggaaggaggaggaggagaaggagaaggggaaagggaagaagaagaggaagaggaagaagaaggaggaggaggaggagaagaagaagaagaagaagaagaaggaggaggaggaggaggaggaggagaagaggaagagtaagaaggagaaggagaagaggaagaagaaggaggaggaggagaagaagaagaagaagaagaaggaggaggaggaggaggaggagaggaagaggaagaagaagaagaggaagaagaagaagaggaagaagaagaggaagaagaagaaagaagaagaagaagaggaagaagaagaagaagaagaagaagaagaagaagaagaagaagaagaagaagaagaagaagaagaataaacaacttgggatcattcactgacactgaggagagggcgagagtccctgctcagaggtaatgcccagggtcacctggaggtctggcaagagagaaaagatgaggcatggactttgattccttcaaaaatttccattagaacttgaaattgagttttttgtttgtttatttgtgcaactggcattttcccaagtaagtgggaataaaaatacctctagaaagtgtggtacattttttgaactacatcacattatttcattatctaaataaatccagagtgcaataaatgttaataaagttttaaggaaaaaaaatccttcacatactccacccatcgcatcattgtcatgtcttagccatttaagagatcaatatcccaaacaaaataatcacattcctcgatggccagaaattgctagattaggagggatttgaaggtgggagcctgaattctaagtccagttctgcagtggctcaacccatgacatctaacaaacctaacacctctctacctcactttctatttctgtaaaatgggcatctcttcctttatttttctggattcaaaaagaattggttgttaaaggaaaatttttgtcatcagcctcaagtatcgtaaatttcctttcagtgcaagctgaattacatacaattattattccaatttggacatcttacagtaaaagtgacgacaaataacttcatatatacaagcaatgcttccaggataaaacttttaaaaaaaatcactatcaatgatgtaacagaaactgctgaagtgaatacagggaattaatatgtcaagtaactagttggacctacatgatggtgttttgttcactgttgctttctaaatcatttgagtatttacaactaggcttatgatgttctttgagttttaattaataggctaaaaactcaagtgaactttttttcacatttattactgcataaaccagactttaactcaaatagtcaaaatggagaggctttactgatgaactgcttacgaaggtgtcagtaggaatggaggtatccacaggcaaaatgaaggcacctggatgctagcaaaagtgggaagtcatcactaagcctggtactgaggaggaaatagagctggagcagtggaagagaagtgcccagtggaagctagagtcaatgaaggagctcaatcattggtagttctcaaaagcagagaggaatccagaaggaaatgtcatgatctcgctgtcatctccatttcctgctggtgcttctattggcgggcggacatgggaacctggcagtgcaatctgcagggacaaagaagccaaacaaaggcggaaaatgtatctcgggattggaggtacaaggaaaacactgagcacagagggatggaaattacaatgccgtttagtgttgtgacagacattggcatttatgtgtctttgctggagctgcagttctggaattccagagtaaggatgctacaaagagtttccttgctactacctttatcctaagaatgagtctgactatgtttttggtggcggtggattcccccatcatcacttagtggtcattaattgtgggcactaattgctgagttctctaagccagaattgctcagcagttgataactgtggtgaatcagcaattgtttatgtccatgctatctttggtgaaatcttacctgactacagagaagcttgagaaatgtgttttttctcctctgcaacctgggcagagggcccagcttacagcacccttctgtgaacactaaatcacagtgcaaactcactcaccgtgcgctgtgcttcattccacagaatatggagcagagcctctctgggcaaaactgtgcagtgggcagtatctagcaccatttgtattccatattttttcctgcctcgggcccataaaagtagcaagtttctttggacaatctctgctgcaatcagaactctcattcaaactgaaatgtgagataacagttgaagaggaactgcaagcttcctgggggagggagggtgtgtgtgtgtgtgcgtgtgtgtgtgtgtgtgtgtgtgtgtgctctttttaatagacttataaataaaaatgtctatgagggccaagcagtcacataaatgaagacattatttctacaaagacccatcttgtctaagcaataaatattaaggaaaactgccttcctgaaagatgttaaattacaaattttataaagttgaaaaaatgagtcttacataaatatagaatgaatacaagtagaaaatttgtataaccaattgaagagggaaccattaatgagttatataagtaaagttggttcaaatgggaagtaaagttggttcaaagaatgcttgaggaacagagatttgtgtagtcagtcaggacagcaatctgctcagagacaaaatagttaatatcttataagactatgaatcataatttttggagttaaaattatttttatccccactggacaaaatctacaagttaatacgtggtcctaatcaatagtaaagtgcacatcaaacaaagataaatcctctaaagggataattaatccaccagataattaaataatcttctagaaaattaaattaaatattgaatagatctgttcaacaatgcttcatatgacattgaaagggtatcagtcattcctttgtcctattcccaatcttcagctaacttttcttaagaaaataatatagtagcttctatttttctcagagtacaccatggttttcttaggtttctcaatgttgatagatttaaatgtaaaaaagtaattactttaaaaaatttcctacaaaattacaaaaaaagtggtcccgggtcttactttttgccatctgtagtgactgagtagatggtcatcgaagctggaattcagagtttgacaatgttgtgtttatgccgagatgatggtgagcagtgaagagaaaacccaagggaccccttacaggagcagctggttagtgggaatgtgggacccagtgttgccaagacttctgactttctagaaagccccaagaaactctttataataaatctcttgatttttaaatattgacaaattaattcagaagattaaaagcactgtatgggcaacaatttcaggctacctctggtcagagagtttccatcttgcaaatttcttcataagcaaaataaaacaagctttggtagggaaattctagtttctcagatgcttttgtacgcaacctgtaatagaaaaccaatagattttctctatataaatttggatcctagagcctagaatgtttaagtcttctcagttcaacaagagaacctatcatccattgtcggtgaacccatcagtcaatccaccactccatccagcaaatgtctgcagagtgtagacaatacaccatgtgtggtgctgaagatatggcaatttgcttccatctttcctggacattttgcagccaaatttcccagtctccagcttttgatcccaggctgactccttaattcactgcagactgactcctcccttcaaaacttttctgaaattactgttttcagagcaatccaggatcacttcattgtttaattcagcaaacatgtcttaatcgttatccagcctgacttttctgtgacagtgaaatctgttctgattttcctgaaaacctctctttgggtgttctggaaagttttccactgcttctctccttgccattactgtgcattcatgttgtagtagattcttctttcttcacttcttgattttttgaatttatcatcccttcattttacaatctttctcctataagctgggcacggtggctcacgcctgtaatccccgcactttgggaggcagaggcgggtggattacgaggtcaggagttgaagaccagcctggccaacatggtgaaaccccatctctactcaaaatacacaaattagccaggtgtggtggcacgcacctgtaatcccagctattcgggaggctgagacaggagaacagcttgaacctgggaggcggaggttgtggtgaacagagttcacaccactgcactccaggctgggcgatagagtgagatcccatctcaaaaataaaaaataataataataaaattaaaaaaatatatatttctcctataaaactcatcagagggaatggcacccacacacactgttccatctctccatgcccccaacatccaactagtcactgactcctttatatgctacttccataatagacttcaaatgatttccttctccctgtctctatctgctttagttcaggctcttcttattttgtactaaatgtaacagtgaagatgctttcgaccataagtaacagcaaacaggcaacatggcttaagcgatatggatatttattaacaaaaataatttgtatttgaggctgaagcaggtggatcatgaggtcaggagattgaggccatcttggctaacacggtgaaaccccgtctctactaaaaacaaacaaacaaacaaacaaaaaattagccaggcagggtggcacgtgcctgtagtcccagctacttgggaggctgagacaggagaatcccttgaaccagggaggtggaggttgcagtgagccaagatagtgtcactgcgctccagcatggacagcagagcaatactctgtctcaaaaaaaacaataacaataatttatatttggacagttctagtattgtttaattcagcacctcatcacagataagtaatttctattttttactattttccttaagcctgaccctagacacgtgcagaagatccagcatctcaacagaaagaattacatccattagcagaaggaagccttctttacaactcactttaagttcttggcctgatatccttttatgtcttattggccaggagtgtgtgatatgtctgtctaaaacaatcactgcaagagaaatttaagcacgttcattaatttagaccagttatgatttacttttcttctgggacttacctcccttcagactcatgttgggtggatacatgaatcaattagtagcagtagtgtaatcataataataactacaaataaggctaaatctgagcaggccagatgctgttctaagcatttacttgtattgcctcatttaatcctcacaacaaccatatttgctagacagcataattattctcattttacagcaatgaaaatgaaaggttagaatggttcaggattttgacaaaggtaacacagctgccaggactcatatccaagctgcctgatttggagctctgctcttgcccactgatgttctacctaacatgggttttattagcatgacagaagtatgtggagaaggagctgctgctggtgtgtcagacaattcaggctgctacaataaaatatcatagattggatggcttaaaaataacggaaattaatttctcacagttttagaggctgggaagtccaagatcaagttgtcagaaggttcaatgtacagtgagggctctctttctggttcactaacagtgccttcttgctgcgtcctcacatggtggaagaggccagagcactctcagccttttttttttttctttttaagagacagggtcttgctctgtcacccaggctggagtgcaataatgcaattgtagctcactgaagcctcgaattcctgactcaaaggatcttcctgcctcagcctcccaaagctctgggattaaaggtgtgagctgttgagtctgtccttcaggcctcttttataaagggcactgatcccattatgaagcctctgttctcaggacctaatcacctcccaaagggaaacctcctaataccatcatcttggaggtaaggatttcaacatatgaatttagagaagtggaggtcacacacatttagaccacagcatttggctaccaagcatctgctgaatttctactactatgggactgtaacaatgtcttcctttcttccttccttccttccttcctccctccctccctctctcttttcctccttccttccttcctccctcccttcctttctttctctgtttctttctttctttctttctttctctttctttctttctttctttctttctttctttctttctttctttctttctttctttcttctttctctttctttcctttctttctttctttctttctttctttctttctttctttctttctttctttctttctttcttctccctctttttttgagatagagtcttgctctgtcacccaggctacagtgcagtgatgccatctcggctcactgaaacctccacctctccggttcaagtgattctcctgcctcagcctccctagtagttgggattacaagtgcatcaccaggcttttctaatttttgtatttttagtagagacagggtttcactatgtcggctagggtggtcttgaactcctgacctcaagtgatccacccgcattggtttcctaaagtgctgggattacaggcgtgagccaccacgctgggccataacgtgtttcttatttccatccttgctccttttctcacctccctctcaaaccagcttccatactgctaccagaaggtccattccaaaacagaaacctgatcttctcttgtgctaatcgcccaatgcctcacagttacctttaggagcaatcccaacttctttatcaaggagcatgaggctcatcaacacctgactccccatctctcctccctagttcagcaaacatctttccttgttctctgtacttcaacgttgcctaatgaattacagcctccagataataccatattcccccatactctcttgactttgcacatgtggttattattattatttggccaagaatgtctttaggctctttttttccccccaaacatagtatgacatttcctctaggttttcttcactgacatcattctgagtttgctgagcttcatttttgctcccatggtgttccatgcattatgaaatacttgtttgccttctcaagagtcgcttgagtgtaagggccttgtaagctgcttgagaacagtcattgtgatttttttcacctctatctgctcaatgaatcttggtataaacactgaaaaaatacgcagaatgaccctcaaggagctcagaaattagtgatgtaaaacaaatatttgaaattaggtatttgtagttcagaaaatgttataatagataattggctcaaagagagaccctcatcacagctaaatacaacctcttaatttatgatgagttttatttgctatgaaaactagcccttcagttttgagtattgtagtggtttttaggtgaggttccatgtgtctcatagtgttacttcaaaggcaaaggcattaccttcaagttgttatccattatccaccattccctaatatttatggaaagcctttgtctgttcagagtaagcccagagtagctcctagttagggaattctaaatgcaacactgctagtgagttcaataaatatatattttataataatacataacacgtgaattatatattgtactttatactatatattgtataataatatttatggatatatttatatggagctacctacatattaaatatataatctatattttactggggccacatacatatacattttttacttgctaaacacaactaggaatccagagtccagagataatctggaaaaacctctggtctatcaagacagatttgcaaagtcatgtttttgacttgtagaaaatactctattgatcttttcagcagaactccagcaattttgttaattacctctaagacaaattagaaagtacaatttcacataagggatgagggaagacaggactaccatgaataagaaaacaagacagtaggacattgcaataagaggcaaaagtaatgctattgcttggatcccagtaatgcggagtgtgtttaatccttggttagttacacaaggcagctgaactgagtgggcatttcactgaagagaatgccatctgggcaccaagccttctgcttcaactattcaagcacttactatgtgtcaagcattgggctaaccattgaggatatagaaataagtaagatattagacatggctttcctgacatttagatcttgttacttagaaaacccatttgacggcttagagtcaaaatagcaacatcttgaacaccatatatttatgcctctcacatgatgtttttgggttattttggttcagactcctcactcattgctctctgtcatccccccaaagctaaatttattatgatcctgaatgtcttaccaccatgttcccactgaggctggaataccaaagaaaaaaggagggtggaatttttatttttttctttatactttaagttctagggtacatgtgcacaatgtgcaggtttgttacatatgtatacatgtgccatgttggtatgctgcacccattaactcgtcatttaagaagggtggtatttttctttaaggaacatgtatcatttccatttatataccattgatgagaacttagtcacacggctttaacttgctacaaagaagccttggaaatgcaatcttcatctgggtgacaatactctcccgaaaatgccgttgctatagaaagaaggagattggatatgggggaacagctactagtctgccacctcgtctaatagaagatggatgcttgaataaataagcagacaaataaaatgactaccaagtccccttctcaaaatagagattttataagcttaattcttctcaaggtgaccctcccattgaaatataccaaaaagcgagtgtacaactcctctaaaactaattctactgaggtatatgtttacataagtcagaatacaggtgaagcttcaagcccaggtgcaccttgattaagttacttttttatttcttaactttttaaagcctggattgcatttttttccaaatggacaattatcttaaaattatttttatatttttgccaagccccctacaaggccactatcaatatgaaaaaatgattcgtgcaaagtaaaacaaaaagttgaaataactccaaatatttaaataaacactggcacatacaatttttctcatggtaataaccctaaatgtgtggcaccatcatccatttaaggaagctgaggactgtttaaaaattgccatcaacatatatcgttatccttatttttctcaaaatgcatgatgaaaaatccacatgtactatttggaagatttatttatagaacacctgcttctgtgaaactgctggataaataaagcatagcagtagtaatagtacaagctataacttatataatactttttatataattatattaaaaattctaaatatctttaatagaatattatcaatgtttattgtttttaaacattttgcattacactgtaaacaatataagggcattgaaaaactttatatttctctatactccttccatacttaacaacaaccaaacacctaccatgagtaaagattcatgcttgatatcgaggatgcctaagagaatagaagacaaaaacacatatttttagaataggcaactgctagatgaagagtaaatagaaattgattaggtgatagatttttctggcatggtacctgcttaggatgagagaaaataaaattaggctgttgttccctttgcagtttccaacaacctgtggaaatacccatctcttgggaaatcatcctgccataacatcgggctggtctggcaaaacttctgtggtattcaatgcaagtgattctttgcctaatttcttcccattactcataatttccctctgcctaaatatcccgggtgcttatcctcttgaatatcattcttaatctctggatgatcatcccccgcactttattttcatttggccatgctcccactatataattattttaatcaggagcaccatcttttttaactgtgatagcaaatgatgccatttccagagtagggtggaaaattaaaattgttagaattgaatttgatttgctttgtgatggtgattcagaggtgacggaggagcaggggagtgtaggctgtgttgggccatgatgaagatcagaggctgcgtgctgccagattggcatcctttccaccctatgaacggttttcatttcagaatggaattgtggaatttgtatcagtttaatgttcagggaatacttgagaattgaatgttgcactttagtgcatataaccatagcactttagtgcatataaccatagcacctgcctagaggcattcaataaatattggtttaaatagattgaaacacagacaattttaaaagcattgacttgacatcagtgttcccccaaaccctggtgtgcctacaagtcatttgaagagtttgctgaaatgttgatttctaagccctatttctagaaactccgatttagtccatgtgacataaggacctggaatccacaatttaaagaattgaacgatgcatcacacatgattctgttgctgctggtatgtggatgtcaactaggcagaatattgggaaatctgacataaatggtgtaagctatattggcctgaacgatgtttgaaagttaagggaattgaggatggaatttttatggattgctctaccttcaatagaggtagtctattcatttctcattaaattcatatttgtttaactgacagatacaaacacaaatatattaataaaatgttcaaaggagtcaataaagatgaacttttccacaataaaaactagatacctattatgggcaaggacacctgaagtccaaattgcttgctcactcctgaaaacaatattaaggttttattgtaagtttattcatgtctatgttacattaattacaagatgctattatactctacccacaccagttcttacatttctttctagaaaataaatgagaagactaacaaatgtaaagaggatgactgtttgattgattttgcctacatgtccaactttctactccattcttaccaaatgagatgtgggacataaaagctttgaattataaaaaatataaaaatacaaagataaagtattattattcattaattacctcctctttgcttaagaaagctgttctatctgggtagagggcaatgaagaaagataaaggttcctatttctgtttcattagtccacttttccacctcgtaaacagtgtaaaaactcaatccaacaaactccatttttcagtaaagcctatcatcagttaatgtccctgacctttatttttcctatttctcttctgtggcattttgtaagtgtttcgtgttgtgtcaggttataaaccatggaaggaaaaaatggaagagcccaaactgcccatttattggaaaacaatcaaataaacccactattgcctttaaatatgctactgctgttgctgcaacagtgttggtgattatgtatgtggaactgtttctcttaggtgtgatgggttttaaaatcctgtctctttagtgaccagatacttagtgaccactggccacattaagaatgggaagtaaggccgggccaaagcgagcagatcacgaggtcaggagatcaagatcatcctggccaatatgtcgaaaccccgtctctactaaaaaaacacaaaaaattagtcagatgtggtggcgcatgcctgtagtcccagctactcgggatgctgaggcaggggaatctcttgaacctgggaggcagtggttgcagtgagccgggattatgccactgcactccagcctgggcaacagagcaagactccatctaaaaaaaaaaaaaagaacgggaaataagaccagtgcctaagtgaatgccatagactcatttaaggtcaagccaagccagtgactttactaaatgcagaacactgagtgcctcttcaatggaagaggcagtgccttgtcatggatcaaagtataagtagtctgtcaaggccaggtttaaatttaacttattttccttatactttgtattaattgtgcaaccctcttgggtttcactctctccagctataaaatggcataataaaactctcttcatgggatattgaaaggactaaataaaagtgcatatctacatcacctcctacaacgaccagcaaataattcatgtttaagaaatgtttaattcctcattgtctcttgtagtatgcacacaaagatttttaattctgtggctgacatactgtttggaaaatgaatgaaatcaaagttcccgtctctggctgcttacaatctaaaaataaataaaaggcacacaaataaagaacagctgaaccgagtagtaagtttatcacaggatcgggaaggaagagattattcattctgagatctggtgtataaaaaaaggggttttaaaatgatgcctacttttaattttctttctgattttcaacttcaccatataaatttgaaaacctccttgcacagagatttccactggctacgtaatagtttctcttgtggtcctgtgactattttatactttctctgttgaaggcacttaaactatatccccattttttttaactctcaataatactgtaattaatcttttttattatgaaatcttaagaaacatctttataagaggaattttaagacttttaataaggccaaatgcctctcgagaaactttgccttaacatttgtatcaagagtgtagcagagtgcatggctaatattttaatgtgatgtaatgagattggtctttgaagcaagggctcagtggtcctagtcttggtagtagatgatttattttgcctaaaacagatgatttccgtggggaaagccatggagaaagaaaaaagtgtggataatctggctaccaagattctctcagaattgaactaagaattagggacagccaagccagccagtatgaatgagacagaagcgagactctgagctccaggacagttttgaatgaccttttagcttaatattgccttggtccctccatcatcccagcatctgaattctcacggtgaccccacactgtgagaccattcccataaactgggcttcaattccttcatctataagaaagggttttgtatagcctgtatttttgctgttgactaattttattagttgttttcggtatgtaactgaagtatttgagctgccaaatattgtcattaaaactgttgaaaaatctagtggcttccccctttgactattttctgaaaacatgtgttccctttttcccagttgaagctgtagacacgtctggttgcttctctcacttcccattctgctctgatgagtttaaagtgtacaattgatttaaccagaaataacttagcagctgatcatatttccaaaaagaaccttctttgcatcccaagaaaaaaaaatgactcagaaaatcactttttaaatttgattttaaattttcaggtgactctactgcgttaaaagctattttagtagagttaggcatggagtgagaaaaggtagagccaggaatttcatttcctctgaatgagccttgctgagatcctgagaataaaaaccacaacactcagaaattaaaatgtcaactttgaatcaatttgctatagcaaagacagttgtacttttgaaaatttaaaatgacaaattgattattagtgtacctataaccctttagctatgaaatggagtgctacatttctttaaaggctgataattagtttatatttcattggatcagacggagaatataatttatggccccttaatttttttcttctttagtatactttaagatggtaaaattgttttctttactatgaacctaaataatgctggtccatgctctttggcacattcctctgcttctgtttccatctttcccgtacctcctgaagtgtggaaagggcaaatcccattaatcagacagaggaagatagtgtaaaccaacactcacctttgcctctgtccagctccctcactacactagatacagggcagatcttacagtactcagaactgaccagcagatttgcaccttgtttatttacaagaattaaatgcggctgggcactgaggcttatgcctgtaatccctacagtttgggaggccgaggcacgtggatcacttgagttcaggagtttgtaaccagcctgaccaacatggtgaaaccccatctctccaaaaatacaaaaactagccaggcgtggtggcactcacatgtaatcccagctacttgggaggctgaggcaggagaatcaattgcttgaacccggacggcggaggttgcagtgagccaagatcatgccactgcactccagcctgggtgacagagtgagactccatctcaaaataaataaataaataaataaataaatacataaataaatattaaaaaaacaaaaaagaaaaaaaattaaatatagggtgtcagaagcagacaaatagacatacaaaaatctcaggagacattaaggtcagcaggttctgaaaacaaaccagcaaatgtattaccctatttattttcacaaatactacttttccccttaataattaagggaaagtatggttttccttcaaagtgttggggattttaaaattcaaaattctgatatatcaggaggaatcctaaacagtactgatttagtttgctagggttgccataacaaaatgccacagattgagtggcttaaagaacaaaattttattctctcacaggtctccaggctagcagtgcacaagcaaggtgctggcagaaatgttttttttccaacacctgtcccctgagtgtgcagatgcctgccttcctgctgagccctcacacagcctttcttctctgcttgcacacccctagtttatcttctgaagatgaggccttataaggacaccagtctcattggatttgggccccacataaacagtcctgttttaccttcattttttaaaagaccttatatcttaatagagacacattctgaggtcttcagggttagacagcaacataagaatttgggaagaacacaattcagttcataacattctgctctttggacccctcaaattgctacacttcttacatgcaaaatacaatcactccatcccaacagctcaaaagtcttaacccatttcagcaccaactctaaggcccaaatctcattaaaatatcatttaaactaagtgtgagatccaaagtatgattcatcctgctgcagaatttttctccagctgtaaacctgggggagcagacaagctatctgcttccaaaatataatggcagacaatcaccagatagacattctcctgccaaaaaggagaaattgagaagaagatggtgtcataggtcccaagcaagaccaaatcctagtatggcaaattttattagattttaaggctccagactaattctttttggcttcatgctcatcctccaggcctgctggtaggtatggtggccttatattcaaggcccactgaagtggcagcattacctcctgagttcctgggtggtagccccatccataggagttgggtaatggcagctgggctgctgagattaagggggtagcctcaacctcagaaaatgaattggaggcagccttgacccctgagcctgtgtcctccaggacagtggccgcagtgacagcccttgcaatctttgagtcacctttgagtccttcttccctttccttgaatgaaaacatgtgcttgcagctagatagctctattttcccatcctgccacatcccagaagtctgacagtcttccttcctattgtcttctctctgtcaccttcagtcaaggatggcagtgtgtctcccatttctctctattcatagcttcctgggaggtggctgattagatccaggagccacatctataatctctttaccaaataattttccagccatacttactgtgttctctccagaacccactttctactttttggcaatatggacaggctgatacttttacaaatcatgaagttcttgtttctttttgcttgacagttgctttaatgtatctcttccaatgacatttttctataaacagtcaaaaaatctaggccatagctttgacagtttgtgtagaattttctttgctaaatattcaagttcatcacatacaatatgcactttccacaaaacactagaatacaattcagcctcttttttttacttttataacaaagatcatgttccttcaatttccagtaacatgctcctcatctctgtctgagacctcaaaaatcgcatttaacattcattgtattcctaccaaaagtctcttcaagacagtgtaagatctttctaacatgtatttcaaaacttgtctagcctttgcatattacccaattccaaagctgctccacatttttaggtatttgttacagctgcaccacacttccctgtatcaaatctggtttcctttgctaggactgccttaacaaaataccatagactgagtgacttgatcagcagtttattctctcacagttcttaaagttagaggtccaggatcaaggtgtcagcagggttggttttactctgaggcttcaattttgacttgcagatggccaccttcttgatatgtccccacagagtgcttcttctgtgtgttcccatgcccagttcatcttccattcttacaaggacacgagccaaattggatttgaacccgcccaaacagcgtcattttagcttaatcacctcttttaagatcttatctttaggccgggtgcagtgtctcatgcctgtaatcccagcactttgggaggctgaggtgggtggatcacaagggcaggagattgaggccatcctggcaaaacatggtgaaatcccatctctgttaaaaatataaaaattagctgagtgtgatggcacgtgcctgtaatcccagctactcgggaggctgagccatgagaatcccttgaacctgggaggtggaggttgcagtgagctgagattgcaccactgccctccagcctggtgacagagggagactccatctcaaataataataataataataataataataataatgatgatacagatcttatctctaattcagaggcattctgaggtgctgcatgttggcacttcaacattttttttgttgttttgttgttttgtttaaccatgtggttgattataaagaatactgcaaaggatacagattaagagatgtgtagggtgaagtacaggtgaaggaccatggaggttccacaccctcgccaggggcatcaccctccaggaacctccacgtattcaggtgtctggaaactggcacttcaacataattgtggtggcaaggcgcacaagtcagcccatagaagataccaagttaaagataaatatacatgtgatcaattaattcaccaatattttctgatagcctatgctcaaatcaccataatagtaatgtgtgtggagatctaaaagtctgaagacacagttgagtccagctttctccctctctccctggccctgcttgaatacattggatggacagctgcatccttatctcttctgtaaagcatttgaccataattccaagcagcatcccacatcacatgcccttaatgtgctctctatcaagaactcacccaaagcccagctcaaaaaagtagtattagtgggagggagggtcatgggaagacaatgctactcatctgttctgaattttagtctttacattaagccagcaattcgaaggcaactcctttactgtggtacattaatccctcagcttcaatccctcagcttttttcaagggaaattcccttagctttttttttttttttttttttaaaggagattccactatatgaatttctctaagaaattcttccccatgaaattcaacgtactgactttttggagggtagtctattgaggacattttccggcaaactgctctgtgttcttctgtacagggtctcacatacacataaatttattttccaactcaatgtttaaaaaatcatttacttctcactgatttgtaaaatctatttctgtgtgtaagaaatgtgtgatgatgatttttttcttttattgccaaaattgaattaaaaatatttccataattttattttttgtttttactaggacagtcttcatttatactttataacagatgcagggattgttatttttttccagctttattgaagaataattgacaaaaattgtatatatatggtatacatgatgttttgatacagttatacattatgagatgattaccacaatgaagttaactaacatatccatgacctcacatagtttccctccctttactccccttccccttccccttcctcttccccttccccttcctccttcccccttcctttcctctcctctcctctcctttcctcttctctcctcttgtttccttcctctctctctcactctttctttttctgtgtgtggtgagaacacttaagatttactcttttggcacatttaaagtatgcagtacagtagtatcaactatagttatcatgccacatattaggtctccagaccttattctgcataactgaaactttgtactcttcgaacgacatgtctctactttccctactccccagcccctggaaactaccattctactctctgcttctgtgaattcaaatttttaggttcctcatgtaagtgagatcataaggtatttgtctttctgtgtttggcttttttcactagcataatgtcctccagattcattcatgtcattggaaatggcaagaattactttttaaaagctgaataacatttcattatgtattgtgtatgtgtgtgggtgcatggtatatatgcgtgtgtgtatatatatatgatatatgatatatatgtatgtgtatatatatgatagttccatttaaattattttgtggaacctccatactgttttctgtaatgacaataccaatttacattcccaccaagagtgtacaagtgttccattttctccatgtcttcaccaatgcttgttaaattttcccttttaattacagccattcagacaggtctgaggtgatagctcatgtagttatggtttgcatttttctgattattagtgatatggtttggctctgtgtccccacccaaattgcatctcaagttgtaatccccgtgtgtcaagagaaggacctggtaagaggtgattggatcatggagggagtttcccctatgctgttgtcaagatagtgagttagttctcacaatatctaatggtttaaaagtgtttggcagttccccccttttgttttctctcccctgtcaccatgtaagatgtgccttgcttcccatttgctttcccctaagattgttagtttcctaagttctccccagccatgaggaactgtgagtcaattaaatctttctttataaattatccagtctcaagtagttttcttatagcagtgtgaaaacagactaatacaattagtgattttgaatagcttttcatatacttgttagccatttgtacgtcttcttcaaaaaaaagtctattcatttcttttaaaatattatttatttatttattgctattgagttgtttcagtttcttatggattttgatgattaaccccttatcagatgtatagtttgcaaacatttcctcccctgtattccataggatattttttcactctcgattgttgattttttttaatttaagcatatttttattttgatacagtccctctggtttatttttacttttgttgtctgtgcttttggggtcatgctaaaaaaatgttgttcagactaacatcatgaagattttatccagtgttttcttctgttatttttacaggtacaggtcttttgtttaaatttttaatcaatttttagttgatttttacatattgcatgagataagggtccagttttatttttctgcatgtggatacacagttttctcaaacatctttattgaaaagactgacctttcaccatgttttgtcctttgtactcttgccaaaggtagttgactctaagtgcctggattcattttgaggttatttattctgtcctgttggcctatatgtctgcttttatgatagtaccatattattatgactactgtagctttatatttgaaataaggaagtgtgatgtctccagttttattcttgttgaggattgatttgactattcagggtcttttgtggttccttataaattgtagaatcattttttccttttttgtgtgaaaaataccattaaaattatgataatgattgcattgaactttgggtagtatggtcattttagcaatattaactcattgaatccatgaaatggcctatttctctatttatttgtgtctttcaccatttcgtttatcaatgttttatagtattcagtgtacaggtcttacgcttccatggttacatttatttctaagtaaattcattcatttttgttgctattgtaatgagattgtcttatttatttttcagacaattcattgttcgtatatagaagcactactaaattgtaaatgttgatttcattttctgcaactttaccgaattcatctattctaacagtttttggcatcatctttagggttttctatgtataagattatgtcatctgcagagacaattttacttattttttccattttggatgtttttatttctttctttattttatataattgctctggccaggactttaagtactatgttgaatagaagtggtcagaatgggcatcctttccttgttcctaatcttagaggaaaatctttcaactttaaagattgagtatgacgttagctgtaggttagtcatatatgacctttattgtattgaggtacattccttctacttaatttgtggagagtctttatcatgaagcaatgttgaattttgcaaatatttttttctgcatatatttagatgataaaaaggttttcattcttattctgctaatgtggtgtatcacatttattgatttgtatatgttgaacaatccttttatctcacttgatcatggtgtgtaattctcttgatgtgcttttgaatttcatttactagtattctatcgaggattcttttacatctgtgttcatcagcgatgttggctgcaattttctttgcccttgtctggctttgatattagggcaatgctggccttttaaaatgagttaagaaatgctccttgctcttcaatttacggaagtaagagtttgagaaggattgacactagttctttaaatattgcttagaattcaccagtgaagccacatgatgctaggcttttctttattgggtggtttttgattactgatgcaatattcatactcattattgatctgttcagatttattgatcatgttctcattgaaaaccccctgaaatcaaagaaatgaacagacacaagtaatgttgttctttatttcaatgaatgtaaaatatctttaaatattttaatacatatgcattattttaatgtaatacatatacattattttcaaaaaagcctgaagtaatagttattcatagctgatttgatcaaaaatgcttcatgggagaggtaatatttgtaataaatatggaatgaggcatggaaaaattggcttaaaacctttaataaaattctgaggattttttgcctttttctgaatgacactattctaaaatctggcaactccacaaataagatttgaatgagtcttcataatccaatttgtaaactaaactcaattctaatttataatcaaatatataagctagactattttctattatctgatgtgaatttccaaatgtgaatttccaaatatgcttaaagtcttataaaggccctctcactttgttggctggtatgcagagagagacagtattttaggctctcaggatgtaatcaacaagggcctttcatggaattataatccaagaactactggaccttaccaggccttttagtatcccacctgagaagtcatgtaatgtcacatcaatcctgatctactggctgcaggagtcagcccactcagattcaagaggagacacaaaccttatctcccaatgagaggaatatcagagaatttcaggacctcctttgaaatgattccatgtatatgcatttcttagttgagaactctaatcttcaaatatttttattaatgtaatacaatgaaatacttgtaataatgtctaatttttgcaaaaaagtagttattgttcataagaaaatattaatagaataataatgaattttttattattgttttctttgttaggcatcattctttatccttgtcatatgttcaataaacaattctgagcaatttttctgactaggtaaaaagcattaatttcagatgcaatgaattataagaagtttatatgtgtaaatacagtcaaacgctaattttgttttacatttttgatatctctgaaattgaaatgaatcttagaatcaatggggtaagattgttgaactggcagcagttttccttcttagcaatacaaaaataatggtacgaccaattatcaatgatgacctattttatcatctttgatgaaatatgatagttgttactcaaagttctggagtaaccagatactcaagataaaataaccacaccctctattttgagatattttctctataaccagaaatgagtcctaaatcttagatactgcttgaattacactatccaaaaaacctgttcacattcatttttttataatgtgcttatttttctaatttgattctagacttctaagagagcagccaacaatgcattaactatttctgtcagctgaaaggccctttaattgacttgttcgtattgactgagatcctagaaggcagcctctgttaatggtgtatcctgatgagagacaaggaataggtttgctagcatcagacttgagtgctaatgtagtatatcatgttatttccaatcacttagctttttctcgtgatagcaacaaaatgacttcttgaaaaatgaagacttgcaccatgttatctgaaaaaatgcatagctgtctttgaccaatatagctacaagtttttcaataaaaatcctgtcttaaatcttaggtaaaaaatgtgtctttagggaaactgtattgcagttattattaagagtgtttgtatcagtacatcttttaatgagaatggtgtttcgtgtagtatacaggtgtgcgcgtgtgtgtgtggacatgtgtacagatatatatatatatatatctgcaaacagatatgtatttattcattcaattattatttaaagaattactgaacttataaaatatgctggcatgtaatgactaccaatcatccctgcccttaagtagattacagtcaacctctcataaattcaattcttcttctctaccttttatgatgtggaaacatagcaactagtatgttgtaagtcttgtgtaaacactagccaatgttttcagtatttttatttagaaaataactttattttgatttcatctgttttttgttttgattttatctagttttataagacacaaagtatatttttaaatggtacatttttgcccagaaaccaaaattgccaatttcatatattttatgattgtagaatatctttcagaataattaaatgacctttgtggggtattatggaatagaaaatcctcaaaggcaagaaatccatagccttattttattttttgttatataccctgtaaataatcataaacaggagagtggttaatattcttcagatatggggctgtgaaataggagatacaggcatgaaatcctatttttattactatcgttatgctgatgatcctctggccacttctttctagtctgtgtaattgcaaagttcttcatattttattcattagaagagctgctctgtgcccattcttcttatgttgctgcctcgtgccgtttccagcacttcctaatgggtgtgatcgctgggctccatcaactttctgtctatgccttgctcagacctctaatgaatattagacttgcagccatcagtcatgtttcaagtgcagacatacatgaatagagaatttttgtttgttcattagcattgtgaaaagcaaactcattttgtctccttcctgttctctttgatgtatttgcccacctactataatgaatttgaagggaaacttgatgcatgtaggtatttatttaaaaggttcttgctggctcttttctcaccttttttcacttcttttttttttcttttaccgtaagcagataatgcttattaaccatcaacaataaaatactgtagataggattgtgataaattcttgtcgaatcgattgtgctaaggcgtttaaaaaggttgcctttcaggaggggatcaaaggaaggaatatggggagatcagagggaacaagaaaggtaaaaataatttggggagaggaggaggagaaagggagcaagaaagaaagaaaggaaggagggagagagagacaaatgcagagacagagagaaaaaggagaaccaggaaagaaagaaaaaagaaataagaaagagcaaagggcaatcttgggtaagaaaaatcatataggtgtttatgtgtaagaatgtgtgtatgggtgtgcatgtatttgtgtgtgtatgtgtatatgagtgtgtgtttctgggtgtatgagtgtgagtgtgtttatgagtgtatgtgtgagtgtgcatgtatgagggtgtatatgagtgtaagtgtgtgtatgagtgtgagtgtatgtgtgtgtgtgtacatgtgtgttgaaaggaatgcaatacttaattgggtaagacaattcaagagtttattatataaacacagcataccctccttccatttaggtctctttgttcatcatttgggtgaaaatttattcttttactcggagcaagtttagtttttcatcttagtatattttacttagacaaagaaatttttaaaaatgtattacaatgcaaaatagcagcttgtcagggatcagtgttatagcttttttgagtgcactgctggaaatctgattcttttttgttttataatgagtgagctcaagataaaatgttgatagagactagataattttgaagagaaaatacataattgagtctcagttgctcaacttattttattccatacttcttgtttcttttcagcaaccaggttctcttagaaaattttaatggatcaataaaattctgtcatattcctatggtatgaatatttttattcctccaaaattcatacattgaaacgtaatcaccagtgtgatggcataagaaggtggagcctttggtgagggatcagaccatgaggataaagttctcacgcataggattaatgcccttagaaaacaggcccaagggagaccctaagcccttctacctcgcaaggacacatcaacaaggcagtttccctgatccagaaagtgagctcccggtagacatgggaattgccttcattttggacttcccagcatccagaattgtaagacatcaatttctgttgtttataagctatccagtttatggaattttgttatagccggccaaatagaccaaaatgcataccaaatttatttttcataagaaaaatgcactgaatttcacattttcaactaaagagtacttatttcaaactttaatttatagtaaatgtgtattaattagttgatgaagctatagaaaataccgagttccttacataagagttctcaccctttgtgacatgttttcaaacacaaaaattccataaaatatgccatcaccatgagggatttccactttgattaaaagactcagaatataaacaacagtggattagttgttgtcttgataaatgaaacagtgacttggaggtgggtctattcacatgaataattgcaatggcattttgattagcaatgcaacatttactccctgttcactttatttaacacaaaattattgatttattgaacaccttatttaagaaaagattaggagcttttgggggaaatgttaatacctccatgtgtatattctaaacacacacacacacacatagcacagtaggtaataaatattcttcaaactttgtaaagaagtatctggaaaatggaatattatacatataattagtcttgatattgtataaagaaattgcaatttgttaaggaatttaagagaaatagcccgatataagatagtatgcagtcagtcaataattttcattttttttcaaagtgctatacaattgagaagaggaaatgctttcaaataaaattgttagagaagacttcttatgggaaaaagcatttaaaaagggctttgaaaaagaagggaagtagaatttacatatgtcaaaatgtggaagggtggaagtcaactattcctgcaggaaagaattatgttagcagaaattcaaactaaacgaacaagattttttttttaataaaaaagagtaacaacccaatttgattgaggaagaacatctgtctaggaaagtagaccaatatgaaaagtagcttgggggctagggagtagaggtattgaagagcagattgctagttttttgtttctttaaattcatttgcaaatgagatactattgaatgttttgctggcagaaagcattgtaatcgaatagttagtttaagaaaactagttgagtgcatgtgtgcagagtagattgcagtgatgtgcaggcaggacacagtgagcccacactgcagatttggaaagaaatctgcaaagaaagctttgatgggggagagtgttaatacgacatgcacaggctttgctgtcttgatagttaagagactagtgtttgttgaatagagtattaaacttctcaacctaaggctgcaaaaaatgggaaaacatgtgtgaagcctgagtaggaagaaggacacaccacatagcaatgtgctactcgtttgaggtactcatggagcagctctccatcaaacagctcagaaaagcatgcagagctggagaaccaagactttttaggcatttgtgtataagcaatagataaaatatctatgacaaaggacagagaaaaacaccccacatctccaaagtcctggtctgctgaagggtggtgggatgggaggaaggctggtaaaccccgctacatggagacacaaatgaacacagagagagagagagagaatgaagagaggaaaaatgttatcatcttcccatggaaacaaatgaaaagtgagcatgagagaacgtttgacacaggaattgggacctagtgactttgtgtgtgtgtgtgaagcagggtaaacaaaaatcacaagaaatctaactgaacctcactgatattttcaaatgatggaacagagtttgctgcagaaatgaagcaaaagggaatgggaatgggggctagcgaagaaagagtaactgtgggagatgttcttttgggactcttgtagcaaatttgtgagaaaagtagcatcatcacatgcacactagatttatagttgaccaagacaaaagcaaagcaactgcctgtttttaattctaataagaataaccagaaatttggtgaccttctctcatttccaagttaacctttattttttctctgtattttatttgtctccacttatcatcctacctttctttagatggatctgctgtaacctaacgcatgcgatttggtaagagtaaaacctaaaactaagtagctcattagtgtttagcaatccgtggtgtcatcgaacaagaattcctcataaaagagaggggatagaggcctgaaaattttaaataaagttcaaaccttgtaattagtgattctaaaatttaggtgtgtaaacttgagtaaagttttagtgtcacctgataagtgtgaagtaaatgaagaatcttgggctgtactctccaagtgtctgggaagttttcaaaaacccatatcctgggtaaaatgcattaatgtatggctgtgtgatatccattttaatgttgttgacagctttgggcagagaattctagctttcccctctctatatatgtaccccctttcctccacaataattaatttttagttgaatcaatgactgcccatccaaaaaacaaacaaacaaacaaataaaacatgtccgtaagacatcccagatcattctgattcaagtggccagaggctatactttgagagatgctgatataagacttctaaggaaaaatttcagctgattcccagttacatgattagcctatcactcctaggtagctactgagaaaaaatatagaggtttaggccaattagacttcatagaaaccatgatacttattagaacaattatttctacaagacttttttttttttgcttttctgttaatttgttttttagataaatcaatagatagactaatacagttggaaagacaatatatttgggaatatccccaagagggttgaggatacatactcaataatgatctgtagttttaccaatgtaatgattatttgatttatactattttaatattgattcaagaacaagtgctgtgaaaatatatagtactcttttattcccttctctaataggaccaggtttcacataatatgtaaaaatattgggatttggagccataagatctaaattcaagatcctttttattttctgtgtgattttggggaatttgctaatccattgttagctaccattttttatctgtaagatgagaatgagtatcttcacagctttgttgagagggttgaatgagttatgtgatgtgaacctcgtttcgaatgttagtgttacggatatccaactttcctcactggtttgtaaactgaaatggcaggtgtattcataaaataaatgactttatgctgggcacggtggctcacgcctgtaatcacagcactttgggaggctgaggcgggcagatcacctgaggtcaggagttcgataccaccctggccaacatggtgaaactctgtctctacaaaaatacaaaaattagctgggcatgatgacgggtgcctgtaatcccagctattcgagagactgaggtgggagaatcactagaaccagggaggtggaggttgcagtgagcagagatcacgccattgcactccagactgtgcaacagagaaagactctgtctaaacaaaaggaaacaaaacaaaacaaaacaaaaaatgactttagatttttcccctgacactgtactctccactaaatagccatttttcttccttttgctttccacatattgcttaatattgtacgtcaaatttatttcattctaaattgaattaaaaataatgtttaacattttctttcccttatcctttcattgtgaagaacttgatggcaggattcataagtgttttgccttttatactaaccaggttcaatcagacaagagtcttgaccattgcagatgttttatatcggtttgtttaatccatgaatgaactgatatgtgaaaaccttactgtatggtggtctcattctatgccacacttataggaagcatttattcaaaggcttaatagatgtctctttttggagatgtgactaaaatggaaaaaaagcacttgatttcttcaatgataacctaaaatggcaaagatgaatgcacctatatagaagctaaaggcatcataatcatatatatttctgcaaaacacattttttaatgtcatctatagaaaatctttctgggttgtttcttttttttggcatttggtcatttgttcattcagcaaatatgtagttagttcttagtgcaagcaaggcaccattctctatgttggatatacagtcatgaacaagccataaaatgcccttttcctaattccaatggggaatacattatacaaacaaagaaaaataaacaaaaataatgatttcaggttgtagtcagtactcttaagaacaataggctgggagcagtggctcacacctgtaatctcagtactttgggaggctgaggcaggtagatcatgaggtcaggagtttgagaccagcctgaccaacatagagaaaccctatctcttctaaaaatacaaaaattagccagacgtgattgtatgctcttgtaatcccaactactcaggaggctgaggcaggagaattgcttgaacctgggaggcggaggttgcagtgagctgagatcacaataatgcactccagcctgggcgacagagcgagactccatctcaaaaaaaaaaaaaaaattgggaacgatagcgtgatgttggagtgctttggatagggttaactggaaataattaaatggttaatttcaggacccagtgaaagacatcagcctctatgaagacccatgggaggacgggttcaggcagagagcagcaagcatcaaagagcatgtgcgagggctggcaaggaggccagtacagctggagggcagggcacaggctggattgtggaataagacgtaaggctgagaaatctgcaggaccacatgcacagggtttcatgggccatggcgagaaggtgggatttgtttcttgttgcaatagggaactattgggaaatttcaatcagaggtaaatcaagtgatccttactttaaaagtcccttttggatgctacaaaaataacttttggaggatggaacaaaaatggaggcaagcattttacttttgagtctattgtaattacccacggaagagatcgttatggctgtggctagggtctgtcgtcgactagctgagttactagcaggtaattttacctctatctatgcctttgttttctcatctgcaaaggggaaataaaggtatttacctcatagtgttgttgtggagagtaaataagctagaacattaaaaaaaagcatgaatctgcttggaatattttaaatgctcaattaattctggatgtttttattagtatcatgagtctaaatatacacaatggctttagtagccagatttattgcaattcttagtttctagattgtgtgtacatatcagatattttacttttccaactctgcttttcattcattattttttttactgtgtgaatcggtataagttaaactatgctgaggtcatgaacatgccccacactaaatctctgaggcttaacacaatagaggtttctttattacatcacagcttgatgaagagttgagagtcctccctctttcttttcactctgcatttgaaaactaatgcttttgtcgtatcagggaaattgtgtagtaaactgaagatcttactccaatgctgagttgttcctttattgttatcagttcctaaagatttataagagtgtctcaaaatgttcatttttatctgtaagtctcgtgttatttcatgatgtttccagcacattggaaagtatcaaggtctgccgggcaaggtggctcacacctgtaatctcagcactttgggaggttgaggcaggcagatcaactgaggtcaggagttcaagaccaggctggccaacatggtgaaaccccgtcctactaaaaataaaaaattagccgggtgtggcggcacacgcctgtagtcccagctactctagaggctgtggcaggagaatcccttgaacctggcaggcagaggttgcagtgagccgagattatgccactgtactctagcctgggagacagagtgagactccatcaaaaaaaaaaaaagaaagaaagaaagaaaaaagaaagtatcaaggtctgggagtctttgtgaaggtggatgttcaggacaggagctatgcaggttctcagatgtctggagcctgtagcccacattttgctcagtcatcgtgttactctgtcatttaaccttactgggatccttcaatgaggcacttagcaaaaaattgtacaataaacaaaagtatttttatattctcctacaaaaactcacacaatgcccaaagaatcatttaagttaatcacgttgtccatctctttgtctaaccatgaaggatccccatagtccattctagagagctttgcctagtccagcttgaaatgatcccatcaaaatgacttttatcatttgttttgagaggcggtaccattaatcttttctgtttccccctctctctttctggctcacttcaattcaacaggcagggagaagagaacattgaacaacattataaaaatgttaattcctaatgtcacggactagcccttaatcacactattagacatatgttctgaattaacgatcttgaccagcaagcaggaagacgaagattgactttgatgagtgcctgccattattttcaaagatggatgaagttgtttttctttctgactaaatgttttctcagaaacggtattctatttagaaagaaagagcatataaaacactttcttttgttggcagagtcttcttttctaaatcagcattttgatggtgtgtgttttgttcatatagtgagacatgtgctgcaatcactggtaatctcttggccttataactttggtggcctcgttctctagatttattttttaagcccccagcgcttaactgcaagcaatgaaataaagcatgtttagtatgtacagaaatctcattatcccaaacagtcatttcctaaagacgactgcggtgaaaatcagatctccttttctttgtgatctttacctgcacaaattctttctccacggcacactttgtcgaagtcctcctcaacaccaagtctctgagcctctgctcaaatgccatcatttgcataaaactgttcccacgacccctggtgagaagtcatattttcttactctgggcttttctagaattttattaactgctctctttggcactgatctcactctgacttccattactcttagctgtgtgcgggacctccttcctataaatgttatgagctcttttagggtagcaaaagttcattaaagtttatatcactcacgtattacaccatgacctttcacaggatacagttaaaccattgaatataatatatgcaattcacatcattacatttaattatataattttatgaattatatatttaatttatatataaattagtaattttatacaatatgaatataatatttaatttacatataattatatatgtgtgtatacacatgcacatacacacacacaaaacttgcaactttgcatcattctatgggcagaggctatgagaaaactgtacaagatctggtttcattaggttacagttaagtgaccagttgtgagaatagtttcttcaaagttctatgaagagtttttaactgaatgcatgggtaagtggcatcgagacttaaaaagatgaggcaggaccattactatcatggaaaactgctatctgcattgcagtgacagccaagcaccgtgtttgaaggggacaaaggcatggaagtcaggttacactgccaatcattggggctgggttggcacagactccaggtgaacccagattgggtttatataaatcacatgtgggacggaagaagggcagatgggaaagacactagcggtttctaaccatattgcaaacaccttgaaattagagccatcattgatctttctatgtacttctttataacccctacagaatttattttcacgtgatttatacctaatttgtattttatcagttattattgcaaaaatgctatataaccagttgccaaagctcagtgacatacaacatgcagtccttattctcacactcactcatctgtgcatccactgggtaactgtgcttcctgagttacattctggggccgtggctggagaggtcatgacctgctggggcatgttcccagggtcatgtcaaggaagctctggaagggcaggtggaaacatgcatgcctcttgaggtctacactggaactgaaccatcatcatttctgcacacattccatggagctacacaagtagcaaggccaagcctcacatcaagtggggcagtgggtttactccacccctaaacccactgccacatgtatttgctcatcagtgcagcaaatttcttttactcctgcaacttcaaacattgtatgaataaaagaaatgagaactaaaactcttcttgttggcatactgagtttgccagaatctaaggctatgagaatacattacatctaaacttagaaaaatgtaaagagaaacaataaccacaaaggcaacaacagctcaacagagcacagtctgtatacatctatggaactttctagctccattctgatattgtctggaattttgcttggactgttcatagcaacgggaagaggccagattctcttggccgtagctgcagttatcaccaggaagctgttgtgtttactgtttcccagttgtcaaaactttaattgaaacaattgcaagattacagagagatctccagtttgaattatgttcaacagctcccaatgattaagccatacaattgtgcaactaacctgtttgaattctcttcaatttcttacaatataaaaatcatcatttgaactaatcatgtacaaattagatttgtgtttaggtcttctataaaacatatatattttctctgtctttgaaccatttctctgcatataatatatacatattctacttgaggaaactttatggtcaggatagtgtggttattcactcattagcaaaatccctagacttgatctgctggaatgatttaaattcaagtataggagtctatataggctgaaatctctgatttaacaaatgaagatgcaatattgtttcccgcttttacttcctctccctcctcctccttattctctctctttctttctctcacacatacattccctccccaaacttacactctctttataagacattctagaatatgcaactttattttttatttctgtctttttgtggctcaattgagataattcttttccaagtttatgatgcattatcctgtttaggataattagaaaaatagaaacctgcagctggcaatctaaattggaggtaaaacacacctagaaatttctgcagtggagaaacagtgaagatatttggactttacatctacactgattaagaggggaagaggctcactgtgttgaaatgactgggggaagttcactggcaaggagttttataggcagacctaagacaacatacccttatgcagtctgctctgccaaatgggttaaatagtagttttgcaaacttttttcttttaatttgtttgtcaaatactctgctttaaaattggggaagaatttaggtccattaaaacactttgagtaaaaactcagaaagacactgaacatttgaaaagaagacagctacagggcttaaactgtgcctctcagtttgcatgttgtctgcaacaaagcaaaacacactcatggttatccccttgaaacttggggtagggagatcctgagaaggttccagcactcaatgctgacattgcgttgtgctatagtattattattgtgtggcagtgtgtaagatcaccttctgtgatcacttactgtgtacactctaaaacaaatactttcttaggaggatttatagatatagatatatattaaacatattacacgcacagacacacacacacacacacacacacacatatatatatatatgtaatttgagttttcccataccttgtttatatgcatgaggtcatatgacaataatatttgcatggaagtaatgtaaactcatgcaattcctcagtcgtattttttttataccctgcttacagaggaccttgacaactccctaagagctttgtggctgctactgggagttcctggaggagtctcccatcaggtcccagtcctcttgttttcttaatcttggctgttttgtggaagtccttgcgttgcatggctgctgaggctgtgtatgaaaactctggtttcctagccaaggagctggcctcacaaatccccagagccccaggccccggaagcacagtgcataacgcagacctctaccgcggagagatatatatgtcacatgcaggcagctgggggatagacagagtttttccccatttgcttcttgtcaaagtgaagtgccttcctggttttcaaagcaaaattgtggaacctccttaagccctgctcaccagatttcatagagttctttgtttatcagaagcatcaaaacaggtttatatttggtttaataaccccatttggtggaagaaatagagatttcagagatttaaaatattgatccattaagagatactaagtttctgcttagcttttgaataactcttctgtattaggggaaaatgtgttgtgagtcccgcctccacagcaaagaagtcagaatttaaatcccgaatctcgtttctagctgggacccaagtatgcaacttgtgctttacccatcagcccctcctgtgagatgctctgatgggaagatagccccaggaagcaggctctatgtgaaccttcttttttgcagacacagggtctgcagaaactcatctttggggagacaggggttgcagctcaagatacttgcagggaggtcatggtggtgcagacagcatgtcgactgaatccgtctctaggcgttcagcattcgggggcagccagctgggcagggttttatatttatgattctgtggtagtccagcatcttcataataatacattttggcttggaacaggcagagtgaattcttagcttctattcaagaacctgatcaattaagttctattttatctgttttatgctacccattttttttcctgttaaaccttcctattggaacatttgcaacattttgcaaagtgcagtttaaaaacctagccatagattctaaaaaaatgccctgatttgttctttatgttgttcatttactttgtctgcaatgagcttttccagatggccacaggtgacttatccgtggcctatgagttttgttcaggatgtcttttcatcaaagtctttcctgattggtatggtttaaaattgtaacacacccttcttcatagcacacttgctgtccttagcctgttttatattttccatatatgatagggtttggctgtgtccccacccaaatctcatcctgaattgtagctcccatgattcccatgtgttgtgggagggaccaggtgggagataattgaatcatgggtgcaatttgccccattctgttctcgtggtagtgaataagtcttacaagatctgatgattttataaggggtttaccctttcacttggcactcagttctctcttatccatgtaagacatgtcttttgccttccaccatgacggtgaggcctctccagtcagatggaattgtgagtccattaatcctctttttctttataaattacccagtcttaggtgtgtttttatcagcagcatgaaaatgcactaatacaacatacctcttatccctttctaaatactaaattatataagcatttttattgtcatttcctattaattaccatgtaacgagcaggagggcatgttttgtttgtttctttattttggtatgttttcttacgtgatttattccaagtgcctagaaacttgtctgaaatagtatgaatccttagtaaatatttgttgaatgaattcatagtttgtaaataaaatatttgtaatcatgctttgttccttcacttttgaaagaaactcctgtcaggaaagaaaaagttcaatttctgcaatggccaaaatttacagcctaggttgtgttttttcttcctgactacatggttagcatcaagacttgaggcgagtcaaacccctgtttgatcctcagtatcttcatttgctataatctctccagtactgcacagagaccaagacacaaagatgggacatctaaagggaaaatctagcaataatcctccggttttcatatatagatacataattttttgttctctctctttttcttcttgcttgttgagagtcatttggttaaaacgtgtttcaacttttaaacttctcaacctttaagccagacattaggagggaggcactaagaggccaaagcggtgcaagatgttgatggattcaaaacggaattaagagttgggctgctaatggaacttctagggagtaaaaacaccaaataagaattggtaaatctactagaagcaacacatccaccagaagttgcacacaaactggctgttcagagcttataccattagtaacaatgcaattaatgtgcttatagcctttcgggtagttcataaacaaagtatctcttgctcattggatttgactgtgtagtctggattctagagtctgagagtagaggcctgggctgttgaaaggagggagagtttgagagatttctttccattcttgggcccaaggacaacactgacaaatgtattcaaatacaaaatgcttcaccctcatgctggctggactcatgctgtgatgacccacctaagcttactccattcctgaatgtgctccatgctccaaataagcctgccagtcctctaggccaggtgtgcttggctcacccgagcagggatttaggaagaaaacaattcatgtgtagtattttacagtgatttacagttatttgaaactaaagaaaatgaattcatattgtttataactattctttaaaagaacacactggttaacagacatctccaattgaaactctagctttaaagatgacataggaattgaacttactttaggcagagtgtggactgccatgttgggatgactgtagtcctccaggccctctgcttcatgaatcagcacccctaaaatgctgatgattttcaaagtaccttctgtatgtttttctcatgaccttcagattaatgaaagctttaggttgcctggtctcttcctacttacctcagtggctttcatggggatgatagcctggaggcaagtaagagaaagttgttgctctttgtatatagagattaattgtgatttttatgtttgtacataagaatatgcatgtaaactagaatcttgattaggcaaaatttcaaccttgtaacatcctcagacaattgctattattcactgtaaaattgcaaatgatataaagtggcccttaataaatatttctttcattttttaaataagcacatgttaagcacctgttgtatatcaatcacaaataagacaattaccaaagggagcccaggcctcacatccttcagcctaatgatgtataacactttcatctgcctgtcttgttttggatgcagtatcactttaagaatgataattctaagctactgaaatattctcaatcataaaaaatccaacagatttcactaaactacattttgtaaagaaaaaaattgagaaggacaagactcaaaaatggtttccagttagctataaagactggaaatcacaggttgcataccacctttatgtgggttaaatataaccttcacaagggtttgtttggtccacatattatcagctttaacagtgcttttattttttttcccccaaatctttgagcttagaactaatgatgtctttttaaaaaacaaaatcagaggatatggcaactgcagggctactattatcctgagagaaatcaatgggaggccatcagaaccagccctcttacacagccaacctcttcttcacctgagtctttaacttcctcattgtctacccagaactgaggacagaggtcaggctaatcttggccctagtgctctcattttctctttggtagttttaaaagaaagttattattttttgaaattcatatattaaaatattttggtctaaattctgacctaacttactcaatcgtgcctgatctggtaagaattcaagtttacgacactgcctctcagcattgccattcatcaatatttgactatacaaacattttgatgaaaatgtcgtttatatgtgtacatatatgggcacatatagatgtagaaatacaaatttaaatatatagaaagagtgagaaagagagacagagatggaaaaagaaggaacaaaaaaatgagataacgaaacaaagaaatgaagaaagcaagcaaagggaaggggggatgtgagggagggaagaagacaggaagggaaggagattatctatatacatctattctccaagatattttcagctcagtttctgtgccatcccctgtgttacttcaggcttgccctaccctgactggtggaatatcttgtcttccagatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggtaatgagaatctccatctttctgcaattgtagagaaagcacattaattgatgcataaaattccccaagacagaaggacatggatgagaaattcaatacaaactggagctcccccgatggtgacttttgttttttaaccttaaaaatggtaaattctagtgttttcagtatgacaacttatgtttggtacatataagcatgtggtcataccatcagctgctgcttcttcttttttttttttttttttttttttgagacagagtctcactctgtcaccaggctggagtgcagtgtcgcgatcttggctcactgcaacctccgcctgccaggttcaagcaattttcctgcctcagcctcctgagtagctgggagcaaaagcacatgccaccactcctaactcttctttttttttttttttttttttttttttttagttgagacaagagtttcaccatgttggccaggatggtcttgatatcttgacctcgtgatccacctgcctcggcttcccaaagtgctgggattacaggcatgagccaccgcacttggcccccaccagcttcttatattcagaacttcccatttcaaacaaggaatggcatgcaatattgagctttgcgattgagtcagggtatttatgatatgtggactatatgttttggggggagagagtgagagagatagggatgtggggttatataggctgtttcttcatgctcccattgatgtttcagtcaccagccttcccttttgctaccaataaacacatagcaaaggaaatgtatatttattaagcatctattaaatttcatataattatcttacttttgcttcttaatgttgagtagtatctattgcagagatgttaaataattttcccagtgtcaaacatgtctgtcaagtgatagatacagaatcagaaatcagccatttctgcagccagagtttcttagtctcctacaccaacttacttctgtaaaatcaatttagtttgaagcttccatgcccattacatttactcttcttttatcctccaggtgaactgctagttttttactgtattgattgtgaaaatatgtacagatcatttccaaatatacttttgttttgactgaatttaaagcattctttggttttggcttagcaattttgcttacttcatcaaatgctacttaattttaattaaaaattcttatgttaagctagtctcaatccccaaatttccctttagtgtttttactcactcctcaaactgttaacagcaaggactatttcacataaaatataaagttaagtcaaaatctcagttcagcaaggaaaggaccaggcatctgtcttcattgggtcctaggagatgtgtattatcacttcagaacaccctagggctgcttgggcaccagggcaggttacccgagtgccttctcctaaactcaagctggccgaagttatagggtaatgaattttgcctcttcatgtgggtaaaatcagatatagttaaccacaggtagaatgggcttctgcattctgtgagcccccactttatcctgcagcgaattctatctcattattgcggatgcctacaaaccaactatgatttgtagcctgggtggaggccatgtctctttaaacattatacctctcaagacctacagaagacattcagtggtaattagttgaacagattaatttagacaatctttaaagaagagaattatcgcaagatggcacctatgagcttgggaggtgtgttgaagtgttagatggttgtgctgccgtaaaacatattcaaacatctgctcccaatcgcttggattcactcattcctttgatttataggtttactctcacagtgcatattagacactatgtgtatagtcaaagaaacagatataggagctagaataggtagaagtgcttccccctagttactcttgactctgacccctcccctcccctccctcctccttccctctctccgtccttccctctctcccttccttccttccttccttccttctttccttccttcctttctctctctctctttctttcttccttagacggagtcttgctctgtcgcccaggctggggtgcaatgatgcaatctctgctcactgcaacctctgcttccagggttcaagcgattctcctgcctcaggctcctgagtagctggtattacagggcacaccaccacgcctagctaaggtttagtacagacggggtttctccatattggtcaggctggtctcgagctcctgacctcatgattctcctgcctcgacctcccaaagtgctgggattacaggcgtgagccaacgctcccggcagactctgagtcctttcttagctgccttcttgatctttgctcactgtttcttttcctttacccctttctttataggacatttgcctactgaacactacctcagtgtctcctcttacttgggaacaactgacccaggcttaaattactgcacactgaggggcagggaaaagcgtggccttatatcccttaattgggctgaagggctctgtgtctcctttcctaaaactttccactgatctcttccattccgctcccagcctctccctcctttgacttgctcaatgtttcactctgaacccctcatctgataatttcacttcatcatctagagtgagcccagagggattcttcataatgtcttctctcaccttgatcattccagaagttattacatatttcatgaccctttccatttcctttagagccagggactattttccatccagtgccattttctgtggcaagagacctcgctcagggcaccagaatttattattagataaggtcctgttcaacaatcagcctatcaaaggtcaagagaaaaggactgaacttcccctcttaaggatgcctgactcactcctggatgtcccatagcagcacgttgaccatctttgggcaaagtctaggtgagaacagatcagaaagtttcttctgtcattctcaagagggagtagagactgatattctgattcaacacttctgagcttcattcattgtcttagtgcaagtcatagcttgtgataaagggtttttataaatactttattatagaagcatttatatgtattactttatcagatatttactgatttatcacttacttagtgcctactgtgtgccagacggatagtctgctgtgcagagaaagtcaggggcattacggtccctgcccttgaggaaccctcagaacactggaaagaaaatgctatttagttattaggtgggtacaaaagtaatggtggtttttgtcatttaaaagtagtggcaaggtcggacatagtggctcacacctgtaatcccagcactttgggaggccgaggtgggcggatcacgaggtcaggagctcgagaccaacctggccaacacggtgaaaccccatctctactaaaaatacaaaaattagctgggcatggtggtgcgtgcctgtagtttcagctactcaggaggctgaggcagaagaatcacttgaacccagaaggtggaggttgcagtgagccgagatcgcgccactgcactccagcctagtgacagattgagactccatctcaaaaaaaaaaaaaaaaaaaaaaagtagtggcaaaaactgccatgagttttgcaccaacctaatagaaatacatgggtttaaaaaatctggcgagagaaataagcacagatgtgcctgaacctggggtagaaatgagctgggaaatttagattgtgaagagaagcagcagttacgttttgaaggagcagaagcagctagttaaataaataaacaaactggtgtactacaagtaggggttgggggtagggggaacatctgtgtgcagtggggaaatttaaaataatataaaaatcaccggcctcttaaaccacaaatatattggtgtggttgttgcacagtcgtcatttgagaaatgtacagaagataaaggaaaggaggaaggtcaaattcaggttatgaagctccttgtatggaaataacagtgagctagctttgtctgtacaaggattatgggcatacaataagtattcacacatgacaccaggcatatctttgtgaaaatgcatttattatttatctatcaaactctactatttactgcagaaaggaaaaatacaaaagctaacacacttgtgaaatagttaatcaagttcaacatacatgcaacttatttcttgacaactgactttccacacgtttcaaatttttgttttagaccaccacacctctttttatatcagtggtgctctgtgtgcctcagagaaactttggatattcttgccttgtaaaattccctcaagcttttgctcttgtgaaattaatcagaaaactgacttggccttgtatagcacgcagtggatagcggttgaatatgttacaactcctagatagtattgtcacttaaatgttacctatcatatcctgaattgttcttaatattttatatactgtacctcatattaacatctcaataactcttgaggttggttttattatttcttttccccagaaaaaagaaactgagtctcagagatgataaatggttcggttaaggtcgcttgactaaggggcagagtaggcattttagctgaatctaaggatgcccttaatgattatgtcaaaggagctgctaatgttggagttttgaataatagccagtcagtaaggatgctagagagaactctcctacaatctctcaaatcacatcaccgcagcatgcatgtttctttttgctaagccagggtgcttagggaaactggggcatcttctaagcctctggtgattgataattttttgttttgttttattatttttttgagtaagcttctcactttgttgcccaggctgttcttgaactcctgggttcaagcaatcctcccatctcagcctcccaaagcattgggactataggtgcattcaaccatggccgtcttgttctattttaataagccactgtaactgaataacatacatttcaataagacccaagtaaatgaagataatgagtgcatgttgtagggctgagtgaaagtgacacagctcacaaggttgaggtgggtggggagagaaaaaaaagtcattcagtgaacctcaaaagcacatttccttcttagagtaagaggaaagctttaactacccgtcggaattagctgatttcctaggggtttttctatctcagccaaatcactaaattgtaatgaaaaaggaataaatgaaggaacatataaagaataataattttactgattaatgactgtctgcaaaggaacttctctcaacataatcattcaatctctaggagtcctcccaactagatggtttctgaaccagctactttatagtgctggcttgttgagagtaagaaaggaaactctggtgacagctctgggttgcagaccctggagacagcacaggagagtgttgggctgtgtggaaggtggaaaaacagtcatccagcaagaggcgtcaaaggctggtggagcagcatgttggagaaggcagagagaatacacaatgtccctcatgatgatgacccgtggcccaaatgaagagtcttctcatccaaacaaccaggttgccctaaagtgaagctcttttacttggcagtagaacattcttttatttattttagaagaaagtacagaagttttcatttgatttttagtaactctgttctttgcctctcgcccttagtgtacccttgtataaagtgatatggcaaaaataggaagagaaaatgatgtaaggtgtaaattccggtcatctgataatccaaaaaagaaaatattttattcttttccataaagaatagaatatttttatgggatgttatctttttagcacatggaatcctggagctttaagctactacttactctttggttctacttttctgttacagagaaattatttaataaatgttgctaaattcatgaatgaatgatggatgaatgatttctgttagacagatttttaccaatgtatttttagataggtcaggccatagccatgatagaattagttgaaatttacttccttgttagccattactcctgtttcacaatctcacaataaatgcttaccaaattttaacctacatgccttttgctacagattgattttcttctggctatcaaaagtagttatttctctttctatgcccggattatttcatttaccatcatatattccaggtttattcatgttattgaaaagggcagggttttcttaatttgccaagcttgaacagtagttcattggttatatacacattttcgttattcatttattcactgatggacgctgagattgtttccatgtgaggggatagatatgtcaggtagcttgatttagccattccacaatttatacatatgtcaacacatcacgttataccctataaatatatacaatttttgttgttcaattaaatgattaattttttaaaaagtagttacaagtgaacttcctgttccaaaagttatctttgtatacatttgccttcaaaataagcttttgttttggtgaatgcatgtctaatccaggccccaggacattgccctccccaagggccctgcattcccttcccatgagatgcagaatgagatgatgctggatgcctcctagtggtgtcgaattttgctgtttcctcacctgggtcattatttgatctttcagaactctttcggtttcctcaaaaccttcacctctgagattcccaggctccatgcattaagggcgccttagaccacatagtatcttgagaaggggccccaatcctgaattctgagagaaataacaattcacctcagggcacactaacgttctatcccttatttaaaaataataataaattaggcaatctctattggttgaattttattattcattaatctgtttatgagctactctactgcttattgagttttgaaagtgcttgttctctaggcagacaggaattaggaagggtttatgtgggtttttgctcactcggtccctgaattcccagacacatcttgcaaactaatcagcgccagcctcttgtgttggagaggagtgtgcttggcatgcggtgggtcctccatgccttaactgctgaatgagaggatgcatgaatgaagagatgggacattttctctctccccatccacactttctagttattttctgctgtttcagtcattgaatatactcttaaagtatacattctggagtaacttgatactggcttccttatgctaatgttcccatgactgggtttcaatttttttttattttgtttttaaggcagaatctcactctgtcacccaggctcaagtgcagtggtgtgatcttggctcaccgcagcctcaaactcctgacctcaagcaatcctcacgcgtcgaactctcaaagttatgggattacaggcgtgaaccattgtgcccagcctacatttttttttttaggcagaatgttttgtgaggtacttcaatggaaagaataaaaaggcattgcccaattaagagataaagaaaaaatatgaaaatagaaaaaaagaacttgtaataacaggttgaaaattcaaaaccaaaatatcgcatcattactttgtagaattctaaatgaggtaaatagctgatattttgcctggcgtagcattaaagcaggttttttttttctttctttttatttaatgatgccaccatcctatccaacttttagggaaaaatatctaatatgaacagcctatcatccatgagttctggaaaacaaaacatagctatgaaatacttttttttttatcttgtggaaaacaaaacataccctgaggtttctattacatcagttatctgtcaagccttataaatatactatcactaaattgtctgtaaagtctcattatttgagcaattgcaaaattgtatcagaaataaaactcaaagtcattatagggattattattttgcatttacatgaaatgatcctctccctgaggaggtggctttaccacagggatattcagaactcaccagtcagaacacagatacacaaggagacattccttacaacttcttcttgatcagaatttactggaactcttggccaagtatgtctgaaggggacagctctgacagaatgggaagctggtgatgctgttctcatgttcctttcattctctctgtctttgtcatttctactctgcctggggctgcttccgtggtccatggcaatgctctctgtgaactacaaataaatcccaatgtctgcattttttaaaagtgtagtgccttcatcatgtagcagaaggagaaataattccatctcctttgcacatctgtcttataggtattttgtgaaagtgtcatgagctaattcatgtaataacacttagaatacacccaattgtagctatttttgctggtatcattgtcattttctggatataaaatgtaatgaatctctcagtaatattttattatgtaatggaaagaacaaattgtggatttgtcacttattaactagaaagcctaagtcatttagcgtctctgagcttctggtttctaatttattttttaaaagtgggggaatatctatctctgggaaatactggctgagttagcaataatttgtgcacccagcagatgtggcatggagtcagagctcaaagatttatcaaccatctttttattattattttctccattttcagccgatcttaaataagctataaaaggcaacattgatttatagaagttaaatggatgtctaagaaaagtctgtatgcatgtattgcaaatcaaaaccacaatgagataccatcttataccagtcagaatggctattaaaaagccatgaaaacaacagatgctagagaggttgtggagaaataggaacacgtttacactgtgggtgggagtgtaaattagttcaatcatttttgaacacagtgtggcgattcctcaaagacttagacagaactatcatttgactgagcaattccattactgggcgtatacccaaaggaatagaaaccattttatgataaagatacatgcacatgtctgttcattgcagcactattctctatagcaaaggcatgaaatccacctaagtgcccatcaatgatagactggataaagaaaatgtggtacatatataccatgaaatactatgcagtcataaaagtgaatgagatcatgtgctttgcagggacatggatggagctgaaagcctttattctcagtaaattaacacaggaggaggaaaccaaatactgcatcttctcacttaaaagtgggggtcgactgatgagaacacatgaacatatcggggtggggaacaacacacactggggcctgtaggagggttgggagtgggaggagggagagcatcaggaagaatagctactggatgctgggcttaaaaactaagtgatgggatgatctgtgcagcaaaccaccatggcacatgtttacctatgtaataaacttgcacatcttgcacatgtacccctgaaattaaaagttggaaataaaaagaaaagaaactaaaggggaaagaaagaaaagtataaatgcatgtatgcaatgaacaaaaacaaaacagaagtaatagcatgccagcacaaatttcattcaaccaccaaacttcgagtggagtaaggaaatagcactgaggttccttctccccaaaatagggctgctgtctgaaagtttattcttaaaattcaccatgtaactgatggatctgccctgtgtgtaaataaaccaagagattccttgtgaatgtggaacagaagagctcatggactcccagaaatcctgtcaaggtgatccatgggtaatctcagggaatgcagggctggaaaatgattgcaaattagtaaactaaaacctagtcaattgagctgtgtcttatgtggagaaagcctgtgtgcacagaatggggatggtcaccctgagacctaaggaggacagtgtgaggactcagggcctggctctgtgattccagcacagtccagaggcggcacagactaatgtgagaaacaccagcttccactcttgagagagctgctgtcggcaggtgggagacccgtgttggagcacaggagacattggtggttataggcaaatgctttggcatctaaatctgtgtgcaaatcctggcctttccatttgcaaatgataaaccttgagaagtttcatcaccttcctgaatctcagttattgctcctgtacaatgcaggaaatgtcacaatattttcctagcgttattctcaggattaagtgagctcatgagtgaaactctacttcaatgctcccatggccagggaaggcatccacggatataagttgctcatctgagtccccaaaccaccagtacataataaagcagcaacctcaaactctagcagtgcctctaatttagggatcttattttttaaaaaatagtttatctctggaaaaggcaacagtgatttaaaatagaattttattgtccactttataaatattttggtattgggactttgcctgtgagaggtagagacctcttaaaaggttttaagcaataaagtatgaatcatggtacatattatgtaaacatgtttcttggaataataagaagaatgataggaattaagagagtggatagattagaagcagggatccagtttatgtcaccagccccaaagcctaggcagaaccatgagatctcaaaataaaactgagtccggcagcatgaggataaagcagttgaatggagagatatgaagaaggtgaaattggtggaaattgttaattaagagtgagggaggaagtaagaaagaaatgaagactcttatgcttatgatctcagcaactgagtgtacaggacaagtcattcacagagttgagtgacagacaggtgggaaagttgacccctgagaaaatgactagtgaaggaggttgaacatcttagtttaaggtgcctgatgacatccaagggaaggatttagtagacagtcaaataaatatatattcatgaaggaacatgtgtgtgtgtgtctgtgtgtctgtgtgtagcagcaaagaaggcaaaagtaaaatgtaaaatggtgcaacaaagtgaaggacattaggggccgacatgttccatggaaactagcaatttaataagagaagtctcagtggactgaaggggaaaaaggccaattgtcgtaggttgaggaggaaaagggtgcagaggaagatgagatgacagaatgcaggcaattatctgaagaaaatttggctctgaagagaaaagaagggaagtaactagattgagagatagggttgaggatgactacagcatgcaagcagaaagagtgggagaagttgaaggtacaacataaagagagagcttaattgaaggagaaagtgccctgagaagtcagaagatgagattcaggataaaatactagccatggacaaggggaggattgctcaagccaagagaaagcaaatcacagtgggttcgatggtctgactttgcagatacctttgctagattgctatttaatgtcgagcttattctctacaaaacattaaatcattttccaacagggaaaacaagaattacacacacatacacaagtcaatatataaatcaatgtcacaaaatattttatgcaagaaattaaaattagaatagagagggaaaagagaatacagaacatttgggaacatttttgagaggaaactggagttgagtcttgagaaatttgaagagttggagaagacaaacagttggtgtgttccagagagagatatatattttggaatcatcaagatctaagtggtgttgaatcacaagtatggtgtatagtctaatagttttgacttttaatctacttgcttcctgaataagaccaaaggcaatctagaaatgtataaatatatttctagaaaaatatatatatacattatatatatattcattatatatatttattatatatatataaattatatatatatctatatatacacattatatatatatatataatggcaccactaattgtttctttctttgtattgagggaatgttctacaaattatgactcccaaaatcttcatctgtggtatttttaaaatcagttttacatctctaacgtcttgagggtcattttaatttcttagcagtaaagtgacattgagtaaaccttggctgattcatataccaagacctgcttttgttttcttgtatctgtttgtgaaaagtcctatggtttcagatttctggagcatttatagaaaataaaatagtttctgaacattttaaatacatactttatttgccttcaccccttgtttcttatgttaggaaataaaaacaagattgcagatgtggtccagtccctcccacccacccctgtgtggagcacagggagatggatattatcctggggtagactgtatatttgaccactcaatgcctgcatttgctttggttggcagccaaatgacctttaagctcatttaaagcttcttgttacctaaactcctcggtctttttttttttttttttttttttttttaaatctggaagccttgagaaagaaagcaaaagagaaataattgctccttaaacaaagctaagacagaattatcagcaagcatcagtgcagcattgcagacttgaagagttgcttgcaggcatcttactggccattcctcctttgcagccataagaaatgtaaaacatcatgtaccccactcaggagaagggggtgtggggtctcttgaggttgatccactcagattcacataaggacttcaaagggaactgagttcttgaattcttcctataattttctgtttgtctgccatatatataacgttttatttgctgcttctgagtgactgaaagaggaaaggacacaaaagaggggaaaaaaacccactgtaatttttaatagttaagtcacccaaattatatactaaaataagcttaccaagcagcagttaaccaaaattcgttgatgaaaatgaatggcagtctgtgacatttcatcaaacctgaatgataccccgcccccaccactctgccactctaaatttggtgaaataccaaaattcagatatttaaacttagagaagaccacattgactaattctgtaccatacccttgctcttgagaatatttaatttttttcttgccacatgcgttttattatttttggtcatactaaagtattttttaaggatcatatgcctattccatgtgcccttgtagactccataaatgggaatgtctggctgctctgctcatgcattcctggtgtggggtgccgtttcttgttctccttttatatattgtttgtatgtcatatttttatttcaaacttcagtgagaatttccataagtatgtattgagtttctactatgtacaagttggtgtgttcattgttttgtatgcattattccctttgattaatacaacaatattgaattattgttattattataaccatttaaaacataagaaagctgatccccagagtgacctcactgatgttatacaactagggtgttgaggtacatggattcaactcatgtcgtctgatcccagcgacaggctttcttactacatacaacacaatcatctctcaactgtacttaggaagggccttgtgcattgttccaaaggaagtgaaagtttgcagaatccttacccttggcatgaagaaagcaaatctacagctgtagactccttgcctatcaataggtaccaccatcatttgcatcattttattgtgactaaaacccaccatgacgatcaccactaccatcaccaccaattgtcctacccattgttttgaagtgctggaatggtacctgtcactcacaaatttaattaaatccgatcatattcctaatatgaccttaaaagcaggaataaatacacaaattccccttgatggttccattgcctataggctcaacacagccttcatctgcagtttattggtccagtcagtgtgggttcccattataattttttaaagaaatttaaaattcactgccaatattcaaaaactgaaaatttttacattaagattctagcctggctctttggtctcatattacagaatagcataatttcctgttgctagtgagtactacaggcctgttttagttgggacagctattttatacttatctctctttccccctgacaagagattgtgtgtcaatttccatttattactaacacaaagctggattcgcatgctttttgacttgcttggcccctgtaggcatttaaatttgtgtctgtttctgttgcattaaacagctttagagagcaatttactttaagttttcaggtaaaaatattcttagtaatgtgctttgcatcatcaaactaaatacaatttctttcctctgttatttggaagataattttattcttagagtgctatttttagatcccaacactttgacacaaaaacatcaaacttttgtggaaaagatgccagaatgtgtatgaaaggcagtcgttggcattgatgggcagactttagaaactaccattttcaccttgaaaatggaaatggagagacatacaattctattgcagtacagaatttcttcaggagaggatatgggtttggtcttcattccacttcggctgtttggaatttgctttgaaatctctgcctgaaaagataccggaatgtggagattgaaattcatccctgtgtctatgcaacattcatagatgtactttcaagctgagacaaaagccttattctatatcctttgaatggcctctaagtacaggtattcgaattgtagatattgtatggtatatttctttacattttccttttgatctgtaggaatatatgtacaggtgaatatttgacttattcataatcaagatgaattaatatgtttttctccgttttcatgagttggataataaatctgaaaatttaattttctacatgtggtgtgtaatataagctctccaatacaaaatcataggtggatgcataaaaagataaattgacttgcctggggccacagagtagttcaggaacaaagattagaactaaaataagtgtcactgccaccatttttgagcatttaccgtagatcaggcaccatgctaagtgactacataatctcttttaaacccatcagtcactgtgatgtagatattatctccattttaaaattgagcacactgaagatctcagaaatgaaattatttgcccagtctaacacagctaggacctggggactgagattccagagcacagctgtatacttctaaaactatgtccttaaagacctggggtagatactggggataccaagaatgtggcattgtccctgtctcttctgtggtgtgaggtgtgactttaggccagctatctaatatctctgagcctcagtttcctcatttgaaatgggcataatgacacctacagcataggaatttttttgggggaaaaatacctatcccctagtttatttctgctcaaaaccattgtacactcaatgctagtttcctacatccaatttttccttctcagccaaatgatgtggcccttaccatgagtccaaaaacaccaccttaaacaaaaggggaaaatatccaatggcttatcctattctttctaaactttatccaaaggtgattagtcaatattttatttgcatggttaacaaaaacaaagccagagtcactagctaccgagatctttaagaacaaaatgaaaagcaacgaagcagtaactataaagcacctcgagttaaaaggtggttaaaaaaaaatctaaacttgattaaaacctgttggcaggtggctgaaacaagtccttggagtgatttttgagtggaatttgtgatggctgtttcaagttagttgctgagatagccgatctctttatgggaatgagaggtgaggtttaatgtcacattagcacacattgagctggtgggctgctcttagccaccaaaagcagcatctttgtaaactatccatttctacaagcacacgtggggaagatgtaaaattcacttgtttttggaagccagtcatgggttttgtaattaacattccttcccttcacatacacttaggcgatgaaaggccttctgttttccccctctctgcccctaccctgctgcaactggccaaatcacttctgaaaagaggggtcatggaaaagagtccctagattatccacattttgtcctctttttttcttaaatttatgttttgcaggacaaatgatactggctttctttccttcaaagaccacttgcctgtcactcagatagttatcactgataccgacagatcaaactcagaagccgcttggagaattggtcccttgcgttgctatggtgaccgtgagtacaaaatcgaaagaagctttctctctgcattacatgagcacaagatgttcttactcccttatcccttttccctgcagtgtgccctagtcttgaaaattatccacatgtccagtgctttcccataccccactgaaaacgataaaccatgttgaaggattttctcatttgcaggacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctgtaagtgccctcaattatgaatttaatgtaactgatcaacaaacaagttttagtcttgtttttgccaccagtcactagtgggcatttgtaccagcaaattaatctcactggacatctgtaaaattagcagtgataatgtctagttccttctgatgctttatgattttttatgacctgtcagtatttaatcagtcattctcttatcaaaacatggatattccgaaaattcccatagacacctattacagtttccaaaggtatttcttacctgtgactttaatcttccacactacaggactttattcatgacactttccatgcaaagctgaaaagaggattattatgcattctattcatatttagggtctacttttttgctttgcctttgttccaaaagtaatttcctgacttatttcccacactaggagcgtgtgactatccaatcagaattcccatggtttctctgccacttccccatggacagtggcgtatctaataaacttgatgccaggatgtggatcaccttttagcactgcatatcctacatataaactatattcagtaataatcatgatatgtgaagaaaaataatgggaatacagatggtgacatttcctataattaaacattttgtatataatcatactaatgaaacaatattccaatactaataaaatacaatttaaaaaaattacatcaagtggtatttttaataaaaagggaaaaagcatacctatatattgctctgttgcgatcatagtaacattaaaatttatgtttctgagtctctacttctcgaaatttgacagtgacttcataaaatttaagttttttcatatgttcatgttcaaaagagagtgtgctcatgtccatttatcttatattgagaaaataatactttctattaattttagtttgtttcatatgaagcaagagctatacaaatagataaggttttaaacttcctatttgttaaaaattcataaaaatttcattttatactaaattatgtaaattctggtactgttaatgtttttacttcaggattgattctagaaacttctacatgtctctgcaagcaaaaaaattctactacaataatttcaacagaaaattaatgataaatttctattttattaggtaaaaagttaccatattcctaagaatttgaagttgcttgggttctagtaggatgcaaattttgtctcaaacctctgtggttccatacattcatgtattcaacattagatttgagtcaaacaaagctagcacagtaattatacagatgaaaaatgagaacttgagttcttattcttaaaaataaacaattagatttgagtctgtatttttagaagacaatggtaaatctagagttctatgtattaactttccctcagaatataatatttattaagtggaaagagagaaaacatactaatttgaagtttatatatacattgttaaaaattaacagtagtgtcatacaaacaaaatatatttgtttatttttaagagtaagaacttaagtcaaggcgcagtggctcacacctgtaatcctagcactttgggaggcctaagcaggaggattacttgaggtcaggagttcgagaccagcatgcccaatatggtgaaaccccgtcgccactaaaaatacaaaaattatccacgtgtggtgccaggtgcctgtaatcccagctgctcaggaggctgaggcaggagaatctcttgaaccccactggcagaggttgcagtaagccaagattgcactactgcaccccagcctgggtaacaagagtgaaactttgtctcagaaaaaaaaaataggttaaaaaaaataaaaataaacagtagcttcagcatctattgaaacagaccaacaaacgatttgtttggtgaagggatgttttatcactaacattgcttagaattacttgtgtatggtaataatttttaaaaagatgtatttttagtgacgtttgctatttttttggttctctgcatgcagcacactttttattgcttatagatggggtaggctgtacccaccaccttgcccttgttattaccatgaccataaagactcaggcttgtcattaggtgccctatgtatgtgtgtctaaatgaatgtttttctgtagtttgattgaggcaattgaccatatcactataatgatgtgactgcatgaaatacccttgaaagcataagtcatgtcttagcaacagaaattggaaacttgagagctccagaaaaggagacaaaaaaaaaaaaatgactggaggagatgacagaggtgtttaagtctcctgcaaattaccaagcagctaagtgtttcttttgcagttaccacacaatacatacaaggaaaaagatcttcttaattggtagttttaacctccttttgctccaactattgagactattaatgggaggaagctcttgtggctttggtgtgaaacaagatccctcatacctaacatggccagtctctaaaaatgttgagttgaatgccaacaatttcataatatggatataataacttcaatgtaaatttaataaaaatcaggccccatggccttttgattcattaaagcagcagcaaacgtatattattacaaagtaatgactgatgatttagtgttaattacgtatcaatgtccagtttgtttgcactttgtggtactgtattttagaattacatttgacaaaaatcaaaacccactgaagtaattgcttggtatataatatatcaccagattggagaacatatactctccaagacaagattttatataaaaacattgaaaagttcaagatcttatactctcaaatatttgttattattaatatttaaaaggggaaaagaccaaagtgggatggaaacatcttgtattctttatttacagctacactcatattacgcattttaggcagatggaatttttaccctaaagggttcatggcaagaaacctctatagaccaggcacttggaaaggaaatggccttttaacagatgcagtggctcagaatagatttccctctcatccgcaaggagtgttcctctaaaactatctgagcagcagtttccaaggttgatatatccgaattattggacagggaacagtagattcccatgaaattttcagtccatttccttccagcctgctttcaaagatatttgaatttcgtagcccatactctatgaaaaagaagacacgccactatgttcacaagtcttagtgaatgtgttttagtgggcctgtgaaaacgataactattttgatacctatctcacaatggctgtacaggtagaaattgatattttagagtagatgagatcagaaggaaatggcttttgagagtcagtctggcatagtggaaagaagctagactagaacccaatgtggatttgaacttttgttcttccaagtgggtttgtgagctgccttgagcaagttcttctcccttcctatgcttatttatgcaacatggggttggtgacatccatatgccacccagatgcctttggctgcaaataacagaaaattcaatctgaactggcaaccacaagaatgggaattcactggtactggagcatgtgactaagcccagaggaggtaggactggcttcgtttatggttgttttcagtagtttaacaaagttgtcagtcatctgatggttttctctctctgttatgaatgttgaatgtctacttcggtctaaggctggctctccatcatggtggagctgcatcccagctggtgaagaatccctgctttccagccttacgagcaatcctcctgagaggccactcacttggcccccaagaaccaatgtgtgtgactgggaacgtatacattgcagattgatttataccagggcctacccccacaccagagagtgggctagcttcccctgaagcccatgggaatgggaaagagggaagagtctcccaaagtgaactcagtattattagaaagaaggtagtcgtcagggagacaatcaatgaggattcttctaaggcagttgtcagaactgaaatgtgtaatttatttttaaaaataccttgcagaaatttgctgagctgctcaggggaaaaactgtacatatatatactgtatgtatgtgtgtgtgtgtgtgtgtgtgtgtgtgtgtgtgtgtgtatatgtatgtttatgtatatatttactgtataaatatgagagaaaagaaagagagaaagatttaactttatgatttcagaagtatcatactgagaatattacaaaatatgatgttaacttggacacactatagttagaacctcagaaaatagtacaaatgaatactactaataattacacttttgttgaattgttgagcaattattctgattagacactatacaattctttacattcctgatttcattttctttccaagcactcccatcgatgacgatcactgtgttgtactgtgattaccaccacacagtgcacgggtaggcaggatgaacctagagaggggaagtggcaagccctgatcgcacagctgggaaggttagaatcgaggacccacccagctctgtctgactccttgcagcaaccccgactctgctttgcaccagtccacaggattgacaatgttagaacttaagagaacatacaattatttacctccaggttttgaggcacaggacataaaggaagcccctgcaattttgtgcaataccacaggtactatttttctagagatagaaaatgtggctgccatcagatccttgaagagattatgtccctgaaaagttttaacagtattttatttagttcatatttctcattttacacatggacacgtagaaggccagagagattaactcactatgttaaggccttatgaattatttattccataaatcgaccctgaaatctctctcatgccaacctggggtggggattgaggacacagaaatggagtgtggttccgtcttcatggagctcaggactgagtgctgggagaagtgcagagtgtgtcctaaggatattctctaatgggcttggtggtcagtcctggaagaacatcatgcaggagtcttcttagcagcttcttctcatctcctaggagcacttggtagaaactctgttacagccctaaacatgccctttcttttttttatcagtcttctcaaaagtaaatcatgaactcatcttgtttcatttgtctcagaattctcagtgcctagcacagggtctggcttgaaaaaaaaatgccctgaaaggctaagactccttagttttgccttgaaccataaagaagtagctggtgagagaaggcattcgtcagaaggttgggggaagttgaacttagagggtaagttcatgatagagctaatgctgtcattggtcttctcccttcctattcagggccagtgggctatgtccacctcttcagcaagtgagagccagcttgagtttgccttaagggccctgttatactgggccacagtgggatgtatcattcattctctcacattgttttcaggcatctttattatctattctagctttgactagccagggcaactgcacaggtttccaggtgtggaggttttatcgcaggaataataatttaaaaattgagccctgggaaacaccatctggattcacatccagactctgccccacccacactgggtcagcttacttaggtacagcttactacctgtaccttacttccctcatctgtaaaagattccctgtctcataaagttgtagcaagtcttagtgagtcaattaatgaaaaatgagtagtaaggtatttggctcacagtaagtactcaataaatattaactatttttattgaattttactgattttattgaattttactgattctaggaggtgcagcttaaacatagtatgtctttaacagttgctttaataaagttaaataataataattttaaagactttgcaaggaccctaataacttggtataaaactgtaaaggtataaagaaaattgcagaatggcatttagtatgtgcagtgtaatgatgtttcagtgaataaaatgagaacttcctgtatacaaggcacagtgctaggtgctgggtatacgataaatcagatgttcttctagagttgcagactcgggggagacaataaacagattattatacagcagggggctgcagtttggagcagaggtaagcacagatgggaaacctattatggaggttgtggtcagggggcaaggctagtcacagccagcgaaacagcaagccctccccaaacatgtgttgtctcagtggaatttattatccacaagactagccttgcaggaaagcttttagcaaaatctttaacattcctcacccaaattctcaccaatcttattctgtgttttatagaaaaatgtaaatgtggggtccagtcatctctcagttaagtgtttttaaatttggggatgtgcagggctgccaggtggcactggtgatctgaataagaaacagagaaagactcaaggggccaccttcactcttatttagtctaactgctcatcactcaatctgttcccttcaattctgtttcctttaaggcatgaatttgtcacctgaagccaatttgcctaggttgaaaaatcacagatcacagtaataataacaacagccatcacctgttgaacatgcagtatgtgccaggcacagttctaataactttatcaggattcgtgtctaaataatctgatgatttaagtattgtttttattcccattttacagacaagaaaattaaggcatggtgacattgaaaactcgccttagatcacagtagctgcagagtctaagctcttaaatcccattcttactgcttccaccttactacctttcctttaggccagggctcggtagaaagcaaaagaattcgagctctcagatactcaaaattctgtgtaatgcggactttgatggaggctgctttcagttaaggtttaaaggctgggaagaaagtgctctgaggtggagtttgtcttttggcatttccgataatttaaatctggcagttgatgacttcatcaaataaatacccatttcctattttagggggtagaggagagggagcaattgtgaaggtgcctagaaaaaaaggaatgcctagcatatgaaagttccagtcctctcctcatcctcaatttgtaaattacaattagcctctccatttcctttacatttagaacattgttatgtgataatggaaaacacaagacaatatactcaacagagcaacatcgtgaagaaccctgcctgtggagtcagattctgctaaccacttaagacacttgcagcaaattatttatatttctgtgcactttagttttctcactcataaaatgctaataatggtacatttctcatagggtggttttgtgtattaaaatgagataatccatggtcagtgcttagcatggtgcctggcatagagtttgttgttcccactgtgctaccccttccaattctctctcttaatggttatccaccattgccactatcatcaccaccaccatcactggcgccatcaccatcaccttcatcaccaccatcaccaccaccgttaccaccatcaccattaaccaccaccagcactgccaccatcaccatcactgtcaccattaccatcaccatcgccatcaccaccactgccaccaccactatcaacaccaccactgccagtgccatcactaccatcaccattaccaccatcagcactgccactatcactatcaccattacccccctcaccaccaccactatcaccacaaccattatcaccaccattgccacgaccaccaccatcatcatcaccaccaccaccatcaccatcatcatcacctccatcaccaccacccccatcagcaccaccatcaccatcagcattaacattatgcccaccaccaccatcaataccaccactaccacagcactaccaccaccaccatcactgctgccatcaccattgtcatttcaccatcatcagtatgcttacttctgactgggtgccatctggcttccattatacaaagattgttatagagaggcagaaagaataatggaaggagtcccatgtgatgacaggaggcttgggtttgattgcaggtaccgccacctgcagcagtgtctccttggacaaggcgatacaactttctgagcttttttcattatggaaatagcacaaatgcttatataacatgcattagtaaaataaggaggaagcactggacttcccaaggcctaagtctcctccctgcaggagtggagctgccttgctaacctcatgtctgcagatatcctggaggacacagctgaagccacaatagatccagaaaatccagggcctcggcattcatgcaggtatatcagatgagcatgaatggtccaggtgcctatcctgtttcctgaatttgcaaacgtagcaggaaaaaaacaacttggaacaagtatacacatttaatttggtagctgttactattaatggtgatttcagtgctgcagggatttcaaaagaagtcttctctatattgatactgacttacaatcgtttctcccactcaagcctgtgccttgaatgagctaacaactccctctatccttcctgttttcctttccggtttcagctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtaggtaggggacatcttaaggctccttttgtgctaaaccctgcaagatcactgtgtgaccatgcccaagaaaaaattctcttttatctgagatctgggatatgatcaaaatgtcataaatcatttctaatggtaaatttcattctatacattcttttattctggcttcattggctacatcgagttaagataatgctaacctttagcaaattttgaggttgtccagattctgtacattttctttttgtaatattgtcttcagatgcccagggaccccttttgttctacatcattgtaatataaatctactccaagggacaggacatgtcaactctttacaacttagtgggtgtagactgtaagtcatgggctgcccttccaagtgctgccccagtcctgataattacagatatccatgcaatgatatagttgaaccattttaaagggattttcgtcaacagtaacatggttgagaaaggaatgatccctttctaaatcagggggctctttgatagtacctgaaatcatagcactggggatcaacctgccacaggctgttcatctgaactggcaactgctgctggtgggggcctggaaagatccaggcatccttctttagtcattcctcactactttcattccactcatagtcactgagcatctacaactggtcaggtatcttgttagatagtgggtattgaaagatgaattgagcactaccactgcttttcaaggagtttataatcctctggtgtgtgtgtgtgtgtgtgtttcacagagaagagagcatggggttttggaagtctctcttcagtgcctgagccttaactacatttatgttggcattttgtttcccttgacataattcttacattttgttaaacataagggagtgcgtgtgtgtgtgtgtgtgtgtgtgtgtgtgtgtgtgtgtgagagagagagagagagagagagactaatacagggtgagccttatagctgtagttaaaaaaaattaacataggttgaggagggcttgtaaagctttaaagtacaaaatcgagctcttaaagttaagaaatattgtcaatactaccaaaacaaagagtgtgcttttatataaaacttggagttcagatgtttagaacagtgatgtaaataagtgacagaatttgtcagtctacccagatttaactttgtttccttttttgtttatttattttttttttgccaactcccacactacatagctttactgctagtgatgaaatgccaccagcattcaatggaagtttccttacttgcttcctttaaatttaggtttgtgcaacttttagctctgaggaaagcagtcactaaaatcacaccagctaaaagaaagcaagtaatagagtgtgaggatatcatattctctcttctcaacaggaaccatatttctttctttgtctgttatgttccccagatccagcagaagctaagatataaattatcaaaacagttttgtgattgcaagtcatttgtttaattaataactcatatatgtgatatgattcactattaaaatattttaaaaatttatattgctgttttaattctatttaaacatcacattttgatgggtgacttctgaggaaggttgctagtcatcaaaatctaatatattttttggtggaatcaagtcaagtgtttcacaattttcataaattatattccatgccaaagtttaatttatcttcaggcagtatttatgaatctttctggctgaaaggtatatataaagacggaataattttttaccctttcatgcaaaatttatgtagctacaaaattatcatacaggctggatatgtgataaagtttgcgcaagtcaaaagggaaaggcggcagctgtgtttcatggcagatttctatctgcagacgtttcggttaaattgatcacaaatgcaatgagctgtaagagcatgtcgatgggtctggaggagatatcttgctggagctggagccaaggtcagctgtggcaagagcacctgcttctgctatgtttctctccaataagtcccatctcagatgttactctgctttattgaatttgtcttaatgtacttgaagaagaataaaatgctgttggaggtcactttaatggtctttcagtttgaattttcctatttagagttcagtgatatgcccatttagaaatgtcaggtagccaacaaagctgaagtctcaacatttccatcttgcacaattcagttgttcaataaatatatagataaataaataagcattttggtgcttagttatagtcaccaaaatgaacaattgcattctgtattattcagaaattgagaggccctggatatttatatttgctagggaggaaaagatatcattggcgtgtgcttctttactggaatagattgagtgtagcattacttaaatattaatttggatatgtctgtctagatatctttggccgctgaaggatctttcaatcaaaatggagcatccttcagcattgtaatcactgacacagctgccgtggtcatgagtgtttcctgagtaccagaaataggctgcgtttttacaataggatgttcctctcagcactgcccctgtcattggaatgtgacaggttgaagtgctgatacatgagtcaatgcatactggatttccagaatcaatattttaacttcaggctgttatatcaccatgatggttagggacatttgcaaccatgtcatttcaccagtcacatttctttaacagagcaggagactcttcacaacatgcagcttctgaaatgtaagctgcaagcgtgtggcattctcacctttggaatgctcaatagtaccgccccttctgctttgttattcccccctaatgtgtccatcaatgtgaggatgaggcaagaaaaatcgaagatccaatggagagatctgagtatgcattcctggtcagatgccaacaagccataggccctgggtagaaaactaactagcatgagtgtactattgtctttatctgcagaatgaaaatgaagagactgtaactgatcttctaaggcttgaagatctgctatctgcatgtacaaattaggaacgactgtcacacctacagtcatgcccatgtgtacgtaacagtaaagaaaatgtctcattccctccaaacttaacgcaagatctttcaaaatatgcggcaattatagagtggaaatcttgtgaagatggggcctgtgagtctcattttatgactctatttccttctactttttatttttcccatgggcctattttttttttcttggcccaactgctctatttgtgtcaaaataaactgaagctactccaaacttacaatcccctggggaaaatactacactgacttgataagtcataacatttggagagatcccccaaaattgctgttcttgcttccaggctggaagggaattattactcctatttcaggtgaagcgtgtcaaactcagtgaggtcaagggtgaagccaggcaggcttggcgtgcacatgtttattttgtgctctggcacttcctaaactcttgatttgtggcataatgcaacacttaggtaactggcctcagtctcctcttggaatagtaacttatattttatgcttgtgagtgcctcatgaagatagccttcctgaagcacgcctgtagtgctttccattaggcatgatgtcatgtgtctcacagtataggaagagatctatattctcttcacattgagaaataattggaaaattatctgttagcatatttttacataaagctgtatttgcatggaggataataattatcatgacatcaacggtgaaacaaaaagtgaagaaataattgtttttttaacattatataaatctctgattatgtctactattcccccataaaagtgtatttttttcaaagttaaataatatattaagtatacttcaatttttttaggaaacattaatgtatgactttcaatgtccccttaccaattacataagggaaattgttttggttggtttaagaagagggtaagagacctctgagcgctagcgggcaggtcctgggactgcctcagtagccacataagaaacactagaagagcacccagtggccactcaaaaatgcttctttagtggggaaaaaaaaaaaaaagatgaagaacacctgggtttgtccctagcaccagtgatccacaaaatcaggttcttgtagcttgaaaatgtttgaaaaaacattggttctgtttttatattcaggaaaagtgagtgattaaatcatcctttcagcaaaattttgtctcttcttgaagatgttgagaattggatacatttaacccatcccaacacccattttagtgttttctactcgctattatatattttttgaaacagagtctctctccatcgcccaggctggagtgcagtggtacgatctcaggatctcagctcactgaaacccctgcttcccgggtacaagcaattctctttcctcagcctcctgagtagctggggttacaggttcatgctggcacatctggctaatttttgtatttttaatagagatagggtttcaccttgttgcccaggctggtctccaattcctgggctcaaacaatctgcccaccttggccgcccagattgctccctactatttcagacacacttttgaaaggtttgtctacaacttcttctgctttaattgagctcatattgtgatcttttggtctctgttggattgacaatggacaattgaagcagaatggagggatgtgtgtgtgtgtgtgtgtgtgtgtgtgtgtgtgtgtgtgtgtgtgtgtcaggattcatactgtcttttttaaaggagaatgcagcatggtatcatcttctcatgcagctcagaaagagaggacccgggcttcagacctcacaaaaactcaaagttagaagcagtaatttgattctcttggcacttccacttgtcaacatttataactcagtaaagaaagaaatcattagaagagcatcatttatgtgaaactggcattctaattgtaaaaagaaacttaaggcagatctttctggacaataaaacagttctccctggacattcaaggacccaatctgaggggcaattgcaggaaagaaatcaggctgccctggagctaatgtgactgccacatgctgagtagccacaagggaagccccagttggaaaagagcaaaccagagaggtggctgaggctgtaacactgcctagagcttagtgagctggtttccatttctctgagtctgcccagaggaagcagatgactcagaggaggtgagaaagcccttgggcagagtaggggatgggaagtgtgtcgaaaacctccagtaagtcctactggccaagttatactcttctcattttgttatgaagttttttttgaacacatgcacaagtggtgtctcagccaaagcttcgtctaccttttccatgcacagtgtgtcatcatctcctttaagggtggccttgcttcagtttcagcagcgctggcatcattagcttcatcaatacccagaccgagtttgatcatcctgtcaatcctgttagcacatgtctggggatcttccacactcaagccagaagacaggaacacattttcataaaccaggaagcaacttaatggaagaaactctccaaaaggggcttgttttccaaagaaaagtatagttcagaggagggaaattataagcctacctaggcgtgttgtaaagccattcaaaaatagctcagagagaggattctgaatggtaatgtagtgtccgactcacattctgcttaaaaggattgtaacaaatagagacaagttaaaaagaaaaaaaaaaaagagtttcttctgaacctggaagaaagggatgtggattcaaagctgcttcagtagggaaggtgattttgtagaagaggaggtaagaagtgccatgctccaattcggcttccagtgttatcgtccctgtttcaaggtaaataaggatctgctctcaggctcatcttccgtgtgtagaggggcttagggatctgtggtaggaccttgtaatctgctgtccaggtctcccttcaaagaaggacttgctctgtggctgggagtgctgttggtggacagtcttcatctgtctgcaccttcagaagctgcctcagctgcagagaaagccttgaccaaggtcatgtcctttccagggggattcacatccagtgactgagccagagtgcaaaggcacaactgttgggcccaagaaggaacatctctggttattcgttctggcttcagcactcccggtgggactgtgctgggctgatgttgggcctttaccatagttcacttttctgcccattcatactttctttttcttctgtccaaccataagtatggtttccaaggtttcccctaaaaatatcctgtacccttaactccatcacagaacttgctttctggtgaacccaacctgagaatcaggtatatttttcgtgcaacttacacacatgtgtgcatgctcacacacatacacacacacacatgcttcttttaaatcaaattaattttcttaagtgaaatttatttttcgtttctcctgagaattagctataaaataatgcctcttcctctcctactttctttttccaaagcactgtttcatgctaataggttattaagaccaagtttgcatggttttgcttcattaccctttgaaggtcctggtactcaaactaaaatggacctgcccctaccctgatctacctgacagactcctcttcatggataatgcagactttgatgagtcagatgaactatctcctctcaagggagtctatcctggtacacccccctatctctgtgagcacacacaatacgcctgattatactgacctgattgtttcatctcccctttctaggagtttctttgtgggaagacgtagtgtctaatttatcttcacatctctgggaccagtaaaggttttctaatatatttagtgttcaataaaaatctaatggattaatgaaagtgaatgaaggcagagctccccgtgccgtccattccactagtggctttatggtattaggcaagccacttactctctctgagcctcagttattccatctgcccactgggcttaataataatcaatagcttgcaaatcagtttcaaacattgaatgcagcaatggatgtccctgttccacttgggattttcttttaagggttcttaaataagaatggcaagcaaaagactgtttcaaatgggaaatgatttgtgccttcaccccattggaataatgagacactccttttggaaactgaggggttttgacatttaaaggacacactcaattggtgtaatggctccagggggaaagatccctccctacgctggattttacttcttctcacaaatcaacagaaatgtctccacacactagtgtacttggagtgtgagtgcctcaaaagctgaatgcaggtccttataaaggggaaagtttcttgccattttcttggccatcgactttaaagataaagggatttcaaaaccacattttcaaattactatatggttcacatacgcctgcttcaaaattgttattggtaaattacattctcactgctattattttccccctgatctgttcaataagacagcctttttttgggttgtttgtccaaatcagagttgtgtccaatctggtagtgagaggatgtgcccagaccagaaatgggacctttacttgtgatttaagcataccagaaataaactgaaagctgaccacactcctaacacatttgcaatgccttctgggcagtcaggatttggcctcagccactgaccttctcttggtctggactgagaataaagtgcagcaaaaagccagactatatgattgttttaaattgaaatgactttctttagcagaatttattcttcattctcccagggatcaacctcctcttttcctactatctcacccaaaagagtttttaaaagcctgtgggtgcttcggtggagtttggagcattttgcaggatggggagtgagggacagtggtctgattctgcactgccacttgcttttctttgtccttcatccttttttccccactcacattcttttccttccataattcactgagcaaatattttccaagtgcatgctcagtcagccctgggctgggcaatggggtcatggagataaataagatccattcactctttgggaggtacaggctcagggaagaggtgagctggattttctagtaagtccttcatgctgtggtatgtggtatgtactcaaggcggtatgagcagggaaaactggatgcagctcccaactccatgcggaggcaggccccaggctctatttctcttacgttgtgtaagtgtttatttcctgcctctctctttcttatattggtgaaataagattaatttgcagttagtacaatgtctagggaaatttgcccttggaaggcagcctgagacttgtgtgcccactcagtgtgtaggaagcagatctcttacattgctaagccagttgctcacttattcaggtatctgggaggacacctggagcccaaacgcctcagggcctaagactgaccatccttccagatcttgctgtctatttggggtactcaacgtggacactgcattccccgccgccatctacactgcactggagccctgctttggactcgggttcgtcttaaaatagtgagatggtacttctatcaatgacagagtcaggtgcccttttgctccatattctctgccattttcccacaaactcttatcctcaaggaccgttcttttctaccttttatctcccatcctttcacagataaattaattcatcaaaaacatgggggtgggggttactgtcaggatgaggttgttgccctgaagggcagattcaggctgacaaggtcttacccaataataagaaacagtccttgcccagaggagtgtgctccaaaagcagtaatggagggcagtggagcagttatatatgtatatatgtgtgcatatgtagatgaggttcatttcttttttataatacctccactctcttagagtttctgaagcctgcagttttcccctttccgtcagagcatattgtgttatgcgtttcctctgattccatcattttttatccttttgtttatttgccctcatttttctcctcttttatcttctgcaaagccaccttgcttccttccatttattcctgaaggccacgtaacctctgatggtgcctgcatgcccagcaggaaaatatggatgataatgtgtcctgcttgctttgtgttcacaaaagactaaaagcctctagatatttcagtattttatccttgttattattgttattctaacttgtccccatcattatgtattgtgaaattgatacctttttctgtactagaaggtcatgtggaccttaaacagtaggaaagatctagcttgaacccagtataggggaggcttcagaccaaccacaagccataggtagaaatggaaagtgtaaatcagatttccaataagtatcccaggactgggagaattttagttcaattgctcacatttttttttcatctgtagtttgtaaaataatcactggcatttagcatattgaccaaagaactttaaaagaaaaaaaagcatcattctgagaatgcaaacaattaaaatttaatttattgctggtgggagtataaatcgaaacagttaagaagactgttttgcattatctactgaagtcaaacatatgcataccctatgaccaacagttctactcctaggtatacatcaacagaaatatgaaccataataaatacagaatattacttatggcagcactattcaaaatagccaaaacctatactatgcccattgagagtagaaagaaagatgatttatgaaatgtttctcacaccagaatgctgtacagcttcctttattaatatggacaaatgtcatcaatacaatgctaggcaaaagaagccagggtcaaaatagtacatgcaatgtgattccatttaaatcatattcgacctctgatttcagaaacgggttagtggtattcttagaaggggtggttggtgactggagggaagcttctggcgtgctggtaaaattctgtcttttgttctggttgctagttactttggtgtgttcagtttgtgaaaaattatcaagtcatatattcctgtgcacttttgcatttgttcttgaacacaagaaacaataaaacacagtactaaaaacagcctcaatcattgaaatattttctcatcatcataagttttaatggttttataagtagttccccatatagaattaccatgacttatttatcattctcttttgtcagacatttccctcccccagtctgtaacaactatttcaaaagatcaattaaatattaatatttctgcttgtaatcctcctccaagctccattttcagcttttttctttaaaaagtgcaataaagccagtaataacaatgctttaatggctcttgatatggattgatgaattattattcacaagtctttcacaacatttatttctaccaaacaaataaggaaattattttaatctgttaaccaaattcaagttatcactaaactcttttccagtttcctgagggggtttggcatttggtttgaggtgtcaaaatttgtagtgaggattaaatcaatgaagcatgtagaaggtttgatattaaataaattcttcgttctgatcactattattattttaccttttgggcatccagttaatactaccagtattattaaatagtgtatgtttagtgattcctgagcaagaaatctctctatctggcaaaactcaaccagatacatgccttatccttaaggaaatcacattttgaaattaaagtctacagtaggatttcctcctggtaccaagattctgccaattggagaaccaggacttaaagaagaacataattgatagttagtgtacttgtttttattcatcatgtatatgttaaaccttctgccactttagtcaaaaagtctgccactttttgaaatctaggtggtaaatgcagctgaacttcagtagaaaacaaactgctccatgttcaagggcataaaaataaagtaaggcaggaagaaaggtgggagggaagaagggaggatggaaaggtggcactgtactaatttttatgaaataagagcctgacctgatgcagtctgtgtttttccaggggcttctctgaaaatcagttttgctggagcatgtgcaggaaagagcagatacacatgagagaaatagaggctccgcgtttgtgctcaaggagggtaaaaggaactgagatgcttctctgaaagcaatgagcatttgtccaactgacacatggaggttttcaaagacagtcttagaatgatgatagtgaagtttttaagagttgattcatactcagtccaaggaaacatcatcataatgaacccacttgataccaagggccaactgaagagtatcatacaaaattgcttctagctaggccagccaactaatggtctaagttgtcaaaaagactgatagagaatcccagagaataaatgcatgctggtatattatttggtgaaagaaaacatgtaagaggtaagaggaagaaactggaagaatcacttagttgtggtattgacccaaatcgtctaatatttgtcttagaattttagggcaaggagctacatgcaggctttgaaggtcgccatgtccagtgtgactccaggctttgccacataaaatctgtttaattccccactctggccaaagcaatctctgatgttaagttttcttaggcaatgtggatgttaaattttcttagggaatgtgaatgatatgaagaataccttctttcccattgacaatttaatgagtttagtataaagtttctagcctacaactagtatgactagtatctttaaatattgtttttagaaccagaggcattgctctggtcctcaaagagctcagagattaaggctgagaaaaaaaaaaaaaaaacaaaagaaaaagaaaaagaaaaaaaacccttaagcatctctaagtaaaaagctacatgttttttgttcttctaaaattacagtgaactgtatacaagaaacaaacaagtaaaaatgaaagtatattagagcaataggggaaaaattaaatacttgcagtggccaggaaggcaacatgaatgaatgaaatcatcctggtgggttctgtggtcaagtggagagtgcatgccctatcttaaaggagctgaccccagtgcagttgagaattgccatgcaagaaagcaggttcattgttaagagatgttctgatttttcaatgaggaactaactagaatttttagaagtattttttgtgttttaaaaaattgacaaataattaaaatgaggaaatgatcggtgggtagaaagataaatgactaataagtttatatgagttcaggtgtgcatgtctgcgactacaggggtagtgtaggacaaacagtggagtgcatggggatggataacatactagtaaatacaacatatgtgaagaggtgcaaagtctagataggccatgtggcatgagagccacaagtggttcggaatgcttggtgcactgaagtcagtgcaggaagtgtgggagaaagaagctggtggggtaaggggaggccagatctcccttgctgtgtcaattgtgatcaggaatttcagcttgatccctaggacaatgactagtttccaaagggtatcaaacacgtacagcagaatcacattttcaaatttgcattaattctagccacaaaatgctgaatggaaaggaagagcaggggctgaaggtagcatgtttttgcagggattcaggttagggtgacagagaatatactgaaagcagtctccaggcatagaaagaagcagacaagctggccgttgtggttcacacctgtaatcccagcacttggagaggccaaggcaggaggattgctcgagctcagcgttttgagatagcctgggcaacatagtaagacctcatttctagtaaaattaaataaacaaataataaaaataaattttaacgaattagctggtcgtggtggtgtgtgcttttggtcccagctactcggtaggctgaggcaggaggatcgcttgaactttgggagatggaggctgcagtgcgctatgatcacaccaccgcactccagcctggatgatagaatatgactctgtctcaaaaataaaacaaataggcaggcaggaaggaagaaaagaaagagaaagaagaaagaaaggaagaaagaaagagaaagaaagaaagaaaggaagaaagaaagaaagaaagaaagaaagaaagaaagaaagaaagaaagaaggaaggaaggaaggaaggaaggaaggaaggaaggaaggaaggaaggaaagaaagaaagaaagaaaggaaggaaggaaggaaggagggaaggaagggagggaaagaaaaagaaagaaagaaagagaaagaaaggaaagaaagagaaaggaaagaaagaaagaagacagagagaaagaaagaaaaaagaaagagaaagaaaggtaggaaggaagcaggaaagagaaagaagagagagagagaagcaaatggattcagaaacagatttctgggagagggagagaaaatccacagggctggcgtaggggaggaggacagtgagagaggaggatgagggaagattactgttgcctttctgtttctgtacaataagttttacagaagattcatgcctccaataactctctacacatagtaggtaaaaagggccgcttttaaaaaattattctctttataaagaaaaagcaaacttactcctagttttctcctttgtaaagactaaaacagccaggtaaaaatggaaatttagttcactgtgcaattgagttcataactcactgtgtcattacggtttgtcagcatctgtaattgaaataatcccccagatttgtgtcactatcaccaggttctgtaagtctcaaaccttaaggagtgcatttttgcccgagaaaccaccaaccccagtcatcttcttctccattaaaaaagttgttgactaagtcacacgcaagaaaatgtgcaatagatcttgcattcttcacttctgttaaagaaaaatgacactaacaagatatatgaatagttattcaaatccaccatggggagtgacaacaaaatgagaaaaacaaaaccaaacaaaacatttgactacatatatcctctcctctttattctacacactctctaggaaagaaataatgaaccttcctctatgatctgcttgtgtttataattgatttatcttgtggttaaagagatttacttaccaaaattgagacagacaggagaatgtaattggggtttggcctcctggcctgcttgggtatcacttacgggaactgaaaataaaataattgaacacatattgtattctataaatcattacttcagaatgcaagacgagatctatcccttaggataaatttctatggatgtagcaagtgaatgtcatacatatatttatgagtctgctgacctggtgggatttaggaaaaacagcccttctctccccactctcccctgccccatgtccccctcacatcctccccatttctaattatttccttgctttcctcaaagccattgacccaccattgggccagtctgactaatgccaggaattctttaaattatctattcattcctttaacttacagctttgtttctcacttaacatctctattccctgtctaagattatgcatttcaatttctcatctgatccactttgataaggacacatttgtatctggtcatttgtcagacaaagatttaataaagttgtagaataatttctagaatgaggctcagatgagagatcctaagggtacagaaaacgaatgacaagttggtcctgaccttggtattttcccttccaccttttcctcctctccattagtacatctggtagacctcaaaggcctgtgtgtggctttcactcatccatatgtgtagacttgagcctgaagatttgaaacaaatgttgtgttctttaaggccaggctgtacctccacctcccctgggttctcccaggagtttcagcaccaaataaataccttctaatgggacttagcttaatttgccggcttgtctttcaacacacgtttttctgatatcagaggggtaggctggtggaaaactggatttctgatgggaacaaaacactctgaaatattaaatctgcctgattcttgaataattttcaagaaacatataaaatctctctgaaatcttcaagatatatcctcagcagaaagttacaagcctattgtgtattccacaaaaaagaaatctgtcttctaaatcataatgtaataataagctcattattaatcagcttaatttaaggattaatcagcacatatatattaagtaactggttctagccattgtgaaggtgcaaaagaaggcataagagagcagcagtgattgaacaggtattgtattctatgttattttttttctttctttttctttctttctttctttttttttttttttgagacagagtctcgccctgtggcccaggctggaatgcaatggcatgatctcggctcactgtagcctccgcctccccggttcaagctatttttctgcctcagcctcctgggttcaagcaattctcctgcctcagcctcccgagtagctggaattatagatgcctaccaccatacctgactaatttttgtatttttagtagaaatggagtttcaccatgttggccaggcgggtcttgaactcctgacctcaaatgatcagcccgtcttggcctcccaaaatgctaggattacaggcatgtaccaccatgcctggcctattgtatgatcttagtgaagcctcaccacacacccacacaatagattgatttttattttatagatgaagtagctgaggcttaggtaattccatggtcaatatggctaatcagcaagtgacatgcgtttgactccatgtctatctggctctggtctatccaccttccactccactgcactgcactgtgcaagcattaggaagtctactgaagttttctaagttggtgtacctaacagcttctgtctaactttgccagaaaggacagtcccactctgtgccttccacttcagatgaaagtgtgctgtggactgtgtgagaactttttttttcacaagaaacatggccatctgaagttttactcttaaacttgtaaaatacaggaactacaatctttcactttttttgtatgtatacggaaagagcttgagggagggggttcccagcctagaaggacatgtatttttttcttaactaacttttattttaggttcagggctagatttgcaggtttattatgtgggtaaacttgtataacatggatttgtcgtatagattattttgtcacccaggtactaagcttagtacccaatagttatttttctcttatcttctccctcttcccacccgacaccctcaagtaggacccagtgtctgttgctcccctctttgcgtccaagtgttctcatcatttacctcccacttataaatgagaatatggggtatttggttttctgttcctgccttagtttgctaaagatagtggcctctagctccaccattgtttctaggacatgcatttatttgaggctctttggaattccaactctcactgaaactttaataaaaaaattaatttagaccttcatgacaacagagaactacttaactcttacccatgccaacattaaacctaaatgtattgagccctataataccttacatttgtttccttttatttaacctcttagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaaggtaccttaggcgctcctgtttctcctgagtgcagtgctgtatcacctatacgctatggtcaggccatgtgatactcacactctgagacagtctttatcatctactctcccgctgtttagagagtctgcatagttcttcaacgtaattgcatatacttattggtattacatgtgttcactggcaatgtaactgaactggatggataattacaggaaaacaccctgcccacggccaaaaagtcagttaagtagagaaagaggtggacccacatttctgttgttagctagattgttagtgaacacattaatatttccacttccaatccctcagcccgcaaatgtaatcaaagaattgtagaatctagccctgggggagccttagagatacttaagccatcttaaattattttttacaacaaagagaatatcagtaaattagtaaacacagtaccgtgtatttggtgaaatctctctattccgcaggtgacttgagcgaatgtctgaggctttaaaagccctgtctgaaagttcatatttagttcattggtgggctgggactgaaacacacatgaaagtcaaattttctgctccaggacttttcctataccccttcacaatctcctgagttcattacattgacacaaattaataatcacggatatacaccttggacaaggaatgaggatcattgcttaaattctctagataaattcaagatacctcaagaaactagaaaatctcaatattcagtataaatacgtaggatttttcaaacataaggaaaaagatttggtgtactcataatttttgcaatattttaaagacggaaaaagtttgttcagtaaataatgtaaacaatattttaagagcagcatttaaattattaaaataaaatgcttgaatcactttgagacaccatttgcaaacaaacaatcagagcaatgataaataattcttctcaattcattaaagcatatcttcgaagcacctttacaaagcaatggtttatttagtccagcttgctactgttggaacttagaaacaaaagggaaaaaaagcactcactgttttatttgaaggatactatagtttgagccctccgttcattcatacaggggccttctcctgaattagtttgaattacttacttattattcctgaagagcatgtcatgcttcttgggagaaaattaatggtaaaaattttcgggctaaccgcatggaagcttaaaataaaacagtttccattccaggggctcatattatgagctaaacaagtaaagtgctgctaggtattcacactggcggaggtctctgaacaacttcccctgagaagtgtgaatgcttccctttgagccatcccacatgctaggaggagcacgaacagaataaatactatgagaccctggcactgaaatgcacaagcattcttctcagcatctctaaccaagtcttttgtttggaagaacatggacagtagacctctctgcatttctctggggacattattcaaagatctcgtagatcatattgttctaaatgtagcctaatttctttttttttttttttttttggctcctttctccaaaaccattcatactaattttcttctgtccacggccctgtatcttttccctgcatatgttgcaacatctctgtgctccctcccacttttaattatgatctgcaagttacataggcaagtgtgtgcctagccttttcatatgcttcgtattttactatttccaaactgttcattctttctgataattctaagaaaattatttcctctatatttagtcctcgcaatgtaagtaagatggcctttttagtcacatctttgagccctgccaactgcctctggggaatgtggccggaactgaaatgggaagccagtggctacaagatggttctgaacagagggtggtctgtttggtgattggggcagccttccatgctatttactatggcgcagtatatttcaaggagatggtgtgtaaatactgaatatatcttggatagaattagggtctttttttcattaccaattcctaggtcagaactgtgtttcattggcgatttttccgtttctcataatgatacgaagaagcaatcatcataaaaaataaactagtaattaactgcaacatatattcctcatccaaacaaatagagcaggtattaaaatctaaatttaacttattggggctcataaaggtggactgacttgctaaatgtcagatttggaggtccatctagcttgtttttggttcattttttctttatgaccctaatttcattctatacatgaacatggtaataggattccatcgtttcaaatacagagcttttgttttgtgtattttttctctctctttctattatcgagatgtaatttatataccataaaacccacccttttaaggtgtataattcagtgatgtttaggatattcacacagttgtataacaatcaccaccatcagtttcagaatattttcatcatctcaaaaagaaattccatgtcattagcagccacttcccagttacctcttcccgtgtccctggaaaccactaatctactttctttttctgtagatttgcccatcctgagcctttcatataaatagaaccatatagtatgtgatctttttgtgtctgatttcttttacttcgcataatattgtcccagttcatccatgttataacattcatcattactttattcctttttaattgccaaagagtgttgcgcagtgtgaaagcaccacagtttgtttatccattcatccattggtcagttaatggatgttgggatggtttcatttctttggctattatacataacactgctataaatatgtacaatttttgtgcaaacatatgttgtctatcctcttggatatatacctagaagtgagattgttgtgtcaaacggtaactataggtttaatctttttgaggaacttcctaactttttcaaatcggctgttccattttacattctcaccggcagtgaatgagggatccaatttcttcatcttcttgccaacactttttattgtctgattttttgatgatagacatcttactgaatatgaaatgctatcgcattgtggttttgacttgcattccctaatgactaatgatattggatatctttttcctgtgcttattgtccatttgtatacataaattttttggagaaatgtctaacatcttttgtagattttaaatttttcttctttttactagtcagttgtaataatttgtcgtatgtttggaatataattcccttatgagatatatgatttgcaaatgttttctccagttctatgggctgtattttgtcttcttcatagtatcttttgaaacactaaattttaaattctgatcaagttcattttctctagtctcctatcttttttatttatacatttaggatcatagataaggaagccttacttaatccaagatcatggtttctcctaagagttttatagttttagctctcacagttaggtctttgatgcattatgagtgaattttcatatttgttgtgaggtagggggtccagctttagtctttggcatgtggatatatccttgtctcaacaccatttgttgatgtgtgtttgttgttagctctcttatcccccctacacacacaccattaataaagaacttgggtaccactgtcatagtgttttaatttaaatgttttttcttcttaattaaaatgtaacataattatttataaaatttatttgaaaatttatttagaaatctagaaaagttaaaacccaatctaagtactcaaaaataatcattaatagggaattgcacttccttctagttttttatccccttgcacttaatataactaagataattttgcccattacattttatattctggattttctttatttcctttcaaaagcatttctatgtaagtcaccaatatttgtaagcatccatcttaatgattgcaatatgttccatctggtgctactaccttctcttgtttaatccatcctattaccagagcattactgctcacagataaatcgtggagctctggcaccacccctgctcaagttgaggttctggttcatctacagtccacgttgtatgacactggttgtgtacctcaacctcaagattccgtggtttcctcatctacgagatgtgggaagcgcaggactctttcacagggagtcgtgtttaacattcgatgagcactctacaaagaacatgggacagcccacagcatgtaaagtctcactaaatgctgactcttcttattgattgaaatttttcattatctaaaattttggtgtaaataatgctacaataaacacatatattgattattttcttaataacagaatttcagtgaaaaaaataaaagtatgtacatttgggtgctctttacatattgccaaaaacctgtccagaaatcatttaatacttatattcattttaatttataccatttatttttactttttattatggaaaaatggcaaacatatgctgtaggacagggaagagtttaagaactcccattcaccggttatctaacttcaacagttacaaactcatgatcatttttatttcatcggtacactcacctcctatcctcctcctttattattttgaagaaaatctcagatataatactatttcatctacaaatattacatcgtatattgctaaaagataagcactcatgataaacacgtagccacaggatcattattataataaaagtataataatttttgaaataattgctcagtgttcaaatttccagttgttttatttttatttaatttgtttgattttatctaaattaattacagcttggatgatttctggataatttctagactattcattacccaggactggtctttctgtttgttctaattccaaatctaattctactactattattaaaaccagctactgttcattgagttcctactatgtgctgtgcttttacgtactttcttccaatcctttcacccatcccaagactgaattcatcctgatttatatttgagtaatgtgagattgaatgggatcctgtgattgcaggacatgtgtagattcaggttttatctccaagtctacaggccccatggaggctcagagacgcaccttccagtaccatcccatttccagctccttctcctacttcatgtcacccatcaatgccctgtcaatacggagatcctcttgcaggtctcaggaggctctgctctcagagacatccagctctggaaaatattgtctctgtcgctaacacatcaagcccaaggttaacttccattggtccactggcaatttgttttgttttgtttttgtttgttgttttgttttgttttgtttgacagagtctcactctgtcacccaggctggagtgcaatggcgcaatctcagctcactgcaactcacgcctcctgggttcaagtgattctcctgtcttggcctccccagtagctggtattacaagcacctgccaacacacccagctaatttttgtatttttagtagaaatggggttttgccatgttggtcaggctggcccgaactcctgacctcgggtgatccacctacctcggcctcccaatgtgttgggattacaggtgtgagccactgtgcctggcccaggtgtttgttttttttaaaatatgtgtcttaccatctcagaatctagttagcataggttcttccaccaagtggatgctcaaggggtgttgttgatagtggctcggtggccttggagaatcatcatggtcactagaaatcacttgcaagttaaatatctttatcctttttggccagtggttttagatgctcagataactcaacccatctgatcaaaagcttaaactcttagattataaagtacaagaaactgaaagaataatagagtccagctgtattgctgaatttagctttatgataaaacagacaatatttaaatattaaaaataactagaactggggctggaggaagagtgacaacagaaatttggtttgacatttctaattacaaaatgcttttcattttcaatttattgtcttaagtataaagaaaaaagtaatatcctgtatatgcccatatctatgttattcctaacagaatgctctgaattttacttccatttaagcacacacacaaatatcaaataaaagtcctttattttgttaactaggaggcagtagctcaaaatgcagaccaaatatccctgagtaaatttactcaaggaaaattcttgaatcaagctgatgataaccagaattctcactgtcacagatgtctgctgcatatttttataaacaggagtaccaaggttgtaacctgcatgataaatgcaaaacactttctctgaacctttagtaaaaatgaactagtattctcaatctgctaggcaatatgcataaatatgcaactttaattttttggcactattacagactgttacagaattttcacaaggtggaacacatttgcaatagaattaggaagaaaaagccaggtattattatattgtaggtgccactaactcaatcagagactttcatggggaatttggaacattccatatgccatttagggcaaagggaaattaatcatgccaatatgggtttatgtttactgtgcagtttttatggcagaggtttgctgcctgatctaaggtgtgctgccctatgaaagagccttccccacacactctgttactgtatagagataaaatttaaagtgaactcaagagcagccttgatctaaggagagtatctcagcatttggacagatgaacatttaataaatgaatatattgtataaagtctattgggatggattcaggttaatttctcttctaacactctgtaagttcaaactgtacttggcaactctcttaagtgctttacatacatcagatcatatacatcagagaaatactgatgaggtaggtgttatgattcccattcatcagataagaaaacattctccacaaagttcattatcttgcctgggaccacatggccggcatgaaaccaagtgagactcagatccagtgctgagtcactcagtgctagttccactacactaacatggtaacagttggtgtgctagagcattcttcaaggaggctgggtgatttacatatcccactaaatgaattttatcagtttttagatcccgtatttcttcctggtggtggcagatctccattcagtgtgttatgctagagggattgtttcccataggaaagcctatttacccaagtcttggctatattttggaactgagtaccaatgcctacacagctaaaaaaatgagtttaagagttggagacctatgtcttttctactttgtccataaatttcttatttgctgttttcgttgttcttcatgatttaccaacatcatagagaattactgctgctcaccccaatgtcttgctctgtatttagagaccatccacaatctccctgagataccagagaagaacacaaactagaactgtcaggttctcagttttgggagtaagatggtgccagtgtatttctctatgcactatgctggaggcagagacatgttatctttgcttctcaggaaattagccaggcaagtggtcattattttgcagatgtatgtagagctggacttaaaccacaggaggaaaacctgagctttcttttctggctatgcaaccctgttcaaggtttgtaacctatgagagcattaagtttttcatttgtaaattaagaatagtgacttctgccacttcaaaattattgtggggaacatgttgtctgatgcatgtattactcctcacacagtgcccagtgcataggaaacgagaaagcagctaaggttagcttgaacaatggatctaaaggtttcaatgtgtgctctcccctcttatattttgcagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggtgagtgtgatggcatgatacccagcggagtctcagcctgggctggagggacggtgcatgccctccagaactctgcataatttcaacctcaagttggtcccatctgggaagcttatttccagacttccagccaaatccttgattattctttacctttatgagatgcaattggtattcagggccagtgtcaattcactgctgaagtctcaaatgcattgactttaatttgcctcaactgaatagcagtaattctttattatttattctgtgctggaatccattaagtgcaaaggagaacatcataagcatatccgaatttcagaaggacacttgccacatgtattttgtcatctttgcttcagtcttctttactgagggctgttaaaacaatgagcatacatgcaggctgtattaatagaaggcaattgtccaggtcttagagagaagtagttagtatatgagtcataaccttggggaataggtggcttgcttctgggaatcaaatttctttttttcaggctttttttttaaagataatgacaaattgtggcatttgctattttgaaacagaaagatttggggcattttatttgacaaaactatagtactattgtttcacaaatcaaaatgctatcacttcctttatttttataattactcctacttgatacaaaattcacaaaaatacagggcaatattttcctaatgctaaataaaaggattattttttaaattttatttattatttaagcttcaagactagtgataaggtcaatatcatagtatctgaggaagggatcatttttcaatttgcatggtatctaataggttctagtgcctaaattgcccattattaatttaagcagtaggtgagaatcagatttttggaaagcatttggacaaaatgtaatacgagaagttgagagtgataagcaaggtggaatacacttcatgcaaggaatggtgaacgacaccacttaggatggctactgcgagttaaaattttcttctgatactgcttaattccaccctgcaaggatgactattcttgatatagtcatggcaggaacactattagatcaaaaacttatggggtagaacatacaacagtatgatataaaaaacactgtcctgtgatcaagaatacaactttcttccctttgtcatctgctggtatcataagatggggctgggccttggcagattctgcccaagccatgccactgagtttctgcacggacagtggtggaacctagcagaaaggaagcctggagtgtgccccatacacagagtcctctccaggccttatgaggaaactctaaattattatcttgctttattttttctttggtttattcctctttgattcatcttgctttccagctatttacagcatcaaaaaccatgaatgatgaatgggtgtaaagaaatgatcaaatgctgaatcaggcatgaagtgaaataatgatgatggaccacatgatgttaacaggtgtccttctttctaagataaaaatagaagggaaggaaaatagacagaaatagagactaggatgacaatggctcattctaagcccatctggacttgaagaatccacaagagagagggggaaacactatgggtaattagatctgtttatcaatagccctttatgtgattatgattaggaccattctatcaacatagcaggtcttagactctgcccatcagggctttgtgagggtgataaagctgactgaggacactgaggcatggagaagttcagtaggtgggcgtgccaacgaggtaatctatggcacagtggggaccagaatgcaggtttcccaatagtcagccagcagcctccgttctaaacaatatcatcctctaatgatgtcattggaccatagtaagatggttggttacaaccaatgcgagattttttccaaagcatcttttgggtatagttccataggcacaattgtacctgtcaggccatgcctagggaaatacagctgccatgaagacagacagtgcataatgaatataattgtatcaaattgcacacacatatacacacacacacacacaaatatatataactctatactgagcactattttaattaatccacacaacatttacttctcatcacaaccctgtttgattgatttattgtagaaactgaggcacttcaaaatctcacagcaagtaagaagcagagctggattcaccctcccttcctcagtctggtggcatattctgtattcttaaccacaagggctaaactaagagtgtttttaaaatgcacaatgttttaaataatgtgaatctatttcattgagaaagcattcttgaattctaccctgcccctatctttttacatcctgaggtcttactctattaaaagctgcctgatcccataggcatctgcatgttttaaagtcctggctacatgcaggaatcaagaaggtacttgtgccttgtttgtatgattgtttaagtttaggtctcagggcatgtgtgaaagttcaggtatgagtcctgagccaaatatgagtgaccatggcctgtgacacagtcctcaggaggtcctgagaacatgcgcccaaggtggtcaaggtacagcttggttttatatattttatatattttagttagctcaggctaactcatgggagatggatgtccaggacattgttgttaatagagtgtccgccttccccactccagcttggaacacccccaccacaccttgctccagggaacccatagcagtaggtagtgggaaagataccctgatttagaatcctggacatctcttgccatctccttatactgcagagatacaactaagatatgtgctcaatcattcattttttattaactctgtgggtaattactagtcaaactgcacagtatcaggaactgtgaagataagaaaagaaatgcaggactaagtgctgtctaaaggagataaggaatgagagactaaaaaatctgccttcaactttttgaaaggcaatctagatagaggaagcagtcatgtttcccacatttctacagcaatctaactagaagggagactttgactaaattttaaaatgaatcttctaaaaattcagggattataacagtggaataaagtaccttgagtggtagtgaattctttgccattggaggtcctcaaataataatgcatgactatttgttggagaaaccataataactatcacaggagtagatgagaggaaaaaataataacctctgagtttcttcccaagtcttagattttgtgattctttattcccttcttgtgtagtcttacattaatatttctttctgttaaggcttcatttgcagactttgaaatgctgctttgaggaataaagaatcgatattcttacagcttgttcccagtatgtttgttctattaggccattgacctaattaccagagaatcatggggggtgagaattgcattataaagaactgggaatattttaatgtgactttgatacactgtcgtgaaaaaaaaatacctgtgaaaatactagtgggagttaaggtttattagaggttgcaaaaagatcagaaaaccacagggtttaaagggggaggttatttattatctgtgagagtttttatgataagattgattcaaacctccctgagaagaactgagagtcttctgttagtctagctgtcttaacctttgtgactgaagatagccttgggaatctggtggaaattataagagggccactcttacagggagcccattttgctttctccaaataaaatcaagtatccgcctccaggttgtgcacaatggctctaattttagcactctgggttaagaagtcagcaggtggagtaaggtggatgagttgcataaacactgcacacaattctcagcttgcaaatttatttaatatagttgaacgggccagaggaaagaagatcaacgtgattcaaagtcatggttataagtctctccctggcaggggtttgattttccagggttggaattcttctgtgccctttatcattattcttgaaatttctccaactagagaatcattctggttaaactgctgctatcttttcaaaggaaaacaggtacttcttcctaaacaaaaagaaattagtttaatttctggaatggaagaacagaggcagaaagagagacattttgaggtcacagagttgttaggaaagagaaggcagttttagttctataacctagggctgtggccacagacaacttctctgagtctggacggttggaggagaaagggtcttgaagacaggaaaagggtacagaaagggagatgagctcattctcaagatacacaggactttcacagaattttatttagtgatggctttgccttctccacagtagtggggatttctctttcaaatttgcaactcagaaaatattcatggggcacttaccatgtggcagatactagctcatgtactgaagagacaaagacagatagaaaggatccttccctggctttaagaaatctaactggccaggcgcggtggctcacacctgtaatcccagcactttgggaggccgaggctggcagatcacgaggtcaggagatcgagatcatcctggctaacacggtgaaaactcatctctacaaaaaattagccaggcatggtggcgggtgcctttagtcccagctactcgggaggctgaggcaggagaatgatgtgaacccgggaggtggagcttgcagtgagccgagatcacgccactgcactccaggctgggcgacagagcaagactccttcaaaaaaaaaaaaaaagaagtctagttatgggacagaaacatagttaaaaaaacgaatgtcatcgatgctaggtagaagtctgttctaggtagaatgagttaaagatgatcaattctctctgggagagaaggtcagaaaaggcttcctagagagggtgatgcttgagttggtcatgaaagataaattagtgttctccagcagacattatattttttcacgaaaataaagattatttttgattgttcctcattttctccattttattcacattgcagttgaaatctatatatgtgttatgatcaatttctgtttctattcttccatcatcttctttgttgatagaaatgcaaagtcaaatttagaatatgcactaactctagggctatccatctatggtgaaatcctttgggtacacaatccaaatatggttcccagatcaccttctggggaggctgtgcagctgccctccagcaccaaatggtttgtctgactttgcttcaggatttcctttttatcaatctttttttaagcatatgcattcaaaagatgcactgtctgcatttgtgattgcacacaccttggaaggaataatgatgaactgcgacattttatattttgagcacactaactcaagggaggcaagaataagaaggaagccagggagggagcattttcaaaacacaaaactcggcagtggctagccagggctgggttgaccttagaacatcccctgccattcctgctatcttatggaagcccttcaaagtgtaatgctgcctccacatagcccctccctgacaccagcatatgcttgatttcctcagagcagcaagaatcctgataaacagaaggggaaaagcaagccttggaaggattattttgacagcataactaagccctgaccacttcagtctctgggcttgtgtcaagtaacactttgctgattttgaatttaaaattcccagtagtcttttgctatctcccagactttgttttagttgtttcattccctacatttctgtgctttccaacaatctcttgtactttcatcatccatttcacagtaatgaggttatgagacactgtgacctctagagggcgataaagagtcctcctggtcactttctcctagggaaggtcaatggatgataagggcaggacagagggcacttccattatcacagggttagacttgggtggtaagggtgggcctgactggagaaacagtggcatgcttagtagcactggatctggttaatctttcttgtttctcttctctttgttgttgtttatgctttattttctgatatgctcctaagtcccaagaagattgctatgaactgagttgtgaaccacccccttcccaaaatccatgaccctcagtgtagctgtatttggagtaacagggtaattaggttaaatgaaattataagatcggagccctaatccgacaggattagtgtccttaaagcaggagacactagagaactctgtctcctgctctctctttgaatgccatgtgaggacactgagaaggcggccatccacaagccaggaaaagagccctcaacagggaccgagtcagccagcacttgtgtttgtatttcccagcctccagaagtttgagaaaataaattgtgttgtctgagtcactcactcagtctatgacattttattgtagccaactgagccaactttgcaactcattgacaaaggtcaaatgagatgatgcaagtaactatgctgtgtagattgtaaactataaaacacactttatttccttattggtaaaagtaataatatgaatgatctgcatcctggggttatcagagcatgaatgtgaaggctagaatttggggaatttggggttaaaaattaatactcctctttgtatgaaatactctttgtatgaaatactcttaaaaattaatactcctctttgtatgaaatactcctctttgtaatgaaaatgtgcagtgcgtagaggcagaacacttgggcctggaagggacattaccctgaagaaggagaaagataaggtacagggtgtcctcttgaaaaccggctgtctctagtcacaggaaacagattttaatatacacaagcatgaaaacgaaaccttttaagaatgactttctcaattgccccctgacacagaccttcagggaacttccctgatgtctctaaaatagagaggggtgtgtgtgtgtgtatatagagagagagctataataactaagaaacagagttatgtgtagaactaactaacaaagacttctgctcactgcagtgctagtccttgcacaatacacctggggcaacatagtcaaacacaaggaaactccccacctcaaccccaacaactttggctgtggagctagctgggcagcatgtgccagcatcaaagaaaatcaaaatagagacaatagcagcttctaagtcagtcctctaagaccctcagaaaagagctagtatggaaataaagccaacaaatatgtcaaaatacaatcaactctacaaacatctgtttaatacctactgtctcagtttgccagggctgccaaaacaaaataccacagactgaatgacataaacaacaacaatttattttctaacagttctagagactggaagtccaagttcaaggtactggcagtgttggcgtctgttgaggaccctgcctttgtgttggccacctttccctgtgtgctcacatgatctttcctcgtgaatgaggagaaagggagagagagacagaggggctttgctggtgtctcttcttataaggacactaatcctataggatgagaggcccaccctaataacttcatttaccctgaattactttgttagaggcctcctttccgaatacagccacactagagttagtcttcaacatatgaatcttgtggagacacaaacatttattctataatacctgccatgtgctagatgctgttccatgtgctcatggtagaaaaataagtatggtgtagttggcttcagaaagattcttggggttaagattaatatacaattcatctttgtaacgtcagtgtgaggcagagtaacttagcacatagttcacctctgattattcttggatttaattaatgtattttgaatctagtaggaggagaagttacatatacagtgagaggggaaatgccctatagaatccataagatgttataggatgacagtggggccatattggggaaagggggtagctcttcctggtgcatttcaaaagtcttctagtataaataggcatgaatatacattgcattaattgagttcttaatcatattctttttgagattctgtcctgccacctgtgatgtatgtgtgggaggcagggttgcttggggagtgggtctctgtagagctggcattctgtggctctacgttctcacagcctctgggtcttctcactttgtactttcccagtttaaacgactcttcagaaattttccaataattgagcaactgctggttttttcagcaatgctggttgcttacagctgtactgtgagaatcagaataattattatttgcccttatgatgcttcattgtttatagaaagaaaaaaggagtgcacaaagtgccttggttcttcatctgtaaatgtgggataatcttgttggtcaagggtctcacagccgtgtggtggggcattaatgagatcctgtctgtaaagggcttggagaaactcacttgaaagatgtggcataaatacaaagaagggttattacaaaacagaccaaagaacaggctagttactgaactacctttattttactttttttttttttttaagccagggataaagaaaatgggagattgaatgtttagcttttggactggaactctaattagaggtttaaggattaagaaaatagttggagtcagtgtgaagaagcttttctcagagaaaagacatgtttttattcttcttagagcacttgacctgtaaatacttacatcttgagatgtgaaacaaattcaatgaaaggcctgagctcagggcttattcggttctctgtgcagttaattaccttttgtccagcaaggaggccttgaattatcattatttctcctaattcaaagtcattgaagatatgtctccactgtaataagtagtttgacctctcgatgttaagaaataaggactctgactgtcggatgccctgttctaaatctgcagtggaaagatgggtcgggggatagtttccagccttaagaatccagttcaaattcctaacaccagccatatgccactgtctttgatctttcagctagaaaatatttcctagcagctaatacctatcaagtgctgagtatgtgccaaggcatagttttcgtagtttgcaaacattaattcatctcattctcacacaatgactatggagtcggtactagtatttccctattttacagacaaggaaattttggcctagaaaggttaaatgacttgtccaagaagacacagcaagggatcagtggggctggaaatcaaagcccattatatttactttttaacttataaactcttctgctttgttctctgacgtttcatggtactgtgtgtacttctctcaaggaacctgccatgtttttctggatgcttgctcaagcccccatccaggttgtattcttgtctaggaatgccacatttacttcctgtgcaccccaccaccacgtcttgcttgtagatcttcattcaagagaggggccaggcagaaataatggggtaatatatcaggagtgctaaaacaccactggaagatttagaaacacaatgccagtgaaggaacttgccacagatctcctgatatttagcaatttgtactttgatgcacaaggaagcacacaggactaacaagtcaagaaaaaaataccatgcctttattggtgtcagtttctgtaatgcaagtttcaggatgcagcaagagcctccagctccgatacccaccagccaaatcccacagccactgtcaactgaaatgctgtagtggaatagcacacaggggagtgctactttcttggaacaagtgattttaaagtattaatagggctccccaggattttttattttttggtcagaaaaattacatgtgataaatgtatgttctcatttaaacatgaagaatgaatgtgcagatttattatctctcccttcttaaactccttcaaaatgacataaagcaggccaggcacggtggctcatgcttgtaatctcagtacttcaggaggccgaggtcaggagttcgagaccagcctggccaacatggtgaaactccgtctctactaaaaatacaagaatttgtcgggcgtgatggtgcatgcctgtagtcccagctactcagaaggctgaggcagagtaatggcttgaacctgggaggcagacgttgcagcgagccaagattgcaccagggcactccagcctgggtgacagagagagacttggtccaaaaaaaaaaaaaaagacaaagcaatcaaataactttttattttattttagaagtaggaaactgaaaagacaaagacaacagaagggaatttagtatgagtgaaaaatatgaactcactgtgggaaattggagagcagataaaggaggaaggctgcctctgccccaatgtttgctgaacagttttcctgttcaggctaatatgcaagttctttttcacttccatcccaggcttattctttagcatatagaagttgaaccaaagattgtccaaagctgaaggcaaggtgaagatactgggctaaatacggaaataaaggactgtctgcacactgggctatgggatccctagccttattttgtggccctgttcccagagctcttatggtaagactttttttttttctctatactggagataagagtccttgaccatggaagaactgaacagccccatgaaaaacatgtgtgataactggaattatagaaatgtcccctcattgaaaaaaatactttacccatatgatcaccagacagtaaagcccatctactggcctgcgtagctccttcacttgggaacttcagtccaatttgtagtgcctcagtcataagtgtgaacaaataaccaaggctactcagtactttcaccagccttccaagacaaaagatgacaatgaaagcatacaaataaaggtaatggagaaacagaggtgatgcaagagacacaagaaacatcaacaacataatatcttcagctagataggataatatataaacccataaaacaataatatggtatttatttatttatttatttatttatttatttatttatttattaagaaacggagtctctctctcgcccaggctgcagtgcagtgccatgatcatagctcactgcagcctcaaactcctggactcaagggatcctcctgcttcagcctcctgcgtgtctgggaatatagctgcaagccactctgcccggctgggaacatgatctttaaaaaaaaacctggcaaacaatgagaaataacttttggaaatgtgatagagaaatttgttaaaaaatctagaaagatgggagataaaatctgagaaatctcctagcaagttgaataaaaattaaaaaagtgggcaatcaaaaacaaagaagaaaatcagagggtcaaaatgtaatgtccaatatctaatagtatttacagaaagagagaataaatgtggaggaggtgttagcaaagatataattgaaaatattttatagaataaaactgatgtaaaagtttgttctcttacccagcacagtgcatagaaaacggcacacacaaaggcaaaggcaaaatcctaaatctcctaaagatagatgaatcaggagtcagacagatatggaacttctgaagaaaaacactggccatttgcagatagtggaaaaacaccacagttctaagcggaaatggtttgcgaactggaatcctatgtttagtcaaattatcagtcatgtgtaatgtcgttattgaagacttcctaaatatctttcctgggactctacttgatatgcatgcattcattatctgatattgcataaaaactaccaccaaacttagcaccttaacgcaacacacatttatcaccttatatagttctgggagaggtcaggaatctcagcctggtttaactggatgattccagctcttggtgtctccgaggtcaaactgttgtcctgggcaaagagcttgataatctgcttccaagctccctcgtgtggctgttgacaggagatttcaggttcttgacaggctggttttttaatagcgctgcttaaacagcatgtcatctggcttccccagatacagtggagggcagggggaaagggtatagagggaggacacaggaggacagttaaaacagaaattaaagtcttttagaaccttaactggagaagggatgcctagtccaacctgggagagaattacacaagggtgtgaataccaggaggcagggattattggatgccatcatgaagattgcctgtcacaacgtggttcacccaattaaagaagtatataaaaaagaaagacatgagatccaggaaacagagaacccaccacagaacaggccaggtatttcgggatagcagctatgcagaaggcacagagaaaaaccagtctgggtcaatggttctcagctgggcatgctattgccctcccagatcctctgggagggtgcatttaacaatacacagagacatttttcattgtcaagatgggactgctacaggtatgcagtgagtgggagtgagggatgcggcaaaacatctgtaaaaccaggatagccccccgatgaagaattatttggtccagaatgttaagaattttaaagttgaggaaaccaaatctataggcgtagaatgagatacaagaaaacaggccatttggaaggaggatcctagaaaagtctgcaagtaacaaataccagctttatcacttgcatgcatatatcagacaaacaataaggactttgaaaaccaacctcaccaaaatggtgatagacctatacagaaagcatgacagggaatcttatgtgactgggtctcagaaagacagctccttatttacaaatgtgggtgggcaaaagattatatctaaaatggataaatcaagaaataacaacatatttagtaaaatagagttaaaaataagaagagtaatggaactaaaataactgcatgtgaggaggaaggcgagagggtggggcaacagctgctttcttatgttcagttattctatactatttgactttataaatgtattacttcgataaaaaattgaatgcttcaaataaatctattgttagattataaagaaagttgtttacagttttgttaaaagaaaattagtttttttccctaccaataaatatgtataaatatctaaaggatattggctgaagacacataagatgactatgtggacagtggcacacatgcccctttttgatgttttcagttaatgtagttattcaatgagtgaatgaaggaatgaatgaacaatgcatgatgaaataattaaattgaaaacaggtcaggcgcggtggctcatgcctgtaatcccatcactttaggaggcggggggggtggatcacctgaaatcaggagttcgagaccagcctggccaacatggaaaaaccccatctgtactaaaaatacaaaaagttagctgggcgtggtgtcaggcacctgtaatcccagctactcaggaggctgaggcaggagaatcgcttgaacccgggaggcagaggttgcagagagtcaaaattgtgccaccgcactccagcctgggcaaaaagaccaaacctccatctcaaaaaatatatatatatatattttttataatatatataaaatttatatttatatattatataatatataatttatatttatatattatataatatataatttatatttatatattatataatatataatttatatttatatattatataatatataatttatatttatatattatataatatataatttatatttatatattatataatatataaataatatatgtatttataatacataagtatatataaaacaaatgattctaccctttttttaatggtaaagcacattttatttaaatagttcatgctaaggctagtaagaagctcctcattgccagatctggttcaggccttaatctccatgagctacctagagcacacatatggaaaccaaaaataaaatttgaagtcccccaaccccccagtgatcagagtggaatccctcctttatggcagagcactccaaagttaacttcaagaactggtttaggccatgacaggaaaggggcggttggacatactgcattataccctccccacttttggaattcaggaaaagtcaactagcatttgacatcaacccagaccttaaatctcataagaaatatttgcaatctattctctctaaatccagccacctggaggcttcatctgcatgataaagctttggtttccacaacgtcttatcataactcagacattcctttctattgatattaactctttcaaacagtctgaaaaattgtagatctacctataacctggaagccccatctttgagttgtcttgcctttctggaccaaaccaatggttatcttaaatgtatatgattgatgtcccatatctccctaaaatgtataaaaccaagttgcaccccaatcaccttgggcccatgttctcagggtctcctgagggctgtgctgtgtcgtgatctatgatcactcatatttcactcagaataaatctcttcaaatattttacagagtttgacttttcattgacacatgcccttacaagagcattggagctttcttggccacttctcagtcttctggatgaacaccttgtcctgagcctaccctttaaatgttgactttttgtgtcagctctgggttttttttgctttttttgtttttgtttttgtttttttgtgatggagtcttgctctgtcgcccaggctggagtgcagtggtgtgatctcggctcactgcaagctccacctcctgggttcacgccattttcctgcctcagcctcccgagtagctgggactataggtgcccgccaccatgtccggttaatttttttgtatttttagtagagacagggtttcaccattttagccaggatggtctcgatctcctgacctcgtgatccacccaccttggcctcccaaaatgctgggattacaggcatgagccaccgtgcctggcctgttttttttttctttttttttctttttttgaagaaaagatataccctcactgagctaactcatccattcccatttccaaaacttcagctggttactgtatcctgatgaacccaaatctatatgcctagcttgggtagatctatttggccttaaaagaattgtctcaattacttacaggggcaactttacttggttgtcccctaggcctctaaaactcaacacttcacaaaatgaactcaagctctacctcaacacctccccaccactccaactcctcagctagatctgcttctgcttgattttttcttttttcagggaaatgttctacattcaccaaaatgtccatgtcagaaacaagcatcactcttcttttcctctttctcacccctctggagtccatcaaacaccacactttactgaatatacttatattgcatgtggcatagctgcttccacagtctctttaaatctattcaattctttatacaaagatagctttggctatctttgttctggccaccctaatcttggaattagattactgccacggagttcaaattcttctcccaacctctaggcctgtacccttttaattcattctccattctgaccagggtgatcttttaaaaattcaaatatattcatgtcacttattttttgatagcttcccattgcctgcaggttcacctctaaactctcctcaatcccaggctcttgttattctctgaagtttccttttttttttatgattcttacaccccactatactctctgtctatattaagttgtgctcagatgattggatgcatcatgttctgtccttcctctaggtctttgcacattttcttacctttgctcgaatcctctttttttttttttcctgcctccattccctccttgctggaaattctaatttctccaagttttggttccatgtcactttctctgggaagctttcctggtcccctcccaaagactgcattaagagcccttcaactgagctttctgtatcagtctattacagaaattgtcacaagcactgttcacttgtatccactgctatgatctgaattccaggactcagcactcctggcctagcacaatgtgggggcccagtgtctacaggcgataaatactccaccattgtggacaacttttcttagtgaaattgcttaagagcttcttttaaaaatagggcatttttttttcaagcaaaagatccttttttacaagcatatactaatggttcatcttcaaaagagttcactggcatatctttgttgtgcactaaagcacagtgaagaaagaaaaagaagaaattaaattggctaacaaccttgcttaaaagcacagaaataaaatgagagtaaaacttaaaaaagttgcagataataaaaatggattgcactcttcttcttatttctaattttgatagatatttttcttctcaaagggtctgagagaaaaatatcttaaaagggaggcaatttaaaacaggcaaaatattgcattaaaacaaagagaggggaaaaacgtgatcaagtcatcagctccgtaatgctaatactgttggttttcaggtgtttgaattgcccaccttaggtggggcctctaaaaagacaaatgagattagagatgaagtgcctgctagtctaaatgaaagcacaacaatgaaaatcaaagaaacagcacacttaattcccctctgacgttcctgatttccagctctccgtagcaataactaagtaagcctgggtgtccagcaacataggccatcgacatttgtcagaattttcaataaactggcaatgaaagactaaatccatgcaaggtgggagatgaattagcacatagccaaaggtactggaggaataagcactggtttcatagctgaaatattttttgataaagtaataatcctcggtaatctctctccagctttaaataacagccagtctttgtgccggcagtttaattttgttggctgcccttgtcttacaaatatatttagtggagtctggaatatcattttgtgctgaaagctgaaggctttgtcatgctgaagccaggcagaggcaataaatcaaggacaaagtgaaaaggaatagaaatgggctatcggaaacttatttccccagagcggccgagctttcgtctcatgctagcaggtgtattgcatcagtcatgtcttcctgttaagtgcctatgttgtaatgatattgacttacaactacattgcaccctggttggcattgctccgaagtgcttaagatgcatctatgggaaatacatgctgaaaatagcgtcatgaaaatatacaactccagttttcttttctttcttttttttttcttttcctcctctaagatcattcttcccaggaaatgggatttaggtaacttccccaagtcacaccatttgtacatggaaaggtgtataactgaataattttatcctccagtaagaactgtgctgggacacgatattcaacttcagcttcttccactaatttcctcatttgtgtctaatcaattaataaatgacgttttaaaggtaagggaccactataaacttaaaatgatgaaaccaggactaatgttcttcaagatctgtgtttgccaaattggtcattactgagaatggattgtggagaaagaatatttaagtgtttataggggtctgtgtcttaccgttagcaatataaatgaataaaaatcactatactaggaagccggggagctgggttcttgtattagttttctattgttgagtaatacttctacaaatgtgctggattagaagagcaaacgtttcttatctcacagttcccttgggtcaagagtccaatcaccatttgtctgtgtgctctattcaggggctcacaggctacaatcaaggtatcagctgggatgtggtctcatcagaggctcccctgggaaaagttctgtttccaagctccattaggttgttggaagaactcagtttcttgtagttttggttcctattttctttctgggctgccatccagtctctgttcccacctcccaaaggccacgaaagttccttgtggcactccctattggccttgcagcttactttttttttttttttttttttgagacagagtctcgcttttgttgcccaggctggagtgcaatggcacaacctcagctcactgcaacctccatctctggggttcaagtgattcttctgcctcagcctgctgagtagctgggattacaggtgcccactgccacacctggctaatttttgtatttttaatagagaagaggtttcaccatgttggtcaggctggtcttgaactcctgacctcaggtgatccacccgcctcagcctcccaaagtgccaggattacaagcatgagccaccgtgcatggctgcagcttgcttttttaagccagcaaaagaaagcaaatatatgtatgtatggatgagtcttttaatgtaattacagagaggatattctatcacttttgcaatgtaatgtaacctaatcatgcgaatgatatcacatcatcgttgccatattctatgtgtttaaagcaagtcacaagtctcaactacactcagaagttggggttctatgtggggtgtaaacatgagggccaccctagggtgtttctcccacataagtagtccttattattattaaaaactagatactcatatatttgctgtaagcagcaagaatgaatgacttatattaacactaaacaaaattgataaatctcacaaagttaatgttgaaaaaaacagacttaagaaaggcacattctctatacattcattttatataaatttttaaaacatgctaaattaatctgtgctcttagaataatgttaactttggaggtagggagaatgagggaatgcaaggggatttatacggtgatagaatgttctgtctcctaaagtagatgcattccatttgtaaaagcatatggagcatggagtattatatttatttgcacttttatagacataagtacaattattccttatacttcaaaaaaaaagtaaaacaacacaacacacaaaaaaaaacaaaagccctgagttaacttagaatagatgcttaatttctctggctctcagttttctaatctataccatgaggttggtcttgatgatgtttaagtctattctaacagattatagctagagttgtataaagtcttgagaggctataaaactcattggatgattctgaagagctcaggagtcatcgtgtcccagcacagttcttactggaggataaaattattcagttacacgtctttccatgtacaaatagtgtgacttgaggaagttacctaacccccaatgcacttttgttttcttgaggccttattcagctcaaaacatatctatactctactaatttggcaacaccttctgactaggcacctatgttataaccagggtggagagcaggcagtggtgggtgaatctggcctgggggtaaataaaaaggaggtgcattgcagataattttaaaacaataataaaactgagtgcaaatgggccggtcttgtgttaccaccatgtaactgcctttctagacaacgttagccaccgacacattctcacacactgcagcggacagttccaccactgccccgtgttttcacttggcaattgtgctaaactcatataaagcactggctgcagatatagctaagatgtgacactctatgctgggatatatgacatggaagctgagggatatgtgcacacccacctaacagtgcgttcacaccaagaccctcttcaaagagaggtctggatattcagaaacatactatattttagcctcacttgtccctcagcttcctcctccaagccccactgagcaaccatgatccctggaagtattaggtaactggctcccagaattgcttgcttgaggccaagagttcaagaccagcctgggaaacaaagagagacccccgcctttacaaaaataaaaataaaataagcttggcatggtgacatgtgactgtaggttgtcccagctacttgggaggcagaggtgagaggatgacttgagcccaaggggggtttgcatggctacagtgaggtacaattgcactactgcactccattctggacaacagtatgagaacctgtctcttaaaaaaaatacatctccaatttagtacctcttgattatcccttcacttatagcttcaagacaaattctgaatccaagcactgctgaccacctcacccctgcaggctgccatctcctcccccactttccactccatccgctcctgtagccacaagcctcttcccaggccccctgccctctcctctggactgcagtagtctcttctccatagggcacccagagctatccattcacagcatgagagaccaactgcatttctcctctcaaacctggatctagcaggcagtacacaatctggcccttaaagttgatcccagacttttttcacctactgtcataggcctggctcatcgaccttctcattatttctaggatgtgcccagcaggccactgttttgggttttacactaactttctctatgtgcaaacccatttagctcagtttcatgtagatcccttgtctgggccctacatgtcaccttgtctggcagtctttccctgaccacaggctgccatttgaggaacccaaggagtggggcttatagagaccatgccatctccaaatcagccccaaccttcactctctgccttctacttggcttggtgtttcttcatcagcttgttatctggaattatattcttaatttatttgtttgttgcctgtcatccaaaccttaatgtaagctttggagggcacagatgttgtcctttgtagctaggatggagtttagcacagagtagatattcactacagtattcagttgactgaatgattgaaagtctggtttagcttttacattagtcatattgaattttcactaccacttaggactcctatttctgtttggtaaaatttttccagcaaataacatggcagtatgggtcggtttgaccccatgacctgagctttgttgggaattttaatcatctgtcatcataatttcatcaaaattttcttataaaaaatgagtaaacaactggtgatgctgttaatggagcacctacatgaaagcaacgttcaggccactgtgaaattaacattatcttcaaataatagttggtcagtggagcctgctgggctgagatgtgtttgaatgatttcatcctttagcttcagggctgaaattaagaaccaggttagaccactcaaagttaaaggaaagaaacaagagcagaagggaaaggaggtccaggaagccagaacaccaaaaactgtaagaaaaaacagacattgagaaatagagagtctgggacaaaagaataaaagcagagaaaatatccaggcctcgatgccatatgtccctcaggctttcccatcagctgctcagttactgtgtgtctctttcttaaagtttcttcccttggaccccatgctttctccatgtaggctctgccttacttcctgttgcagcattttagcctggttggtgaaattgcatatcaacttaaggctctagagccacacagctatttgatttgcagaacaacatgtaagggagaagattctctcccttgcagaaatgggccagacctggacaaacaaatagaacttccatgagtgtgcattgttttttctttccttactctggtcttactacacacccagagtcaagctgttatctattgtaagttatattaagcctttagtctgtttttttgtttgccgggaaggtagatgtgatgtcaaacatttgaggcattttgaaagtctcagaatattaggagattttatcatcataataattggggattgaatccatttacagtaaatgtcccagtactactggcccattctatcacacattgagagaatgatggttttccactccataatgatatctaaaccacaatttgatctgtgacccagaagaagggacctgctctccctcaccagttgcttcctaatccctctcctcaggtgaggtggaaaggaaggggaaaaaaaaaacaataaaaatgcagcgaatttaggagaaatagaagaaggaaatgacacaaaggaaaggggggggagaaagaaagcaaaagagaagcaaacattaaataggtacaatccaaaaatcctatcagtggagttcttgtatcagtggagttcttgagttgatgggcttctagtttcaattatttgtaatcttctcttaaatatggtagtccctcatatttattcaacaagtcattatgcgcattatctctttggatctgtataccatgcctgtattaatctgatttgctgtcatagctgacaaatcccaaatctcagtagcttgtaataatattatatgccacttactttcacattatatctcactggctgtgggttagcttctgtgattttgttccatgcagtttttcattcaaagcccccggttgaagcaataactctatttaggattttctatttctcaagatagaagaaaagagtgaacaaacttgtggaaatatgcagtggttctcacagtttgtgctcacaggctctttgtcaaaggaagttggagggttattcccaacatcgccaggcaggaaaccatgcagttcccacaaggtatggccggtctcatggccataagccagggtgtgtaattaccttttataggaaaagtaaatatgtatctgggaacaataatacaacctacattaataccagagtaagttaataaggcttgtgggcccactccacttaccgataagaaaagagagggacagaaaactaaggagaaaaagagcctgacctagatctcaggttatgtaatttccagataattgatatggcctttctatccactttctttccctcccctacttgcattttcttttacactaaggtagcactgctcaaacggcagcaggcaccagaatcacctgaaagactccttgaaacacagatgactggaactcactttcagaatttctgatttgttatgtctggcatagggctttttaaaaaagttttctttttaagcaagttcctagctagtgttgaggatgttgatcctgggaccacactttgaaaaccaccgctttaaggtccatctccagagtagagtgcaatgtacaactgttccaattacctattttttttagcctttttgtagaataagtgaacagcgacttcagtgaattggttctgtaactttaacagctccactcgatcttaggagaggctatagcagccccacagtagtagctctccaagtgtgatccctggacctacagtaccagcattgcctgggtatgtgttggaaatgcacatcattgactctgctccagaactactgactcccaatttctggggatggggcaaagccctctgtgttttacgcagtcctccagatgattctgatgtatgctcaattttgagaaatgtggtttggtcctacagctagactgcaacaccatggtgaggtcttcaggacttgtttgctacatgcctgctgcttgctagaaatgaaagctctcaggtcccatcctatatttactgactgatcttcatgttgtggggtttcttcttgcagagcccctagtctctgccacattacccagccatttagtccatttattacaactgactgtctgcttgactttcagttataattttacccctgaatgatccttggttctgtgctctgtagcctcaggacttatattcctgctcatttccctggccaatattagaaccttactccaggtgtagcttatcagccctcttggaagggggttggtgtgaggatgcttagacagggttgatgtgagagcctctatttctcatgatttgtatttttccattaaaattcttcaccttccttcattacaaccttgtcttaactcttgccctcattctttgagactagctttatggacaattttaaccagtgtattaaaaacataattacagtcatactattgtgtatttatgaaacacaaatcatctaatcagctgattgcctttgcatgagttgttcatgagaaaacatgatgcaattaccagtccccttccaacgagatgtactattgccattttaaaaaagcatttctacatccagaagtcatttagtcttttctttaaataaagtaaaaaaacaaggctgcagacaatgaaatgagagaaacagatcgacatctctaatgattctaggcaaactctgagtcatttcacttcagatctgtgatgtttatacagcaaatgcagatgttatgtttactcactgcagagcatttcctgaaagtcttggcttgcatggaaaactttcatggggtattcttttagacagtgtatgtcttgctagctgagaaaaattttaaagaaaaaaaacttgacctcagaggatattgacgtagaggtatctgaggttaaaatgtcagaaggaagacctttgggaacatgtgaatatttcccgagtcccaactctaccaatgtgtgaccatcatcactgaaatttggtcatatggaggtgcataaggcatgtttcttgtcttcaacgagctcatagtcttgcaaaatacaaacaacacagagaaaaaatgaaatgttttatcataaatgctgtgattagtgcaaccaataatttatcaccaaagcaggcattcacacaacaggtatactttgtagctgttcctggcacaccgcttatatggtcactctagttacagttgataagtgcagatatgaagtaggcttagaacggacatttccttgtgggatgattctgggaaagctacctaagacaccagatctagtgcttattgaactaatatttcattgtcctgttgatctttagagccattcactatatatttacaaactatcgtgttggatgtcgagatctctttctaaagccaaaccattatcaaatgctttgtctccttttcttaccattcacacatttcacctttcaaagaccgtcaccacaccagctccatgccctactggttacgtacagaaagagtaacagactaaggttgacaagcatctgtttaaccttgattttattgcaaaccagccatgacacattctactaatcagtaaacatctacaaacatgagaaggacatcatcagtgtccctgctcacattgttctttggtgcccttatcacactaaagagttgtacaggcagacctatggatgagtcaccactctgacacctcaccagttaggtgaccttagagaagtccctgaacacttctgaaccacaggatgcccatttgtaatagccacagaaccatggagggcattgtatagactgagcacagtatatgtgaaatgccaagcaagtttctgctgccaagtaggtatctggtgcatggtgatgagttgctgtcattattctcactgatgcagttgctaactgcaacatagggctggccatgagtgacagttctgattttttttttctttttttttttttgagacggagttttactcttgtttcccaggctgaagtgcaatggcgggatctcggctcacttcagcctctgcctcctggttcaagcgattctccttcctcagcctcccaagtagctgggattacagatgcataccaccatgccaggctaatttttgtatttttagtagagatgggttttcgtcatgttggccaggctggtcttgaactcttgaccttaggtgatctgccctcctcggcttcccaaaattctgggattacaggcatgagctaccatgcctggcccttatgttcttttagatgagtgaccatgctctttcccaaagccatctggggagtcatcctccctttttaccatcttcgcatgttattttcaattttcatactaacatgtcagaaccagtttgctgcttattcctctgctgtactttcaaacagaaaatagcatgttgttggcaggttctgactgtttgattaaaagaaataaacaaaaatctgtgatgaaacagttcactatgatgtttaatccatcgtgtccatggaaaggggttcattagccagaatctcactctgaaggatgcccaaagctaagagatcaggggaggcttcactcagtaatggcatctggtgaaggttagcatgaaaaaaaatccatggtttgtcaattacttaagtaatatcttgtcccagcatggtgatgctcatggcaactcccattgattggttttgactgctcttggaataatactggagccactttgctcccagctggaagcagagcacgatcagtagtgtctgcctggggtagtaaaacaagaaacagaaggcttctcttaatgtcctaccagtcctaatctgtaaactaattgcaggactaattcctacaggactgtcacacaagcaaagattttatgccttatttattaatttatacacgttccaatccatcttgtactcctggatttagcatactcttacaagctttcagaaatgaaacaaagattagttgacattcatattcttttcagtccacccttttattcctcctaaaaacggtagacttctattcatattacaaatatttcaactacttacatattcttaactattgtaaaaataagagaatggtcaatgaagaggacaatagaaaaacctgataattattagataaattgagataactattttaactatatatactgagagtgtttggtaaatataccgcattctgctatggtctatctacactctattttcttgtatacaaggcatagtgtatgtatgcctcttacctttaataaggataacaaatttactttcttaaagtaattgaagaacagtaatttacctgtttccaatagtatttattttttagatttttatcatctccaatgaatacttgcttgtgcccagggataagtgtgataacacaggggatgtttctatgtaattatttatctcaaagtcccatttaaactgactctccctcaagaaggtcccttacaataacaagacaaagctatgaacagcaccttagacagttgaccttaactatagaacacctcttatactgtgggtggagtgagagtgagtccctcacaaggcaggaagcagaatcttcagggtgagaaatgaatgcatcctaatggcactttcctgcttggataggaactcattcttaatcagaacagcttttgaaatgggaaacacttgtgggaggggaggattatactttagggcctggaaggggctgctgatcaaaagtctctttttattctggaatctggggagaaggcagaaatcatatactttatttttgtggaagacctgctgctgtactacaccaagcattcttgggatcggggcatgacgatgatcccatccaggatatccaggaacccctgaattacatcccatgctttgtatctgttggaatttcctatgaacagcacccatagcttgtattagaagctcacaagtgtctgtaactgtagaagattaagaaggctcaggagttattgtaactcattttggcttacttaataaaagtaaattatagagactgaaatatttctactggatatgcttgcattttagtatgctctgttttttatataacaaacataattgcataatgaaattaatatattagcctcaagtagtttttaaaaaaaaaactgaatcatttggatcttgagatcttactgagttattactacattaattattaaatatcaaaagaagtaccttagtttaagaaactttataaccatatttctaccatatttgaaacctttccaaagtatttgtcttgctgttttaattctaatttcctgggttccttgtgaaggtgaaagtctttggtaagtttcacagcctttcttagtgtcagattgggcccatagaggttcaaattttgattgagtaggcttaccattgggagagtgggatgttaagaaaactcagggatgagtgggaggtaaagagagaaggtggggaattagatgaagtgtggagcttccaggccagattcccagcccctccctggcccctgatcactttattctgggatgaagcccagaataagtttccctcttctcccctgtcttttgctccagggctacacagggtttgcaaagtgtggtctctggaccaacagaaggagcttcacttgtggactcattagaaatgcaaattctgatgctcccctccaacccctaccctctcacatctgcaaaactggaagctatggggtagggcccacctttcagtattttaacaaaccctctaggtgatcctcctatttgaaaatctgctattatagccagacactatttctgaaacacccctgagatagcgctcacctgagcagcaggtaaatgtgtaccttcccagacctcttcctgaagatcctgtttgattgcatctgtgatgagccccagaaaggctggttgtcaataagtaagtatctacgaaaatttttttcttttctttcttttttttcttgagacagggtcttgttctgccacccaggctggagaataccagtgcaatcagagcttactgcagctttaacctcccaagcccaagcgatccttccatttcagtctcttgagtcgctagggccacaggcctgcaacaccacacccacctaatattttttattatttccttagagacaggatctccctgtgttgctcaggctggtctcaaactcctgggttcaagtgatcatcttgtctcggcctcccaaagtactgagattatagatatgagccaccgcacctggcctacaaagattcttcccgctagaaaacattggcattaccaagcaagcttccccaccacatcctgtggcacactgtgtgctggtggcgagtcacaggggttttcaggatggattcccctcaaatctcactgaccaggtgggtctgggtcagttaaagtccttgtactggtcctctctgagcagccaagtcagtgcactccagtgtctctgcagatgtgatgaaaaaagtcatgagatcttctaaatctgatgttttgtcctccagcataacccacgtgaactgagacatccttcttctgtcatgttccttgatgagacttaacccacatgacagacagcagcgcctccatcttgaaccctggtgtcacagtatctgaggttagaggaaggaagtgaagacgaacatagtccacttacatatttttttgatttgtaaataaaatactactagttcagtgtttgtttcgtataatacattttccttttttatcgtaattaccaactaaatatgatgtagcttttcataagtagctctatgttaggctcataaacattaatgcttattgtatgccataatagagtaatacttaaggcaggtgagttcttttgtctgtgttctgtagtttctgtgttttcttcccccacttcccttgttgtctgttttcttggaccaaggctcttcgtatcctagaaactcttcaacttgctgcctctgatttttcctgttctgggtaaactggtagagtaaattgtttccaattcagctccaagctgctcttcctttgagttgctcccacttgcacccagtgtgccatggacagggatgtcagccttgagtgacaggaaaaatgttgtagtttgacagctgagtccactactgctgtaatcttgcaagaactatttaatctctcaaagactttttcaaaggttgtaaagtttgataataatgtctacttgttatttaaaaaatatggtattggccagacgcgttggctcacacctctaatctcagcactttgcgaggccgagacgggcggatcacgaggtcaggagatcaagaccatcctggttaacatggtgaaatctcatctctactaaatataagaaaaattagcctggcttggtggcaggcacctgtagtcccagttacttgggaggctgaggcaggagaatggcgtgaacctaggaggtggagcttgcagcaagctgagatcgtgccactgcactccagcctgggtgacagagtgagactccatctcaaaaaacaaaaaacaaaaataaaaatacataagttattaaggatgaatgcacagaataactaaaaccatgctttgccatatcgtaggttttcaaaatatttgaattcccttctcttcttagtcctatctaagctgtgtttgaatagttggattagcctgagaaatggcttctctataagtataaggcaaatatttgcttaacaaatgtttaccaaggacctactatatgccttgcagaccaatgcaagtgttggcaaaaaaaaaaaaaaaaaaaaaaaaaaaaaaaaaaaaatcaatcacttaaatcattaaagtaagttttgttcaaaagtcttactgaagactatagaatgaggactatagccccagagtggtccttcagagaagctgtcagacttctctgacacagtgtttcagcccacagcttacatatgggggtgggggttcagtaaatgcaaaatcacatcaaaattgctcacaagtgacatcaaaccagaatcacaccaaggttttggtgtaagagtacctctggtcatagattacaaaggcacaatcattaaccctatcagatgtcatcttatgtgcaagaaaaggcaagggctagggtcattcatactttaaggaatatagtgactcgggcaagagatgtggggggccatgtgccctatcctgttttgtcttcaaagtgtctggagagctatacatcattccagagtcaggggcttgtgaaattatgctggcaagctgaaaagggccaaaagggcttcttccctttgccattttgtctcacaagatcccccctttgatcataaatcaactgtctggttgcatttacagaaccagtatggattgttccacatagctaggaagactctttccttaggaaggtcggtgatcttcatttgtatttgtaaggaattgggcagcatgcttactttcctatttgttggaaagcatattttgaatatcttctattttttaactagcataatctgattttctttcctgacatttccctgcacctaacataacatctcaacaggactatacaaggatactagagattatacatagtggtatatacataatagcatcactatcagttacaaattagaaattaaaaaaaaaaattgataatcatgcaacaaaattggaacatgcatttgcatattttttcattaattgtactatgttttttcctttttagtatccatatttattattatttatgaaaaaatttgacctagagcttattataaatgtttttagagaatacttcaaaataatactgtggatgatgaaaactttgaatagccatgattaaaatatgatgaaagttcccagttgacaagaacatctagttatttctattatatgcagtatactaagataattagaatcatgactgacagtgccacatcagaaaaatcaaacttttataaagtttatgtagtctttagaatactcacattaataacatttataaaaatataattttagaaaagatttaacataatcaaaattatagctgataccatattagatttctatgaatttatatattttatgtgatttatagcaataacatacccataaatataatggaaagaggatctagattatttatcatttgataatattttctatacaatctacctaataagtctaatattttaatcaaaaagacttaatttagaattttgatctttgggaaaactgcaaaagatgtcaaaatgtttaaaatacttgatcaaaacagattcacagattattataaaataataattattcatttcactagagtcataacatggatgtaaaatacttaacccttttaagctcagttttcctagttaatcaaaaactgaataaagacaacacaggaattatcttaatagagtgtaaaatctttattgtgtaggccagctactaaaaacataaagaaaaacctcccatagtgtcattgcctttttttatgaaaagcccattcagataactgtcaaatctgatgaaaagagcccttgaattcaatcagacacaggaagagtgcgtccagggtcatgaatgtacactatataatagaggaatgtaaacacaaaactagtaccttgagcagagggaatacatggcttttagtaacaatataggaaatttcctggttacattgaacaattcagacatatcaagaaaagccaaggcacagaatcaagttatacttgagaaaaaaattgtttttctggaccttcaagataaacatttcagcctcaggtcacaacagcagagttagaactggagaaaaaaagttacaagaactgatgaaaaagttgaaagagagagttatcatctcagctaagcaaaaagttatatcttctcaaggagaaaaggaactgaaggcaattatgtataattcacaaatcaggtgcagtgaaataggcaaaagttaaacttttgagacataaatctgaaaagcttcaaaaagaaactgatttcagaattaaaaatcaaaacctcttgcaattgcagtaagagcaaatcagtatttttagataaccttatttttctaacataactgacaaaattttgttttgttttaatatattttaatatcaaagctcaatctttagaaagacaattatgaataatgttatttctattatagccaacttgatcatataaaacatatctttcatacattctcttttcacaactatatcatgacttacccagaccatttatgacatgcttgcactttctggtttgtccaataccttctcttttttaaataaccgctcattttactttaagacaacaatttatgtaagcttctttctcatacaagattaatatctttcctcttaccttccttaccaagaatacatcatcatatccattccattcatatacattcttcatatctttctttcctacttactggttcctttctatcttgtttcatgaataaccactgaattagataaaattgtcctttttctcaaaatgatgcatttttatgcttttcttatatttttccatcaaaaaaccatatttttgcatactttgtatatataattatatattaaaatattttaaattcttagtaaccttaaattttagtcaaaatctaggaagcaagatcttgaattgtctttcatatatcagtattttatatactaaaataatttcctaatttttagaaacatatttccttataacaaaatttttctctcaattgaaaatgacccaagtattgaatgattatctattatttaatttaacataactttaatatttaaaattacatgaaaagtttatttacaagtatttacctaatttattatttttaacagattgcctagattacttatgaaaactgacatattggacaaagctagtcatcatttaaatttatttccaagttgaccatttttacagcctgtgaatatcaagtgtttacctaagtaagaactttaaaattaaatacatgagtattttgatgatagctcagaaaattcggttgttttcattaaaccaacaatattaaattagtcttacttataaaaagaatacacacagatctttctgttttgggctgagtttgtagttttatgacattctaaaacctgccaccttaaaatatctagcagaggcaaatatagaactgtctcttcagtaaatccaggcaaaaatgtatgctgatgattctgaagacaattttatttttattttatccataatttttaaacaagcttatttattaaggattttcttaagtcacatgaactggaaaatatttaaacttactaattcatgagtgctcgtttatttatgcatctacttagtaccatatgacacaacatacagaataatacacatacatatgcaaacacttctcaacatatatacacacatagaaataaaaatattatagttttcatttcagaaatttagttatgagatagtaatataaactcactaatttaaacaagacaattagacctaaattatttccaacaaaattggaacctttttccatgactaaactttatttgacccaataggtaatctaatggaggctgtggaccaaaattttgggtaaagcattttccatgaaagtttttatttttagaaacttcttttaccttttttttccttcaattccaagtgagttaaaggataatacttcaatgattacattttagggagaacttgccaagttgtgtaagataaacaaaatctccagttactaatacagccttgaagtaataatgccgtaaacaatgagttttatctcaacaccagtagaatagacaacagattcaagtaggcagaaaaaataatagagaacttaaaagactctgcaggttaactctatagttgcgaattttttgagtaatgatcatttaagctctgaactttctttttctttttttttcttttcctttttttttttgagacagggtctgcctctgtcccccaggctggagagtggcacaatctcagttcactgcaacatccacctctcaggatcacaccatcctcccacatcagtctctcaaatagctgggattacagatggacaccaccactcccagctaatttttgaagtatttgtaaagatgaggttttgccatgttgcccaggctggtctcaaactcctgagctcaagagatctgccttccttggcctcccaaagtgttgagattgcaggcatgaaccacggaacctggacaaaaatttcccttcctaagaaacaaaagatctcatggaagaacttacccttttgtcaaggagtgtaaataactagctgaataaaactcagcattggcaacaaagtatgagatctgagactcaggagagacccacctagtcatctgcaaatgtggaggagatgcaggggctttaagggccatgctggtaccaaggctctgggtccccacaatgttccaaatggtccttatctgtatactatgggtttcttctgggacaccatgattgttgactaaagaaaatagaattaagctgtttagaaagttaaagttagttttattcagaagtcttactgaagactaaagattatggaatgaggacctcacctaggagcaatccttcagagaggttatcagatggctctgtaacagtgtttcaacccactgcttacatagaggtggtgagggttcagtacttcagtacatgcaaaaatcacatcaaacttgctcagaagttacatcaaagcagaatcacatcagggtttcaattcaagtgtagatctggttttagattacagaggcacaatcattaacttcatcagatactgtcttatgtgtaggaaaaggcaagagctaaggtcattcatattttaaggaatatattgactcaggtaagagatgtggtggggggcatgtgccctgtcctgttttattttcaaagcctctttctgaggagctgcacatcatcacagagttagggactttgtgaaattactctggcatgcagaaatgagtgaacactgcttcttatgtttgctactttgtctcacatgagaaatagaagataataacaaaggaagaaatgtaagcaatctactacattccaggcaccatgtataatcctttatgatagttactattagtattattccacatcatgaaattgaggaagagcagttttaaataaattgctgataaattggcagaaccaagattcgcaccagataccctgctcttaaatttgttttcttgaccactaattcacaaacttcaaatttgagtggttcattctaaagctgatgtctagtatctttaataataaaaaaccctctttgccccaacttacatatgcacaaatgatattttccttaaaaacaatgctttagacaattgattctgttatttcatcttaccagctgtactctctgaaaagtgaatttactgagcacaaatacccagggagaaatggctaattgtgccaccacgtttcctagccagctgttccacacagagagaagtagttcatgtttaaatatccaggctgtaatggggggtattgcagcagaaggcctctgcaagctgccagaacacatttcttgtttaatggcaatggagacaggggctggtgtggtgtgatctgtaagtaacaggacagtgagctcttttaaatcatgctaagggagctctaggcaaatcatactaagggagctctatagtcaagtgcactgtggcactgagggtgctgcttacctgtctgcagctgcatcctcaacaccttcctctatagtgtacttgctttaaagatacctttaaaatatttcacagtatatatatatatatatacttatcaaaggaagtttaaaaacaagtacatgcaaaaagaagaaataacaaatcacctttaaccccatcactaagatagataggctaagatttcattttgtatccagttctctagtgaccttggtaaagtcataaaatgtattgacccttggtttactcatctataaaatataaataataatatatattttgaaaggctattatgaggattaaataagataatgtaaagcacatatcacaatgcttaaaacagggatcataattaataatgacttttatctaactaccaatagatacttaaatgcaaatgtaatcaaactacacagttttagaattatcttcatttaataatatcgtgtaatatttccacattgctacatattggcaaacaaattgtattagattatgtagtttgttttcatctttctcattgttggacactcaggttaatttaaaattttgctacttcccttttccccaaatgttatgatcatttgcttactgctcagtcctttgggtctcaattattgccctgtgtaaattcctggacctgaacgactagatttaagtgtataaaaaaatccttttaaaatcttagatatccatttcaaactgccaggattgctgcagaacttgggaaaggtccatcctgacagcctctggccaagacccaagaatgcaggggcagttgcttggaagttaggaccctccagagtggcgacatccaggtccatgccagagagtttgacgtggtattaatgaagtctgaagcataaaatccaaccctggaatggcatttgacattaccccgtccccaggcatgatgttaagtgtcaggcttctggacaattactgtttgtaggatatctgttatatggtgtgcaagcctggaaaattacattattttttctaaatctaacaaattatctgtgaagtagacattagtatccttattttgcagccacggagcagagaggttagatgacttgtcaaaactcacgcagtaaagaatgaccacctcacttgctctcttctgacttactaaaaacaatacaaaaagattcacagagggcctgtatctcttgtcctagatcacacatactgttatcaacaagaagggcaccaataccctggcaaacatattgcctgttccagtcttttagttagattattcagaaaatatcagagagagagagaaaaggagatgggcatgctattagtagaccatggtaagaaactgcacctttattctgtggccaatggtaagtggcagaaggatttaaaaggcagagaaggtagaagggagaaagatcagacactggagaaaagataggatttccgaggggatagttttaggaaaaaaaatggctaaacacagattttagaaagttatttaccttggaaagctcatgaaagattctgaagttaatgaatggtttccaaaatgctttgtaaaactccacacaaatacagttgcatattattagtagtattagtcagaagctaatatgttaggacagatattgatatcataatgtcatctaaaaatataagtggtctctaaaatgaaattgttcctgccacagacagcttatcctcttacaggctttcattgtcaaatattcatgtcagttttgtagactgtttatagagggaggaattgggaatggtgatttggttttctgttttgcttttgattttctaggagaggattcctgggacacttactcatagtggctatcatgctccctcctgcccgtcctcaagaaagcatagtaacctcccagctctatgtgaatgtgtgctgtggtctatgggggtgcaagtggattgcagtgtgctgtatctgtaataggttccatctgtgctcttgagtgttctgctgatgaattctcactacatccatgggtaatatgccccgggttgttttaagattatttaactatcttcgtgagtgtcagtatataaatatgctcttgcccagagaggtcataatccccactgaacagtgattaattatacacatacctcgtgtttgtattgcagcttcccccagggagctcaaagcactttgcaaatatgaattgcgaataataaataatgcctttgatttctaagacacctatctctaaggtcttaagtttatgcctctctcagcattctactaggagcaaagccctcacaacccaagggcaagagtcagcacctctcatcttcccctgtgagaggggatcgtgaactattcacaggcctgattttaccagagtggaactgagtatgtgagggacaggaatgtataaaggcagggaaagtagaagggagagaaaccagacactggagaaaagataggattttccagagtatgactatcaaaaaaaaaaaaaggttaaatgcagattttagaaagttacttacctcaaaacactcagggaaaattccaaagttaaaacaatacagggtaggtggggcatgtgacactaagtgccatttagaaggaaaaatgtggctttctactaaatcttgactatgagaaatcctcattaatcaacaaaaagatgaggtaggagggaaggttcaaaacatggactacaactataattctcagttaatttgaagcaccttagtgagtaaattccaacattggcgaaaataattcatttcttttgctaccgaagatagttatccagataaaatgtatgtagatcagatggccctatttgtttcacagtttactctatttttagtccctcttttatccagggaaaggggtgggagagttatttgggtcattttttgcttgagcacagaactcaacagcaattaaattatcatcgagcaaaagtgatattttaggcacagttgtttacaaaacagtaaataaataagaaccactggttcctttctatataaacacgcttctcctaggaattcatccatttcagaatttccccttcactaggcagaaatttgaacttgagatgaggattaggcctttcagaattctttggctgctgcctacatagcaaattgtacacattcaattgatatcaattggtaatgagactagcactccaggccactgttttcagtgttcaaaaccacactgacttccttctaatttcctgttgtgcaaatggagctcttaaatgtggtgctgcattaatagaactcttttcagaatcattttaacaatgacaaaaataatgacacagaggatcaagcctaagctgactagtgatgatgatgataatgatgattcattaccttgattctttgtagaatgtctgcaaatgtagcttcagagggattaaaaaataataatcaagataataattgcaagaatagttaacatttaggaatattatgtgccagatactcttaaagtgcttaattcagcttcaaccttcacaatttaatgaagtagaagtagatactatgattatatacattttgcacatagggaggtgaaacactagaagaccattagatttttccaggctttcacaggtgatatctagaggccttgagatctgatccagattgcttagctcttaaacacgattctggcctgcctctcaaaaaacatgttgatgggcacacaggcttaagatttgaactgggccactatgtcatggagctctaccaggattctatctttgaaaggggtgtcttatgaaagaacatagtttttattattatgcgttttgactagtctttcagctggtgatctgggaagaagtaatctgaaggcaacattcctaacttactataaagcaatgtcttatctcatgcagctggctgcgaatcaaatagggtcacagtctacacaaaccccctattcataactcttagatctccatttccgctcttcacttctctccaaaattctggttccacatttgctgctgttggtttgccaactgtagcaaataatatttcacaaaaaaatagtggttaaattgattcttcccctgttgtgaaacttgcattttttttcttcctctattcttacttaaaacacttagtaaattccttatttccttaatgagattagtatttattaactaccatctgccatatatctttctttgataggtactgaagatacaaagatgaatcaaacagaatctctgtcttcccagagctcacatttgattagaagagtcatacattaataaaatatccatactagtagaaatataattatgaactgtttcatgtgacaaaatttagggtactacggaagctcatatcaaaatgagggacaatggggatcaaagaaggctcccctggtgagctgacctctgagagtgggctgggttggctgagatgggtggtgctccttccagtagagtgtatggtttgtgcagaggttctcctatgagggaagatggggtaaggaggaactgaaggaaagtctggctggtataaaggggataaagtataaagagagtatattttatacagagtataaaagggaatgacgtgagaggggctgtgagcagactgggtccagatcactcttggacctggaatcctaggctcatggctcttctctttgccttaacgcctcaatgcacacaatctgccaccaaatcctgtcaaaaatgacacacactctctctctctctctctctccctttccccctctctctttactctcctatggcctcagagctagatttccctttttaaatccaatcttgcctgaactctacctccagccctccagccttttagatgattttccacctccaatccttctttaccctggggcatcccttcattgagagctgcagtttttccttttgatttttctaaaatacattttagactactctgttcttaagaacatttactgattcctgaaacttctgccttataaaccaaaacacagtgggacagagtgaaaagccctttagcatctgacccagcccggctgtacgtggtgcactgaacttcccatcagaagttcccatcaacccttttgtctgaactagaatgtactgtcaattgtgaagggcttcttggagagctccggagatctttgctaaatgtgagggaactcaaactcaattacattttatttttctttcaaggaaaacacacttgtctctttttcaaccttgccataagtgaacaaatacatgtgacaaggtaaaaaagtgacacagttttctttctatgcataggttttctgaatcacatttatggcttcatttagcaggtatttaggcagcacttaatacgtgtaaggaagtgaggagggggaataataaagcttgagaggatgtgagtctctttagcatgaagtataggacatcaggaggagattcctggagagatgactgacaggttgagataagtttagaacatagggcaggtattggactttactgtgttgatagctaaggatgtttattcactgtgaagcaacactatcaggtatggtggaggaagacaactttgctgctgatataggggatattctagagaaaggatggccagtgggaaggcttgggcattacagaatacaagggagatcctcttgaataagctggccctctctctcgccattgcatactgcctcagagcctggaatattttctctgggtcatgacatttgttttgtttgtagatgtgagctccatgaaagcagaggcattggctatgtagtctcagaatccagcaaacgaaaggtggacagtatgcatttagtaagacatgctggctggctgcaactaacaaccttatcacatcacagaacaggtggactcagaggcagaacatggagccctgccccctcacaatccagaaaagctttccacctgattgtctttatgccggtaaacaggattctctgcttatgtcttgacaacttaacgttgtgaaaacagaccaaagttattcatgagctagttacacgatttgttaatgattttagaaaatggtttaggaaatcatctctaattgaccatcatttatactttcatttatgaaagtgcctggagccagcactaactagtctgtcttccctgcacttagcaggctgcatggggctgacagaagcaaggaaaacatgaggaccaagcaatgtgcagaccattctgaccaagttacatcattgacatctttaaactttaaaaattatcattctgagctcaacatacattttttgaatgcatattgagtggtgcacatgagatgagatgctgaggatgtgttgtggagttggttattaaatgcagtgtggctcagcttcctgttatgtgatgcatttgtgctgtgggtcaagttgccacctaccccactccctggaatgacatcattggaaaatgtatctaagccaccattcacagtagtgcttcttttgaaattacccccataaataacattgggaaaaagcaaatgatgggttggttaaaaaaaagtcatagctcaaaagaagtaatgcctcccttcaggatcggagtttggtttcacctctcaaattgctcagcaagtactttcttctacttcttccaagcttacacgcccaccttccacccaaccatagatatgcactccatctttttttttttttaatccctttgctttggacatgctctttcatttagtaagatcctctgttttcttctccttctcatggctaatttttagggtcttcaagacccttcaagacccatggctaataattaaggtcttcaagaccctaattccgggtttatctttccttccaagccttctctgatttcccaactctcctgcctgtggatgttccctcgcagcattcctcttcacagtattataatagtctgcttattgttatgagtaactcatcactagatttgagtgtcatgggagaaagtctgtgtctccttctgtagccagtgtccacaccgttgtccctggtacatgacaggtgttgactatctgcctgttgtatgtggatggaaggtttgcttcccagctgagccctgcactgggatcacagagatgttaataatgtgagcatgagctccttgttagacagaagtgtcactgtcagtggcatttcaaccaaccaggtaacaaaccacaaatcgtgacccaatatttctgtaaaattgcatctctttatactgtcagtatctgtagttaccaaaacttaaaaaaaaaccttcagaaacacagaatggctgacattagttccaaatattaaaaagttttaagtgtcatgctcaaaagcatctatatttaaaagcaattggatcataaaaagtgaacataaaatttacacagctgcctcatcctgaatactttaaagactaattactctgttgagtcctaatgactattgccttcaagccctgtaaattatatataaataagagaagagagtttgtaaatgtaagtgactctaattgggtctcagaagaaagaaaaacagatctttagtagctcgatgaaatctctaagcccataaaacatcggtcagtttctcccatggagttttgtggagtgtaccttttatacatgcaacagagactgaattcaaagggcaggcctgaaccaaggaacctgtttgattttgcttgtatatatgaactgaaaaatataaattaaagaaactcctgatttcataattcaatgtatttttatttccttgaaaaagggctgccattcagtgaagcatacagtaaggaaacctgtcagaacagagtcccatggaagagtagcagttggtctgtattcattcccagtaatgggactctttttctatgcaaatgcattttgagttaaaggtaagacaggttgtagaatattttgtgcaaacgtaaacagaagcactgaaatagaagaagataattgttgcttattaaagtgcttagaatagagctgaatcaagtaaaccagaacccatcactgaatagtttggggatttggtacctgtttactacttcctttgagagttttcaaggttgtttttgaataagaaatgaatcgagccctagaaaaccatcatagttgagtggatctgaaaatgctcagtgcagtgcagttactgcctcatgagaaattctcaaaaagctgagaatattctctctctttttaattttttttttaatttcagtaggttttgggggaacaggtggtgtttggttacatgaataatttctttagtggtgatttccgagattttggtgcacacatcacacaagcattgtacatggtacccaatatgtaacattttattcctcactatgcccccaccctttcctgagtccccaaagtccattgtatcattcttatgcctttgcatcatcatagcttagctcccacttataagtgagaacatacaatgtttggtttttcattccagagttacttcacttataataatagtttccaattccatccaggcatttaggttgctgtaaatatcattaatttgttcctttttatggctgagtagtattccttatccactcgttgatcgatgagcatttgggctggttctgtatttttgcaattgcaaattttgctactataaacatgcatgtgcaagtatctttttcatataatgactttttatggctgagtaatatcccttatccactcgttgattgatgagcatttgggctggttccatatttttgcaattgcaaattttgctgctataaacatgcatgtgcaagtatctttttcatataatgaattcttttcctctgtgtagatactgggattgctgaatctaaccgtagatctacttttagttctttaaggaatctctacattgtttttcatagcggttgcactggtttacattcctaccaacagtgtaggagtgttccctgttcactgcatccatgctaacagctataattttttgatgttttgattatggctattgcaggagtgaggtgatatctcattgtggttttgatttacatttccctgataattagttatgttgagtagttttctatatgctttttgtctatttgtatattttcttttgagaattgcctaatcatgtccttagcccactttttgatgagattgtctgttctttcattgctaatttgtttgagttccttgtagattctggatattagtcctttttcagatgtatagattgtgaatattttctcccactctgggttttctgttaactctgctgattatttcttttgctctgcagaagctttttagtttaattaagtcctgtttgcatatttatatttgcttttcttgcatttgctttggggttcttggtcatgaagtctttgtctaagctaatgtctagaagagtttttttcaatgttatcttctagaatctttatggctttaggtcttagatttaagtctttgatccatcttgagttaatttttgtataagatgagagatggaggatccagtttcattcttttacatggggcttgacaattatcccaatacaatttgttgaatagggtgtcctttccccactttatgtttttgtttgctttgttgaagatcagttggccgtaaatatttggctttatttccaggttctctattctgttccattagtctatgtgcctatttctgtactagtacaaagctgttttggtgactatggcctaatagtataattttaagtcaggtaatgcgatgcctccatatttgttctttttgcttagtcttgctttgcctatgtgggctattttttggttccatctgaattttaggattgttttttataatgatggtggtgttttgatgggaattgtattgaatttgtacattgtttttggcactatggtcattttcacaatattgattctacccatccatgagcatgggatgtgtttccatttgtttctgttgtctatgacttctttcagcagtgttttgtagttttccttgtagtggtttttaaaatttttttttccaccaatgtgaaatgggttgagattttgatttgattttcagcttctgttggtctacagcagagtagcagagctactgatttgtgtacattaattttgtatcctgaaactttgctgaatttatttaccaattatgggagctttttggatgagtctttagagttttctaggtatacaaccatatcatcagcaaatagtgacagtgacagtttgatttcctcttaccaatttggatgccctttatttctttctcttgtctgattgctgtggctaggacttccattactatgttaaatagaagtggtaaaagtgggcatccttgtcttgttccagttctcagggggaatactttcaatttttcctcattcattataatattggctgtggctttgtcatagatggcttttattatgtaaaggtatgtctcctttatgcccattttgctgagggttttaatcataaagtgatactggtttttttctaatactttttttctgcatctattgagatcatcatgtgatttttgtttttaattttgtttaggtgttgtatcacatttattgacttatgtctgttaaaccatccctgcattcctggtatgaaatctacttgatcatggtggattatctttttgatatgttgttgaatttggttggctggtattttgttaaaaatttttgcatctatgttcattggggatattggtctgtagtatttttttttttttttgctatttccttccctggtttttgtattagggtgataatggcttcatagagtgatttaggaaggatgccttctttctctatcttttggaatagtgtctataggattggtaccaattcttctttgaattaatgatagaattaaactgtgaatccacctggtcctggccttttattttggtggctatctttgtattaccatttcaatctcactgcttgttattggtctgttcagagattttatacctttctcatttaatctaggacggttgtgtatttccaggaatgtatccatctcctctaggttctctagtttatgtgcataaaggtgttcataataacctttaataatcttttgtatttttgtgttatcagtagtaatacctcctgtttcatttctaattgagcttatttggatcttctctcttcctttcttggttaatcttgctaatggtctatcaattttatttatcttttcaaagaaccagcttttttttttcatctatcttctgtattttgtcatttttgttgttgttgttgttgtttcaatttcattcagttctactctgatctttgttatttcttttcttctgctggctttgggcttagattgttcttgttttatcagttccatgaggtgtgaccttagattgcctatttttgctcctttggactttttaatgtagacatttaatgccataaactttcctcttagcaccacttttgctgtatcccagaggttttgatagatattgtcactattatggttcagttcaaagaatttttagaattttcatcttgatttcattggtggctttgttcattttaaaaaaaatttttttgtctttgttgaattgggttaatttcacagccttgtctgtgagctgtgaagatctttctcccgcttgtttgattggactgctgagactttccggtgcatttctctaagtgtgtccttcatttccaggagttgtaattgtttttattttactgtctatttcactgaggaatttctctttcatatcctgtatcaggtttttgatttctttaatttggacctcacctttctctgatgcctccttgattagcttaaaaattgaccttctgagttctttttgtggcaattcagagattccctcttggtttggatccattgctggtgagctggtatgatcttttgggggtgttaaagaaacttgttgtatcataatgccttaattgttttactgattccttctcatttgggtagactatgtcagagggaagatatgggattcaagggctagtgttaagattttttcattcatggggttctcctttgatggggtgttctcccccttcccctaggaatggggcttactgagagccaaactgtagtggttgtttttgctcttctgggtctagccacgcagtagagctactgggctctgcattggtattggagagcttctgcaaagagtcctgtgatatgatttgccttctgatcttgcagctgtggataacagcaactgctgcagtggaggtagcaggggaatgaagtggactctgtgagggtctttggttgtgtttttgtttagagtgctggttgcatgttggttggcctccagccaggagagggcacttttaagaatgcatcacatgtggccctataaggaggatgcattcttgccttaggaacacctggctgagtattcaggattttcaggtggggagcagggccatagagctcccaaaagcttctgacctttgtctttcactacaaggatgggcacagaaagaccaccaggtaggggcagggctttctgagttcagcctctctttgggcagggcttgctgcagctgctgtggaggatgtgggtgtgacttcgagtccaatggagttatattcccagggggattatggctacctctgctgaatcatacaggtcaccagggaagtgggggaaagcaggcagtcacaggcctcaccccactcccatgtagtccatagtcctgaaggctggtctaactttcattgtgcccctccaacagcatcgagtctatatccaggcagccagagaccagggctgagaacttgccccaaactatgagtttcctagcagagaaagcaagccgacttacaggcttttggtatctcagggaccctgcagtggtgatccagttccttcaaagggtctgtgggttctcttagctttcctggtacgttcctgtggtagttcttggagcaaaagtttacgacgtgagtctccacacactgctctgtccatccaagtggcggctgcaagctagtcctgcctgctatctgacatcttaattctcgagaatattctcttgaggatatctaattcttttctgttctaatcttttcttaccttgcttaagatggaaattatggaaaataaccttaatgtttacttttgtcataaaaattggctttattttccatagaatttataatttttaagcataaagtgtctctttttccaaaaagcttaaaaatatttatttttaaaaaaacttggagtcatatcattgcatttaaaaaaatgtttacttgactaataaggattgaatacattcaagatgtacaatgtgatgggtcgatacatataaacactgtgtaatggttaccacaatcaaaaaaacacatctatcaccacccatgctttacattagattgcctgaacttgttcactttgtaattgaaaatttgaccaacatcctctcgtttccccaaaccccagtccctggaaaccgctattctaccttctgcttctatgatttctacctttttggattccacatataagtaagaacatacagtgtctgtctctctgtgtctggcttatttcactttgcattatgtcttccaatatcatccatgttattgagaattaaagtatttttattatttcctgtggctaaataatgtaccactttttctttactcactaatctctcaatgaacactctggttatttctatatcttggctactctgaataatgttgaaatatacatgaggtgcaaatatctctttgaggtactgatttctggatatatatccagaagtaggattgatggatcatatagtagttctctttttaatttgttgaagagtcttcaaactgttttccataagtgccataccagtatatgttcccaccaacagtgtacaagggttcgcttttctccacacccttgccaacacttgctacctattgtctttttgataataaccatcctaacaggtgtgaggtgatatcttattgtggtcttgatctgcatttctctgatgagtagcgatattgagcaccattttgtagatctgttggtcattgtatgttttctttggaaaatatctatccagaacttttgctcacttttgtcattgtttattctttgctattgagttgagttctttatatattttggatattaaatccctgccagatctgtagtgcaaatattttttcccattctctaggtcacgttttcattttttcaactgtttcttatattgtgcagaaacttcttagtgtgatgtggtctcatttatttattttggattttgctgtgtattcttttggtgtcatataaagaacaaatattgccaagactaatattaaggagtttttcctccatgttttcttctaggagttttatggtttcagatcttatatttaactctttattttcaagtaaatttttgtatgtggatccaacttaatacatgtgtatgtgtgtatctatcttttccaacaccatttattaaagaggttgtccttttttacattgtgtattcttgctgttcttatcaaagtttagttgatcacaaatgtataggtttatttctgggatctctcctctattactttagtctatgtgtctgttttgatgccagtaccatactatttttttgttttgttttgtttttgtttctaattaggaattcagcatggataacataagcttttgatcactatagttttgtaatatagctagaaattatgaagtgtgatgcctccagccttgttcttctttctcaaaattccttttgctatttgggatcttttttgattccatatgaactctagaattgtttttctattgctttgaaatatacaattggaattttaataagaactgcattgaatttgtagctcatttgggggtggtatggacattttaacaataatgattcttctaatctatgaatgtgggctatctattaatttatttgtgtcttctacaatttctttcatcagcgtcatacacatttaacatttgattgtacatgcaatggttccaggacaagttcttaacaatgaagcttggcctcagaatggtcacaaattgtattttagtcttttgctctgggacgcctaactgagtgggattatctatgtctttatttaaataattttcattaaatgtttttattttctatgatgggggctaaggaaggatgtcaagtatggctgctaaccttcaggaaaattgtaggccacagccaaattagagggaagaactgtgtgaaatggcccatatttaaatgtccaacccaattaaacagacctacagttgtcccatatgtaaaattagcgtaaagttaattataagtaggccatatttttcagattgaaggatgaaatatatgaaatacatttgagatagttcctagaacaaaatgggcaaccaatgatattttaacgatattggtaataacagtaaaaataggtcactaattttgtttcccccaaattcatgcccacctggaactgaggattttatttatttgtaaaataaggtcttaacagatgtaataaattaagttaaaatgaagtcatactggataaaatgggttctaaatccaatgactggtgtctttttaaggaaaatgagatgtggatagagagacacagagacaaatagggacacacagagggaagagggccatgtgacatgaggatagaagcagagattggagcaatgcacaccaaagaacaataaggattgtcaggagctaccagaagctgaaaagagacaagaaagcatcctccccttgaaccattagaggacaagtggacctgctgatatttctgtttcaaacttccagcctccaaatttctattattacagttgcccaggagacaaaacagatggtaaatggaaccacagcactggatgagattgtgaaagcagtgagtattgatagagaagttcctagaccgagcccggggactttaacatgaagaaagcaaggtgacatcgagaaatcagcatggagagagagaatgaatgaccagtcaagtaggaaggaaactaggagagaaaaatattaggaaattgaagcattttagaaagaaaagaatgtgactgtattgaatactaataaaaataagatactgattatgaaaggaaaattcgatttatcaacatacagttcattggtgaattaataataaaatgaaagttttggtggtagcttagggttaaaatctgactggaataagtttcaaaagtaaattaaaaagaggcattagagaaagtatagataacgccttaaaagttttactgtaaaccatcagggagcagagaaatgtgacattagctaacattaaaagagttgcaggccgggcgcaatggctcatgcctggaattccaacactttgggaggccgaggcaggtgggccacctgaggtcaggagttcaagaccagcctggccaacatggtgaaaccccatctctacaaaaatcagctgagtgtggtgacaggtgcctgtaatcccagctactagggaggctgaggcaggagaatagcttgaaccctggaggcagaggctacagtaagccaagaccttgccactgcactccagcctgggcaacaaaagagaaactccatccaaaaaaagaaagaaagttgcagaagtttccttttagatacaaaaaatgctaatgggaattatatagcagaaggaatcaaattttaaagagaattgtaaaggaatggggtgttgcctcagtagtgtctttacaaggtgataacgatgagaaggaaagaatacgttggcatcagataaaaaatgaggataattcatctaaattaatgaaaggaaagtcagcacataggggttcagctattgacacgtcagtaaatgtgggggcgggactttgtggttcttttacaaatgtttcagttgtcttcgagaagatggagacaagattattagctgagagtgaggaaggagaaggcagaaatgaagagaaggcattatatggtcgccttagccaataggtgaatggataggagaaagaagctgagattaagaggagggggaaggcccacatgaagttggcagtcctggatataaagtggcttataaacagtgtgcatggtttgtgttttcttccaccagataaaccattcaaaagtagggtaagcaggcattgttcggacaaacaaatatccactttcaagaagcaagaatgggccaagggacttgaggctgtaaatgagaggatagtgatggaccagacaatatgagctgggaaaggagagaggagaggacacaaaggagttaagagctctgagtagatggtgagattaacccttacactaagtattggagaagtccaggcattagaggaagggaattagaaagggaagagattgtagtcagaaaacaaaattcctacagttgcaattacggagggtttgcaattattagtactaacaaatactgaagtctgatattgagtccatgatgcactaatcaattatgactgacagcttgaaaaacagttagatggaggtgctgaagtgggtgtgcatggatatggagacattattgtgtggctctcatgggacctaagatgtgaataaggaggggcttcctggcacagatctgtatcaggagcattctaggtgcagagaaaagcaggaataaagtctccaaagaaggagtgagctagcacattaggggaacataaagtaggtcagtagtagttggagcttagtgggtgagggcaagtgtggaatgaaatgagaccaaagaggtacaagggaatatgatatagtttcttgcagaccatgtcaaagaatttggattttattctaagtgcactggagaatcattaaacattttaagtagtggcatctggtttatagtgtaaatgcttattttgactgctgtgtagggaatggatgggtgtgggagaatgaggaggtgaggctggaatctgggagacaagttcagatgtgttgtagttgttcaagtgagagctggtgatggactgccttgcggcatggtgaagacctggaaagaagtgcaaagatgcacaatgtatttagtagagaccagagggctgtcgatgacttggtgtggggcacatgtataggggttctggtcaagaaaatgaaacaaaagaaacaagtatggctcctagaattttaacctgagcagccagcacagaggggtgccattatgtgaggtggtaaaaactaaaaggggagctttttggtgaggacaatctggttagcagaaactgaaagatgcataggaagctgtctaagtctaggattgacatgaactgatgtggaatagaaaagaatcaacatggagaagagcctgctctttcaaagtgaaatggtaaagcaagaaactagcaatgccgtagtaaagggagaatgagagcgaactcttatccctcagtggtggtccagagtctggatcagtcatccctttgatgatgtgagggccatagtgctttgtgtctttccctttagatcttatatgtacattgtggcacccaggctaacattcttaaatatcactttgtgtcacacatgtgtttgctgctcctaatggaatccccctttacagaaacaggtaaaatttccttggcattccttgccagtgtggtctctttctttaacatttcattccaagttcccattccttttgtggggtcacagtttccctacttttcaaaatgatgaggttggttgtgcaaatggctgctaaggttctcatccgctccactgtcctacagttctacagcttcaggtacggtgagatccagctacatcactctgtttacatcatagttaatagtatatcactttttgttttccaaactaagttctatcttgcttctacaaaacttcttcccagacaaactctttctaattacctccacgcattttttttaacttttattttagattcaggggtacatgttgaggtttgttacacagttcaactcatgtcacagaggtttgttgtacagattattttgtcacccaggtactaagcctagtatccaatagttgttttcttgatcctctccctcctcttaacctccatcctcacgtaggccctggcatcttttgttcccctctttgtgtccatgagttctcatcatttagctcctacttacaagtgagaacatgaggtatttggttttctgttcctgcattcgtttgctagggataatggcttccagctccatccctgttcccacaaaagacatgatctcattcttttttatgactgcatagtatttcatggtgtctatataccatatctactttatccaatctgtcattgatgggcatttgtgatgattccatgtctttgctattgcgaatagtactgcagtgaactttcatgtggatgtacttcaacccttataaccacttattgattttgaattcacaaaacatgtattccgtagcactgatcaaatcttctccctttccctctgcttatacgtccattcctctatccatccactcatccttctatgctgccacacatctcttttgaggtagcatgacatagtggaaagggcacatactttatatacatctgcactccttggtttaaatcccatttcattatgaatattctcattacagttttacttgtggagtttttatacctctgtaaaattccattttttaatctgaggatttaatgaaaaacctatctttagtaccaggttaggtgcctaatacagagtaggcacatcagatcagccagtgtgactgttgcttttgtctccttcaactagattataaggtctttgaagatagaactgtagcattatagccatttgtttctctagtgtcttacaccagcaggcattgaataaatgttagtttataatttgggggaagtgttgataacattctccatagtggctattttattcaacaaatgtcttctggagatttaagatagcatgtcccatgttattctctttagacacaaagatgaataagcaacaattcctcctaggggagcttagattcaagaggatgagaaagacaaaagagtcttgataaattgagatttgtattctacgtgaccagagtggcaatatggtgaaaagaaagatgttattagtctttggggcaagtggggacctgggtcacatggactgggtcttaaataatgaggaggagcttgccagacatattaggaggcaagtaggtgttttcagctaaggggaaaagagaaacaaaataaaacaaaaacataacaatgtgcagaggcaaggaaaagcatttggagggatactgcgtgttcaggtgtgtgactaagatataataatacatacataataaagttggaaaggtaagaaaggacattgaatgtcatggtaagaagttggactttctcatatagaattagaaagccttgggcttttgctttttttttttttttttttttttttttttgacagagttttgctcttgttgaccaagctggagtgcaatggcacaatcttggctcactgcaacctccacctcccaggttcaagcaattgtcctgtctcagccttccaagtagctgagattacaggcatgtgccaccacgctcggctaatttttatattttcagtagaggcagggtttcgccatgttggtcaggctcgaactcctgacctcaagtgatccgcccacctcagcctcccaaagtgctgggattgcaggcatgagccattgtgcccagccacctcggagttttttaggcactagagtcatatggccacatatgtgttataatattcatattaataaaagtgtggaaaacagattagagtaggaagagtagaatggtgagaaaaggtaaaacagaaaaattatgttcttgtacaaccaatgtacgagagtatttaccctaagtcccagctcaagatactgaattagatatttgaacttttaaatttaattaatgtaattttattttatttttcaaaatgtttattttcataggtttttggggaacagttggtatttggttacatgaataagttctttagtggtgatttctgaaattttgctgcacccatcacccaagcagtgtacactgaacccaatttatagtcttttatccctcatccccctttcacccttacccttgagtccccaaagtccattgtatcattcttatgcctttgcatcctcatagcttagctcccacttatgagtgagaacttacaatgtttggttttccatgactgagttacttcacttagaataagggtctccagttccatccacgttgctgcgaatgccatttatttgttccttcttatggctgagtaatagtccatggtgtgtgtgtgtgtgtgtgtgtgtgtgtgtgtgtgtgtataaaaaaataaagaaattgtgtgtgggggtgtgtgtatatatacaatttctttatctactagttgataaagaatatatacctatacacatgcacacataccacaatttcttaatctgctagttgattgatgggcatttgggctggttccatatttttgcaattgcaaatgtcactgctataaacatgcgtgtgcaagtatctttcttgtataatgacttactttcctgtgtagatacccagtagtgggattgctggatcaaacggtagttctacttttagttctttaaggaatctccacactattttctacaatggttgtactagtttacattcccaccagcattgtagaagttttcccttttcactgcatccatgccattatctattattttttgattttttgattttggccattcttgcaggagtaaggtaatatcgcaatgttgttttaacttgcatttccctgatcatgagtgatgttgagcattttatttggacttttagaccctgagttcctggtccgtcatccccttgtcatgtgtagctgaatttcaagtaggatataaataataataaaatgccttgctacaaggtactgggtgatccttggctgagtattagaggtgctttgaaatagatccaacatatcctacttcaggaggagtgtagtatctcttccatgcgaggttctttcttgaagctagttatgtctacttagacgtatacagagtctaacattgatcaacttaaagcctggccaaatatccatggcaagcttgtcagatctgacctctggatacttagagcatgaggtcctgggggtcaaacctgcagggaggcactggtttctgggctgtggctcatggggctcacaggagtgatacaaaaagctgtcctggggatctgtgaccaaatcccagtaggctgagctctctctgaaggggcaaatggtttccactgtattccttggagaccaaggcattgtgttggccaaatgaagttgtggggtggagatggggtgacgaggaagagacagtgagcctccccataagtacccctcccacttcaactcgtgcagctctacatttttttttcttttctgtactagccttcactgtccgcatcatttgaatacagtgttgcaattggaaacaaatttgaaaactactggactcggcatataaggcaatctcagatgcatgcaaaagagatggaaccctaaacacaggcaatagtcagcaggttccaggcagttggtgggagcccaaacctgagtaaattttctgaggtgttacagcctcagatgcaggtgagaaggaggctaaaccagtgcagagactgctcaactccaacaggaccaccagattctagcaagctcctttggcatgccacccttgggattttcaagatacgtatacacccaactcaggccaggcaggggagctcatgcctgtaatcccagcactttgggaggccgaggcgggtggatcaactgaggtcaggatttcaagtccagcctgaccaacatgatgaaaccctgtctccactaaaaaaaaaagaaaaaaaaatgaatagttagctgggcacggtggcaagcacctgcaataaggaggctgaggcagaattgcttgaacctgggaggcagaggttgcagtgagctgagatcgcaccactgtactccagcctgggcaacaagagtgacacttcatgaaaaaaaaacaccacaaaaacaaaaacatatacacccaattcaaggataacacactctaggcgagacagtgtataagaacaagtcaagtgaattggtctctggacttaataaaaataagtactatgagagttgtcctgttccagagaaattattttttagatattaaaaatttcaacagcccttgatgctaaaaactctcaataaattaggtattgatgggacatatctcaaaataataagagctatttatgacaaacccacagccaatatcatactgaatgggcaaaaactggaaggattccctttgaaaactggcacaagactgggatgccctctctcaccactcctattcaacacagtgttggaagttctggccagggcaatcaggcaggagaaggaaataaagggtattcaattaggaaaagaggaagtcaaattgtacctgtttgcagatggcatgactgtatatctaaaacaccccatcatctcagcccaaaatctccttaagctgataagcaacttcagcaaagtctcaggatacaaaatcaatgtgcaaaaatcacaaacattcttatacaccaataacagacagacagaaccaaatcatgagttaactcccatccacaattgcttcaaagagaataaaatacctaggaatccaacttataagggatgtgaaggacctcttcaaggagaacaagccactgctcagtgaaataagaggacacaaacaaatagaagaatattccattctcatggataggaagaatcaatatcgtgaaaatcaagttaaataatgggttatacttaaagtaatgggttataagttagtatttgcaagcctcatggaaacattgagtcaaaaagcatacaatggatacacaaaaaataaaaagaaactaaatcatatcaccagagaaaacttcaaataaactatctaacaatgcattttaaagaagcagcaaagtaagagcaaatcaaagccaaaattagtagaagaaaagaaataataaaaactggctagacatatgaagaaagatgaaactggatctcttccttacaccttacataaaaattaattcaagatgaattaaagacataaatgttagacctaaaaccatgaaaaccctagaagaaaaccgaggcaataccattcaggacataggcatgggcaagggcttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaacaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcagggaacaacaggtgctggagaggatgtggagaaataggaacacttttacactgttggtgggactataaactagttcaaccattgtggaagtcattgtggcgattcctcagggatctagaactagaaataccatttgacccagccgtcccattactgggtatatacccaaaggattataaatcatgctgctataaagacacatgaacacgtatgtttattgcagcactattcacaatagcaaagactgagaaccaacccaaatgtccatcaatgatagactggattaagaaagtgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacttggacacaggaaggggaacatcatacactggggcctgtggtggggtgaggggagcagggagggatagcattaggggatatacttaatgtaaatgatgagttaatgagtgcagcacaccaacatggcacgtgtatacatatgtaacaaacctgtacattgtgcacatgtatcctagaacttaaagtataaaaaaaaaaaataggcctggtgtggtgactcacgcctgtaatcccagcaccttgggaggccaaagtgggtggatcatgaggtcaggagatcgagaccatcctggctaacatggtgaaacccatctctactaaaaatacaaaaaaatagccgtgcatggtggtgggcgcctgtagtcccagctactcaggaggctaaggcaggagaatggtgtgaacccgggaggcggagcttgcagtgagccgagatagtgccattgcactccagtctgggcgacagagcgagattctgtctcaaaaaaaaaaaaatttctaagacccaccaaattattcaattatttcctccctgcctccctctctcccttccttccttccttccttccttccttccttccttctttccttccttccttccttccttccttccttccttccttccttccttccttctttccttccttccttccttccttccttccttccttccttccttctctcctttctttctccctttcttccgttgtttctttctttcttttcccttctttccaaatttactgggtacttaccatgggccagacactagaaacccaagaaccaatgagatatgtcctggctcccaaggattttattgatttgtgcgagttaggcaagtaagtagacaacacaacacagtacatgttagaataaaggagatggtagggcctattggatcagttatgggcagtttacagaggccagggagggcttcttatgagagggaaacttatgatgaattctgaagtatgggagagtcaacctaatgagaagggcattctgggcagcggtgatcaccatgggctgttgtggcccttgggaaactcatgctctttggaaccggctgaatttagtttttaaatctgacctcatcatttactgagaacaggaaaagttatttacttcccagcagctctattttttccgcagtaaagtgaagaaaattaaagagaaaaagcattctagatgaaagtggagtattgagtaggtgctcaatcatgatggaatacctgtgctaagccaaggagtgtaacgatgtctagtaagtgaaaagggatcttatcagggtgtgataaaccatcggttcttttaagaggattccttatcatgtgtttaagtacttttttaaatatagattttcaattttttagaaaaacagcatttataatatctgttgtttatttctaaaaataatgatgctggccaggcgtggtggctcatgtctgtagtcttagcactttgggaggctgagacgggtggatcacctgaggtcaggagatcaagagcagcctcgccaagatggtgaaactgcaagtctactaaaaatacaaaaataaataaataaataaatagctgggtgtagtggtgcaagcctgtaatcccagctacttgagaagctgaggcaggagaatcacttgaacccaggagatggaggttgcagtgagccgagatcacgccactgcactccagccagggtggcagagtgagactccatctcaaaaacaaataaataaataaatataaaaataatgatgatgattttgcctgaatacggggaagaagaagaagaagaagcagctagatttaacttgagtgctccaacatggataggacctttaaaacttcgagagtagttgctagtgacaaaagtttatttctttttatacatatttattccagaagcaactaaggctcaaattagttttatttttatttattttattctattattattagtttttgagacagaatcttgctctatcgcccacgctggagtgcagtggcacaatctccactcactgcaacctctacctcccaggttgaagcgattctcctgcctcagtctcctgagtagctgggattacaggcatgtgccaccatgcccagctaatttttgtattttttgtagagatggggtttcaccatattggccaggctggtctcgaactcctgacctcaggtgatctgcctgccttggcctcccaaagtgctgggattacaggcgtgagccatcacacctagcccagttttatttttaaactaagttttattttaagctaaggctcaaatctcttttattgttaatttccacattgtgaacatcttatctctgtttatatgaacaaaaaatgatgtgtgtcctttatagtgtagcaatgttaatatataaacaacaagaaaatgataccaaatagacaataaatgcattacagcatgtcagagaaattgcatcgcattcatggccagaatattcaattcattctttgctttattagacttagggacaacaccttccctctgacaattcactgtctgtggaattataaacttgcaatgtctatcattgctgtcaacctaatgaaaggggatggggacagaaaactccagggaggaaatggaagctcacagatgaagcaagccgagggggtagaggaaggcctgaggatagcgggaataactctgggcccaggattctccagagacaaatagacatggcaatgccaggcaagaagctgatggtgatctgaaccactggagtgcacagctgaagaggtggaaatgtctcttagctccctaacaaagccactgaagaagacgctcagggaggtgattaatgagcccccagctctgacccacatcccttctggaagttagcctttcatggggtcaaacttactttgaaaagtcatggagtgaatttgcttccccaagagtcatgtgaaatgagttagtgggaggtttcagaacatcacattcgcgggtggagggatactttaagaggcactgattgcatcaaagctcctaagaaggcgagtgaagtatttgtatggctttggaagaactagctgaggtgtttttttgtatcacgaacttggatattgggggaagcttcagaatactttagcagataggaactctgctgagattactaggtcctaagaggaatggtggcaagagggatgccagcaaacatgtataaaatgaaagtgttttcaaaaatggaaaaatatgtaaagaatatgtgtgtgaatatgaattaccagaacagtaagatgttaagagagttcaacagccttaaggaatgtgggggtcgatcactatgtctggcacgtaattatcacacactggtttattttatgaggttgaattaaatgttaagacacacagattcttagaaaagtgtggaagggcatattgcccagcaacccaccagtgcacgagatgggcctttccctgccaggggcaggaggggtaccttgcccgtgatctgcacagtgactcgcccctaccagctcctgtctgcacaaaatatgctgctcttgggagcagccattactttttaagtagtaaaataacaaaaataataatatccggaaatctgcgtggtcagaaccacagaaagagaatgaaccaggaaaaccaggaccaggtatagagagcttctccttctggcctcagaagtgttaggcaatggcctcatagctccaaactacatttttctattcttaatttattgtttcacatgcatgtattctgaaattctatgagtagcaacttatatttgaaatggtctctgccctctccccgcaaaagtattcaaatacttgggtgaggactggggatcagtcagggacacggtggttactcacaaccctcttgccttactggattggcagtctgggaaagatgggcaggctgagagagttcagggagtttttctttgggatgagggaatatgagaaactttgaggggatgagaaagagttactttagttgttctcagctcaaatttgagcagatactcctttctccccaatggccatcagcttatgacatcgctcctcaattccaattattttccattcccacatatgtccaagggaagagctcctgccattttgtgtgtgggactccagtgactccagaccagatgacccctacagacagaaaaggacagcaagcagcatgcagttgggctgcttggctcaactctcacagccagtgacgctggggaaaggatcagatgaggaaaagtgcctgtcacagtgtctgagataaagtagcatctcaacaacttattaccccatggcaatttttaaatatagaatgtctttcaaacatttttttaaattttatttttaattgacatataatacttgtatatatttataaggtacatagagatgtttcaatacatatatgtatagtgatcagataagggtagttagcacaaccattatctcacacatttatcacttgttttggaaacattcagtattctccttctagctacctgaaacaacatacaatatacttttgttaactctagtcatcctacagtgctatagaacactagaacttattcctcccatctagcttaatcttatttcccttaacaaatctctctgaagtggccattttgcattgtgagctaatattctctctctctctctctgtctctctctctctgtctctctgtgtctcacacacacacacacacacacacacagaattgatacacttctatttttaatatgtctcctgggagtctcatatgtctaaattctgtttcattttgtaagaaatgctgactgagacccagtaaattgatttcctaaccaacaaggaatagctaacagctgtttgaaaaacgcagtcctaataaaatttgaatgttccagtgggctgtaaagggttaaaagggttaatggaccctaaagggttaaagtgaggcactgtgccctaatctggccacattcccatcatgggcattatatatcaacgggtgataacaggactgagttctctttccagtccttagatataaaagggagacagcaattaggaagaaagagagttataggaagtggtaggaattgaagagaaagtagaaaagatcttaactctaccttattaaagtttcatgatccaattacaaaatagatgttttattttctaaactggcattttggtttgtgataacaccacacacacacacacactctctctctctctctctgtctctctatttttgcagctctcttcagaattttctttagggaccctgataaatatacgtgatatatttttaaaaattgaataatggaaggattaagacctggggccctaataatcaattaaaagataatctgatcatgtctttgcattttataggtgctgctttatattctaatttctaatatttttctttcaaggaagcttacaggttcgctatcacctaaacaaggaagaaacccatgtattcaccattgatgcagataactttgctaacagaaggatgcaccacttgaagattaaccgagagggaagagagcttaccattcaggtaccttccttactttctcctgcttcagccaatgtgccttggctactctatcaaacttttctaagcttctaccccatgccagtgtagtgcctagtgctggaaacatagttacaaatcacacttgcccccagacttggaagaactaggatagtggttctcaagatgtgcttcccatgtcccaccagtatcagcatcacttgggaccctgttagaaatgcagattcttgggccaagtgtggtggctcacacctgcaatcccagcactttgggagtctgaggcgggcagatcaagaggtcaggagttcgagaccagcctggccaaaatagtgaaaccccatctctactaaaaatacaaaaattagccaggtgtggtggcacacacttgtagtcccatgtactcaggaggctgaggcaggagaatcgcttaaacctgaaaggcagaggttgcagtgagcagaaatcacgccattgaactccagcctgggagacagagcaagacttcattaaaaaaaaaaattaaaagaaaaaaagaaatacagattattggctaggtgcagtggctcatgcctgtaatcccaacactttgggaggctgaggcaggtggatcacaaagtcaggagttcgagactagcctggccaacatggcaaaaccccatcaatactaaaaaatacaaaaattagccaggtgtggtggcacgcacctataatcccagctactggggaagctgaggtaggagcacttgaaactgggaggcggaggttgcagtgagcagagatcccaccactgcactccagcctgggagacagagtgactccatctcaaaaaacaaacaaacaaacaaaaagaaatgcagattcttgggttccacagcagatctattaaattggaggctatggaagggggaaagcagcaggtgatactaatgtctgctcaggtttgccaaccgctgggctgcattaaagtgaggaagacgcatgggcaaagaggaaatcataataggctgtgggaaggcatgtggtggaagcaggcacaggtgatactgaagagggtgctgatcccacctgggcatcagtacttacttcctggaagaagttaggagtaagctgagtcttgaagatgagtaggagttggccacagggaggaggagagtgctcaggaagagggtccatgtgagcgcaggctaaagctgtctgaaagcatgttgtgtgggaggcaccccatgagatctcagtgggctccatataaagggccagcagcagatgatggcagagcccaacagagaatagacagagtccagatcatcccctttaaaatcatgaccctcagcaagcccttgcatctgcctatcaatcactccatgttttttaatctgttctcctgttctcctggttgaccattttacactctctcctctttacttatactgctaacaattgccagtttgtcttaactctgagcagatgactttgctttcttatttcttgtaagaatttacactcttacattcagaagagaatatccgcacattctcaagagcacattacctacctaccacatgtgtgtttgcactctctctccctcctgaatagttcatggttctagctaaggcctgaccttgctacctgtgggtcagatctgataccctactgaagaaaatcactctagcattctccttcctccctccctttcatcatttattccagctctactgaatggctccccaaagcctaaaacaaataattattacatgcattaagaactaatatacagacaacaatagctaaacaagcaaacaagccagcatatctctgggtaaagagaggaaacctttctcttatctgacttcttacagtgttccattctctttgtccttttcttgcccgaatttttggaaatgttgtttatatgcttgttcttcatattttccctacctttttcttatacccataccgaaaaggtattgcctctgcactgcagcaaaattgtacttctcaaggcatcattgtgcttacctggcaaaatccagtggtcatgtctcagtgttatctttccttgtcctctcattgacaactgacatagggattccttcctgttcttgcaacttgacctaagtctttattgcttgcccaatacaactctcgcctgttgatccttctgcctgtgttagttgctcactcttgtctcttttgttggtttcccatcatctctcaaaactctaccccaaggaactctcagaacgcccaaggactccagcttctgcttttgatctacactcactccatactcatctcattcgatctcacatctttaaatttcatgtacatgctgatgaatcaatcctgaatgtgtatctaacactaatcctgtccctggattccagaccttataccaactacctactgggcatatctatatgaatatccgttaggcattggaatatttaagtaaatagttaaaattgacttattaggaagttctcctgaaacaatgacctcatcccctgcaagcatgtcccagttagtggcagcttcatttttcaagtccatagtttcaaaattgtggtattctccttttatctctccttctcttacatgcagcatctcgtggatcaacagcatctacctttccccaagccacccttgccctttgcttggattatcactgtttacagttgccttttgattgacatctccctgctcctctttaggttccctggctgtctatcctcaacatagcagtcagagtgatcctggtgaaggaatagatcctggcattcttttgtccaaaccctgtcaatgatttcctttctcgtacagagaaaaagtcaaaggtcttccagtggcttataaggatctccattatctgacacccctgctcatttctggttgcttctctaacctcatctgattatatgccctctggaactctagttgtgccactctggcctctttgctatttgcagagcccttggactcactgctttgcctaggatgctattctttatatatactcatgtccagttcttgtacttccttctgcactcaaatgattcaaaaggtcattctcattgaggccatctctgatcagcttatttaatagagcaacctatttccttgacgtcaaccctacacccccccttattcttgcctgcattatttttttctctcagcacttaacttccaatacaatgtatttacttatcaaattttctgtcctgtctccctcctctagaatgtaagttgcctgagaacagaggagggtcgttctgagcagacgtgccaaaggaaaatcatggcaggggagatgggaggactatgtatgagtccctggtggattgcactcaagctgtgcaaagtcaggcacatggctaatgggatcttagtctcctcttcttacaggtgaactgtaaaataatgaggactctttctgggaatagcaccatatgcatagtcagagtagagcctggaagaaaccagtaggatatggctagcctgaaaaagtgagaatgaatggggagggctccctaggaatgggaaggggactgaacaaatggagctggaattagccatgggtgaagtaaggagggatctctaaaggatggtcatagaaataaagtcctactgaagtcccagtgttggcttttgctcacccctgcaagatgggattatcaatcgtccatgttggttgcagctaactgttcagctgccctctcctccccaggaccacatgttttgtcagactgcaatccttgcccaggaaaagctctctgcccacaactaaatgagaccaggtcagaattatgggacaatggggacagtggtggccctaaggacaaacagagagaaagggggagaaatggaaaatgagttcctgcttcctattaatgttaatcttgcacagcaagttcctgagcaggtttcatttgtttgcttgtttgcagcaaagaatttggtgagaaaatctctgtggggagataaatacctataaaacgctgtatacagtttcccagggagaagacttgtgtgaaaacccttatttcacaaagaagaaagaaaggggtattttatgtgcgttgtgggcaaattagcgagacctgtctaatctctcctgagagaaaatctcagaggggggtctgctatctgtatgcattttttcaagctatttccagatgggatcgttttatgcttcttacctgcagacctctgctgatgtgcctttgttttctgttttcctgcagatggaccagcaacttcgactcagttataacttctctccggaagtagagttcagggttataaggtcactcaccttgggcaaagtcacaggtatgttgttctagttcatacctttccagtgggctttattaaaataaatgaatgcataattttcattagggtgtttaaggattcaggtctggagccttttgctcccataatatctgagatctgaaaccaagatttcttattcagaaaatgccaagatgtatctgtggcagaaataggcaatgcatttctatctactttataaaaacttgcaagaggtaaaatactaaaataatttagcagaatacttaaatttttacttaattttcaaatatatttttaagttttacttaattttaacttaaatgtatgagtgcatacattaaggatttgagcaactcaatagttcatcaaaaattttaaaggcattgtaatttcctattataatagtgaatctttttttttttctattggaagttctgtcaattttcactttatatatgatgacagtattcattacatgcatacaagatagaaattttttatctacttgatgaagtgaacattttatcacacttaagtgacctttttaaactttagtaatgtctttttatgcttaaatttattttgcctattattaatatgcctattacaactttgcttaacttagtgtttgcctggcctcttttctcattctttttctttcaatttttccttttctttcagctttgtaggtgatcttgtgaagaacatactgctagattttattttttatactcaactgtccatccatttttttataatggcaaatgtaggtccttctacattgtggggctacttgtaaagttggattttgtttctgctacccgatttcctatgtatccagctcttcctgtgattctatcatattctttctgactctctctctatcacagtacaatgcagaaaacattaataactcaatgcatggtaagcagaaatacatttaacacgtaagttagttgcttacaagattgttgtagtacttacagtgtgggttctttttggggtcttttggaatgacttcctcgtgccccatactgtatgcaaattcacaggtagaaggaggaggtatctgaaaaatggctgtggaaaaagcatcacgggcccctgcttttgcttgccagtagaaagagctgaaaaggcataaaaatgattcttgctacagccctcaagcttcataaagggtttataatttccagatgtaatgttgatccagaaacctagctgaagtagggtcaaaaaaatgtccattttagttccccaaatagcagttggaagaaccaatcaacactgatccctgattgagtttatttctgattccattcacagtcctaataataatcatttttatatttttcagatactgcttatttttgatttattaatatagacactagtttatacattcctcatttcttcctgtatctcagacttttctatcttctgccaggctttatttccttctttttaactaaattcttttgaattattttctgtttaaggttcccttcattatacatacatatacatatttacttacttatttatttattttcctgaacaaaagttttattttacctttaatcttggaagataattttgctagatcttcaatgcaatattgaagaatattttctctcaggtactgagaaatcagtcagaggtgtaacggagccagtggcactggcctttaagaaccaggtatacatgtctctccccaactctgcatccttcagtggtggcaggatgccagcttgaaatcagctgtagtaggagggtttacactgtggatatcagaaatgctaaaagccaggactttccctacctcttcctactgaagagccagtttcaaagactcactggcacatcagtgtcctcttgttttctggcttccccggttgctaccaagaagtccgctgtccatctgtcctgctattgaaggtgctctgaccacctccatacctactacttacaagttgatttaaagtcatccttttttctttgatgttttgcagttttgtcatcacgtatctgcttgtagatttctttttaaaatatcttacttgatatttttatgtttcctgttcgctatgtcatatgtatctatgtatccagttcctatttattattcatatgtatctgttcatcagttcttaaaaattctcaacatatcaaatcttgcttcctcctattctatctactcaattcttctagatctaaattatatgaacttagacttgctaattctatcatcatatttcttaccctctttttatagctttcattctttgatataacatcttgcattctgggcaattcatttggctttagcatcacattcactagtcctctccttatttaggcctaatcccattcaatgaatcatttcttattgatttcatctttcatttctaaaaataatattttgttctttttgaagcatggctattaataaagataatttgttgtctctgttcttttgtttgtttccatctttttatgtatttaggcatttcattaatagttattaaacattttgtctctgataattccaacatctgaagtctgtgagggtcccagtctgttactagctgttttctaaatttttcctgtggtaacttgtttccttatgctgtgtgtgtgtgtgtgtgtgtgtgtgtgtgtgtgtgtgtgtgcgtgcatgtgcgtttgttcatattgattacaattaatttgtgacaactctaaggatcaaaaattaagacactctcctcaaaataagatttttttttttttaacttctgccaggtgccaggaggtactaccaatttaggacaattttaatttctcactttttttttctgaacagagaagaaatataaatttgagctccatacctgaatgagatcagtcttctggttgaagtcttagcggaaatgttgttactattaatatcattaaccaaattaaaacacccttagaaagagggaaaatgtgggcttacggaccacaaagcccagacctttttcatggcccctgctctgtgtaatggaagttccaataataccctcttgttaaaaatgaaaaaaaaaatcctcattaaatcttaccactgtgtatagcattcatatgacccttcacacttttagctaagccaacaataaggctggtgaattgaaactttacagcaaggtactacagacaacttgttattttatttctggtgctttgtaattatcaggtagaaaagaactgttaagattgaggaggaatactgtattagtccattttggcattgccataaatacttgagactgggtaatttataaagaaaaaatgtttaattgacttatggttctacaagctgtataagaaggatgatgctgtcatctgctcagcttctggaaagcctcaagaatcttaaagtaatggcaggagacaaaggaggagcaggcatgtcacatggtcagagcaggaagaagagcgaggaggaaggtgccacacaattttaaacaattatatctcaccaacttactcaccattgcaaggacatcaacaagaggatggtagtaaaccattcaggagaaatcctccctcatgagccaatcaccacccaccaggtcctacctccaacattagggattacaattcaacatgagatttgagtgaggacacagatacaaaccatatcaaatacccaataaaatgtcttcattgttctaagaatgggagacatctgctcactgggctgccttcccatttgaactgccgttgaacagatggaaggattttgaccaacacttaaccttaacactctggtctatgaaagttccctagcagaaggtaaagggagacaatatgaacattcaggcttattatttagaaaggacgctaatcctgggggacctttggaacaaggaaaccaaaccctatgtatcagaaatagagtaaagtagggatggagaaaacaggaagagatggtattaaaatggctacatggaattaatgataaatgcaactgaacttcacaattttagaaaagattgctttgtaggacatttccaactgtaaatcaaacactagaaagcatttttcatggtagatatgaaaagaaaacatacgtagtaaatctagtgtctcagttttcttcagtaccatcaatagcatttcattgcaaagcaaaagcaagtttgttcattttctttttgtctgagaaaggaaaaattccttactaaagaggactgtggtttagtacatactctataccagccacggtgctacagatactgttataaataaagcagttttttgtttgtttgtttgtttgtttcctgaaggtccccatgatgtagatactggcccatgaaaaatagcagatttaattgtgtacattaaaacttcactgttggttctctaagaatgttgatgctcaaatccatcaagttacgggatattgcaaggtttattctttggtttactgacatttcttaactttcaagagagattacttggttctggcctattgcatcagtgaatttaagaaaaataacattaaaagagagagagagcacatatttagggaagtaatccatttggaagagataatgtttctggaaacttgcttatttcatttgaaagtatagatgtgtatgcctcagattcaaacatagtgtgctttatcactgttatttctaagtctctgtttaacttggccctgtcacaagagcgtagacagccaggcagacataggaattgaaaaaacttgaaacttctgaaagaaactctgccttttttgtttttaatttattttttttctggtcctgttgtccccttctttactcttctaaaatatatcaagaaaatttgatttcaaaacaaaaactactattgtttggtgaaattaagaattaagttattattattatctcttcttaaagaagacttcttgccaatctgcagaattaagaagtagctactttttaaacatatggaaacaggttaaagtttaggtggaaaagaattatagtactgcctttaaactattgctaccaaattctgaagagacattaaaatggaatttgcactcatggcatgctgatagcattatttttttatgcagccaacgtttgttaatctcctacttgccagtttgataggcctaagctcacacctgacagaggcattattcttctgctccaatggctgtttgcccatctagatttcaatatttacttgcctcaaaaaaaatacagaaattgaaagaatttcttctcaagatgcataaaatttacagctaatctgtaaattgcagagctatctgtgagcacttacacatgattttgacatgttaaaatgagttctgattgcatctatagaacagggttctttaattctccccaatccctcaggtttaaactttgagcctactgtgtcttgtccaacattacagtatcattgaatgaaaaccctgaatgctttcacataaaatcactttacaagcatcttgcagaggttgaattatggctgccatttatagaaagcacagaagaatttatgcatataaataaaaggtgtgtacttcaaaatgctcactttggaagactgaactctaattcctttttgattttggacacagagccttcttatgattcaaatctgggagtcaatgctaaaccaggaagcaaaattctacagtggaagatgctcagctttttggagacaaattgacccatgtttgcatctctcatgtagttaaccattgtgtgaccttggtgaatttatctaacctgtttatggttccttattggtaaaatgaggatagtaatacttaattcatttaattaattcacagagctgtgtaagtatttcttgaagctttatatgcaaattacttggtatttagcatatactcaagaaatgttggcttatttttttctttactttcaaggttgtagaaacgtaaaagagaaccatgagggtttttttttttttttttctgttttcttttttgttaatgtgtctgtcaaggtgactgtaagtgtaacttccagggaggtgctcaactgtgctccaaaagagcaattctgaaccatggtgagtcatacagaatctagtgtgactcattatcaattagcactgtttcaagggtgtatcaaactcataccagcttcaacaataacaacaaaagagaaaacaatagttggtgaaaatagaagtttcaaggtgtaagatctgcttcaggtacagctggcttcagaatctcaaatattatgattcgggtttttccagtctgtctgtttctcactccacatttgactgcttaccgcttggaggtgcttcatttgcaggcaagatttcagtggtaatgaaggtgaaatcatcaactccaggtttaagtagcagcagttcaacattccatgtggaaagaaaacctcccacttttaaagttccagaaaactttccttatgttaagtcatgggattgagttttcaaggaccaatcccagaccatggcagtgttcaggtgattgggatctactgcatggccatggccaaattattcacccagctatggctgtgaagagagtggagatagttcagcgttaattgcatgggttgaaaacagggaaaggctacttctcagaagcaagttgagctgttcttaccagagaaagagaaagatcaacaatgatctagtaatgccacctcttcttctcttttgcattttgctctcccttttttaagaggagagaagagggtgcagttatagccatgggctaggaattgtggctcatttggggaaaggattgtgccggtgtgcatcaacagttcaaatatgttgcggtatgaaaaataatagttgagctatgctcttttaataaataaatgcatgtaatcttctttagaacaagtttatagcttccaaagtgactcctctaaaagattatttcattttaaatgcataggcttctcaaattatatttcattttgtttatggtcatacatagttctttagtaaatactaaatctccaaaccacagcctttttcagactcaaatcctcacattgtgtgtaattgctttatattttgtccagataatttttaatgatactgtctgtttgggtaataaagtattttagattcgttaatctaatttgaccttccgcatcatgaaataaatggtgtgttttagagcatcctgaaatatcagatgtcagtaatcatcctaacttcccaaacacgcatgtcttatattttctactttgtagataaccagcactgaattgcaactgggttagatgggatttttgttatttttttcctttaacaataacaagttacattttttccccacagagaaattcagtagatgatttagtttctcctcatgcaacaggaatgtgtgttatcttctgatttaagatgcaattttatttctgtgtgttaaatgaatcacctcatgatagcagtgccagcgtgctccatgctctgcactgctctgtagaagttgtctgttttttctaagagtgaaaccactctatgaatagcatgcccttgagttactcattttatatcgtcacttgcctgctctgtctatactagtgactaaaaaaatgaatgaagtaaaaatatcaatgatatgttgtttccaaatgcagactgtcttcagctgggaggagctgttagtaatctccttctaagaggggtggccttcacggatttgccagacattacacatctttgcctgactgtgatagtgaaggatgttttgtgtggtggcccagaagtcacatgacatgactctcattgatataaacttcaaattcgttctcaagcaaaaactattgagcattactatggccacacaatgtgtgaaacaaacaaatataacagcaaaaaaactgtccttgttctaaagatcttgcttatcttaaaaattaattctttcaaaggaaagttatttgggtgggatctgttggtagtattaaagtttttcaaggttttgaagtatcccgtgtaggctatgctaaatattagattttcttcactgttacaaaataatagtactaaaaatggtataatatttatagcatgctaataccaatagtatcataaaactagtagttactgttagtattattatttcataatatctttctgtatgctaaatctaaactcgttccttatgctaatttatttttcccctggtcattacccagggagataagtaccattcttatttctatttttatagatgagaaaattgagtcacagaggttcagtgactttctcaatatcacataaccagtaagtgtctggattccaagctcctaataaatcctgccacagtttggtttttaaggaatgatatgaaaatttcacacaatgcacagttcatttttctgctgagaagctctgcatcaaaagtttgtctttttagacttaatgggcttaaaagtagaggtagagtgagggagtctttaatcatggagagaggatgacacatttcttgtaagtcaggctttggaatcagctctgggttcaaattatgacttcaccactgactaatgtgacctggacaaattactaaatattccaaacttcagtcgtctcaattagaacacaggtatatgttattatgacaattataattccaaaaatctggtggtaatgcaaatgatgtgcctaggatgatgcctgccatttaataacagctcagtaaggtttgtaacaccagtataataataatataagaagccacttcatccaacctagcattttcccttttggactctaattgccttccagctaaaggtatcctagtctttatgtaacaaagcttaaattttactcttctctcccactctaggggaatgaatggataaggcaaggtgttaacatgactttaattgatgattggtaaacagtggaggtggtagtgtggacaatatatttttatttttttatttgttgttcttttcttttttttttttggagatggagtctcactctgtcacccaggtgcaatctccactcactgcaacctctgcctcctgagttcaagctattctcctgtcccagcctcccaagtagctgggattacaggtgtgtgccacctcgcccggccaatttttgtatttttagtagagatggggtttcaccatgttggccaggctgatctcaaactcctgacctccagtaatctgcccatctcggcctcccaaaatgctgggattacaggcatgagccaccacacctggccaataatacttttgataaaatcatctgaaaagagttaactagaccaaaacccacctgaaattatttaaacttatttcctcaggagtcaagctgcctctgatgggttataatcatgttatactttgtgagtcagtcaagcttaaaatcatcaaatccagtccgatgcttaaacaccccagacattaccactgtccctctccacttctcagcatggggtagtcatgaggttccaaagacaagaccccagcctcatttacggttttatcttccctgctactgtattggcagacacatattacatgttctataatgtatgttgaaggaaaacacacacaggcacatgcatgcacacacatatatgtataatgtataaatattagaactgtggttacctgaaaggttatcacactacccatgactgggcccaatgttgtgcagctagctgcctcccagacttggatgagtatctccagcttcctcttacaatgtatttttctcacgaatgtgtgtggtagtgagatgggaaatgaatgggttgggagtcagacagtgctgagctcaaaccatagaaaggttgcttcttagctctgtcatgactaacatcacctctctgagccttggtttcctcatctgtaaagtaggagtagtaatacttgctttatttatttgttttgaagatatgagataatgcctgtgaagtgtctggcgcttagtggtatttgaaaacagcagctactgttaataagatcatacaaccatgctgcctattgattttctttgcctgatatccctcttccttgccgatggctctgctattgatttgtttgccctttgcctggggaatctgggccagtgttataaatgtcaatgttgacaaggtaatgaagtaaaaaggatccaagctaagagtaatgaactccctgcggcggccttatagggacccctctgaagcttggtgagaatggaagcactgtattggccagaagctgaaagaaacaagtggaacaagcacagattagaattctaggtgctttcccacacagaaggagagggaattgaggctcgaggagtgttgtgtggccactggttactcatttagtctaccaagattttatttttgcaggatgccattaatgataataaattgagttttaaaacagattaacataacgtaaagctcactgtcacttaggaatgattgtatatgccatttatccatttctaagaatgatttgacctgaatctgtgtatttttcctttacacttgcacaattatcattgccagtgatcagtgtcagagctagggtcttgtggttaatattctaaagttctctgcctttttcttgataaagaatcacatggcctgcttcttagtgaggaaaataaataagtaaatcattctacctaggaaattctagttttagttaattcccttaaaatcaactgctgcctactctaatcaactctaatcaatcatatataagacttgaatatatgccttatctttctcacttattttcttacctttttcttcaaaatgattccatagaatataagccttgcacagagcatgcctcccataaaagataaacattatataaatatttggaatcagtaaattgctccctaacattgtttgtagataattcattgaatgcattattgaatacctattatatacaaggtgatataataagagaaaatatgaaaactttaaagaagtaaagcctatggatctttgttcccaaagtgataaaacaagtatctgtgaggataagacatttatttaattaggatataaatagttttgataagtgctttacagatggagtgtgcttaatattcataaaaagaagagatcatttctagctgagatgacccagaatgttattgtgtggaagatcaccttgactttagtcctgaagcacaggtttgacctcaatagatggagtacattccaggaaggaggaatggtgtgaaccaggtaagactgtaggaaaacaaagatagtaggatagaaacagtaaataggccatctgagagggtttcatacatgcagcagagtagagggagacaagggaaacaagaacagtccattgggagaatattacagaggacatccagtgctctgcaaaggcattcagaatctattgtgtagagaggagagagcatggaaaggagctctcgtggtcagagctgctgttatcagactctcttgttagtaacaagcaagatagaggaaagagagactggtatgcaggctatgctaatgcctaacctttggatacgaaagagatagcaatggaacaggggagcaggtgcaggtgcagtttgtaaaataagaattggaagatttgggtaattcactgggtaggtgggtggcagagtacccagggaaggaatggagaggacaagaggaaaggaaattacagcagatttttccagtcattacagagggaaataaattcgttctggtctggcctgagcccgagtttactgacttggggcataagttacaatggattataaagctgataccttaccctcttcctttgagccagctctccagtcctgctcagctgcttctggatttgagaaatccctgtcatcaagaacagggggaagagaagtggattggattgctgtgaggagagtccagttgggggccttcactgtggcgatgtccacagtagtccacagctgcatgggacagatctctcccagccttgaattttttaccattgcctgacttgtatttcttatctgtgtatgtagctgcttccttgggaaaagtgtggtccttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattataggtcctaaaactgaagcagtcttaggaaaaccagcacagcctgtcgcctaagccacactcagttcaggggttttgaatagtttaatggaactggacccagggctttgaatgccagatgaacaactgagtttcatgctttgcctagccacagctgagttcaggggccaacatccctgaggatatgctgtggtttgaataggtgaggttagaaaggagcgagaatgaaccactcagcccactgaccagcactcactgagtctctgccggggtgcagcatagagcaccaggtgtgctgagatgacaggaggggggtgtgggattgtttattcccttaaatattcagtgccctgggtggaaacccaaaattgtgtgcaagcagtaattacagaacaattgatctttaaagcatggaacttgtattcaaagggcatcattaaaagactagagaaaggagaaatcagaagtaaaactatgtgtaaccaaggtcctgtttccctactgattttgggtggaaggccagatcttctctatgaaggatgacacactctgtctagcgtatgcagagatgctgtcttcatcagagagaagtcctgcaaatatgcacatttcagatgcagatcacatcagctgctttaggtctgtgaacaggaagttccatatgtgtacgtctgttttcacactgctaataaagatatacttgagattgggtaatttataaagaaaaagaggtttagaagactcacagttccacgtggctggggaggcctcacaatcatagcagaaggtgaaggaggagcaaaggcacatcttacatggaggcaggcatgcagtgcagaaggggaaaaagccccttataaagcaatcagatctcatgtgaactaactcactatcacaagaacaggatgggagaaactacctccatgattcaattctctccctcccaaaatacatggggattatgggaactacagtttaagatgaggtttggttggggacggagcctaaccatatcaatatatatcatccattctcttttttttttttttttttgagactatctccttctcttggccagactagagtgcagtggcatgattttagtaacctgtgcctcccaggcttaagcagtcctcccacctcagcctctcaagtagctgggaagacaaggtcatactgccaagtacagctaatttttgtattttgtatagagatgggctttcaccatgttgcccgggctggtcttgaactcatgggctcaagcaatctatgtgtctcagtctcccaaaatgctgggattacaggtgtgagccactgtgcccagcctgtatgtgccaattctaacaagagcttactttatattgggagctgcagaggttactttggcttgaggtgggagataggggctttggtcatgtgtgtgggtagagtgcttctcaaaacatgagtgaaacttttatacacggagacaccaagctaagctttcagagtttaatatggaatttccagtttaaattatcttctttataactctgggtatagcaatgtttttttgtgtgtatacatgtatatgtatgtccatgtgtggtgatgtacatcctggtacaggtatgtatgtgtacgcatatgtgtatgtttgcatttgtccatgtgtgtacacatattggtacatgtacacatatattcgtgcgtgggtttgtacatgcatgtatatgcatatgggtgcatgcttgcatatgtccatgtgtccacatgcataaacacgtgtgggcaactgtgtgctataactgtattgtatatatgtatatctggatatctatgtttctgcgtagttgtgtatatacatatgtctgtgtgtgtacaggcacatgtatatgtgtgtgtgtaaatgtatgtctgtgcttgcaaatgtacatgtacacatatgtttctttctgtatagtgtctgtgaatacatgtacatgcatgcccatgcacgtgcatatgtgtatgcatgtgtgcatgcatgttccactctgtgtgtatatgtgtatgtgcatatctgtcatgtatgtctgtgtgcatgtacatgtgtgtacctatatgtgcatatttctatgtatatgtgtatttgaatatctgtacatgcatgtctgtatgcatgcacatgtgtagtcctgtacacatgtatgtcagtgttttgcatgcatatgtatgtgtgcattcatgtttctctctgtgtgtatgtgtatgggaatacttgtacatgcatgtctctgtgtgtgcatttgtttgtatgtgtatgtgcatattcctttctgtgtgtatgtatgtattcatatctggacatgcatgtccatgtgtgtgcccatgtgttttgcttcttttctgagtagtcacatttcccaatttgctttttctctgttatatcatgtgatctctcattcttgctagaggctttactcatgcttctgatgatcttggactgtgctcatgtttcaaaaggaagtgtctggaatgcattgccttggagccaccctgaagagtagggctgggcctttagttagataactccaatgtctttatctttagctcatttatcttgggacaggcacatttcctataaaaaaaactttcccatcgcttgcttagagagaaagaggttctgaaagtcgtagtgcagacaagagctggtggatgtcagggtctactaggtaaaagtccctttatgtctcattttttggtgagcacccttgcctcatctatcaacattactctcacctacctgtaataacccctcagtctcatagcacttctttattcattttccaagcagtatagttatttgggggatataaagggtactttttcgaactattttctgtttctctaagattgctttacttgcgagagaattgctgtgaagctggctgggaaagaacaaaagacttttggatgctaagtcttctaaatgtagaacccactcatatcagtcagggttcaaccaatggagcatgactagtaggagataatatattgagatttattgcacagaattggttcatgcagttatggaggccaggtatgatgtctgaaatccactgggtaggccatcaggaagtgcagctggaactctcaggcatgagtggaagttgctgcccctaggtggaatttcttcttctttgggaagtcttaaaagccattctgctcataaggtcttgcaattgattgaatgagacccacacagattatctaggataatttcccttacttaaagtcaactgattgtggatgtcattcacgtttacaacatacctttacagcagtacttggatgagggcttgattgaataagtagggactatagcctgctcaatttgacacatcctcagaccattataataccctctctttattttttattgaagtgaaacgcacataaaattaaccattttaaagaatacaattcagaggcatttagtatatccacaatattttgcaacaattgtttctatctagctccaaaacattttcatcacacacacacacacacacacacacacacacacacacacaactcagtacccattaaacagtcacatctcatcttcacccctcctcttagctcctggaaaccactaagctgctttctgtctgtattgatttacctatttgagatatttcctataaatggaaccatacaatttgtcacattttgtatctcacttctttcacttagcatagttttgatatttataatattgcagcatgtaacagtactacattcctttgtatggttgaataatatgttgtatgcatatgtcagggtgttttttaaaaaatctattgtcctttgatgaacatttgaattgtttccatattttggctgttgtataaatagggctgctgtgaacatgtgtatatatgtatttatttaaatacctgtttttaattatcttgggcatatctctgggaggggatttgttgccttttgaaagccattaacacgcgagggctagcccagtggaatcaatcaaggaaattgtatattacaaactgtgcttcccacactcttaccattctccttgtcaaaacaaagagatacttaaagatgattctggttggatttattcttttaattatcctacatttgtgtatccaagatcagggatgccacactttaccctatcaattctcaaatataagttaatgaggataaggataatcatggggtaacatcccaaggttattctctaatatgtggttcaaggagattttgttaacaactagacttggggcaagtggtggaattggaggcaggagtgtctctgcactcatagagcactgtgacagtgagcagctgccttacatctcttggttgcaaatctatcctctttgaaatgtcagagactgccagatgatctttggagtttattctagttttgaacattatatgattttgtgatgcatgaaaatgttatgaactttggctttgaaaattctgatgtcaaatctgaccccaaagtcatatttcatgctactttttaaaaggggagaaaaagagaattgaaacccaatttgctgacccaaattgataaatttctgggctgcaagcaaacctacttttcagtaggtgatgaaaaagaaattgagcttgatgatatttacagttaaaacagtaacatgcatttaataatcacatgtaaacacaagtgtgaatatcttatgatattttatacttttatcctgtggaattccaaactccccctgcttacctcaccgggaggcatagttccttacctttataactgacacctgtgcatgtactgaccacatgtcctgggcttcccatggaagtgctcctttcattgactgctggctgcaaacacatacccagccactttgactgttaatgagctctcattctcatttgaaatatatcattacttctgtgtgtggtcatcctggatactcttaatctttttcctttttcttggcatagtgaaaaaaatatggaatttggagtcttatgccaccaacttccattgtagtctggactctgaagtatggttgttaagtggaccctgaaatctttttgacagaaattcctaatttatagtactgtggtgactgaagctgtgtaagctcttagttccaactttgagtcccagattccttcaacctgcccctcctaaagtgtggtctttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattctaggcctcagttttcttatctgaaaaccaggaatcatcatagcaacctaccagagttgctctgaagattaaatagctgtgtatgtatgtattatatgcttttacacataccgcttagtgcacagtgactgctaaatatttaggtgccatatggaggcaattatagctggggaatctgaaaatgaggatgaaagaaggaactcctgtgaaattcattctagaaagaaaacttggcagaaaagaaacttcacacctcctattctctctgttttaccacattttcattcctggcatgggagaccccgtgtacagcctggtcttgcagagccaggccctgtaaagtcaggcagtggaggtggaatgggacagacaggcgagtccaagacctgaaaagccaggattgttttttgttttactttatctaaaatgcaatgagaagtcatcaatgattttttttaaagaagattggtttctttttcttttttaataattttaacttttataatattttagatacagagggtatatgtgcaggtttgtcacttgggtatattgcatgatgctcaagtttgggatatgattgacctcatcacccagtattgagtatagtattcaacagtgagtttttaaaccctttctcccttttaatagtcctcagtgtctattgttgccatctttttgtccatcctaatgtttagctcccacttattagtgagaacatgcagtgttttgttttctgttcctgtgttaattcattcaggataatgacttccagctgtatccatgttgctgcaaaggacttgatttcattctgttttatggctgcatagtattcaatagtgtatatgtaccacattttccctttccatccaccatcgatggacatgtagttcgattccatgtctttgctattgtgcatagtgctataatgaacatatgagcacatgtgtctttttggtaaaacaatttattttcttttttaatatatacctagtaatgggattgctgtgttgaatggtagttctgttttaatatccttgaggactctccaaactactttccacagtggctgaactaatttggatttctaccaacagtgaataagcttcttcttttctccaagcctcatcaatgtttgttgttttttgactttttaataatagctattctgattcatatgagatggtatctcattgtggttttgatttgcatctctctaacaattagtgatgttgagcattttttcataagtctgtcacttgtacgtcttcttttaagaaatgtctgatcatgtcctttgccctttttttttagtaaggttaactgtttttagcttgctgatttaagtttcttataaattctgaaaattagacctttgtcagatgcatagtttgcacatattttctcccattgtgtaggttgtctatttaccctgttgatttcttttgctgtgcagaagctctttagtttaattgggttacatttgtcaatttttgtttttgtcacaattgcatttgaggatgtggtcataaattatttgtcaagtctaatgtctgaaatggtgttcctagcttttcttctaggattcttatagtttgaggtctagcttttttttttttttttttttttttttttgagagaaagaatctcgctttgtcacccaggcacccaggctggagtgcagtggcaaaatctcagcttactgcaacctctgcctcccaggtttcaagtgattctgctgtttcagcctcccaagtagctgggactacaggcatgcaccatcatgcctggctaatttttgtatttgtagtagagacggggtttcaccatgttggtctccaactcctgacctcaagttatccgcccgccttggcctcccaaagtgctggaattacaggcttgagctaccacacccagccttacatttaatctttaatccaccttgagttaatttttgtatattgtgaaaggtaggggtccagtttcattattctacgtatggatagtcagctatcccagtgccatttattgaatatggagtgagataggattcttaaatatagcattttccttgtgttttcctagagagctcttttctaagctcttttctaaattttatgcttttgattttaatgtaaaatatttttgtaggcattcactcaagtgctcctttatgatatagctggtgtttattgattaaactaaaatgcaaacacacttcttgtctgttagtgctaatgccaataattgctatgataaaaatagtagcaagtgcttttgggttttattattatttcagataaggtttgtcctctggatcagtgatttttttttgtttttattaaagtatttgagtgatttaaaccaagacagtattatcgccactgttatatgtgctaggatgctgggaataaatatttcaaagacagtcacatactgtcattttttagaagaattactgagttttagtcaactggcatttatttcaccaaagctatttatccaactctattgacttatatctgtaaattctataggggtagaactttgggagtattagaaataatatacatagattttaggagaatagctctttagatttattatttttatcctgatttgagaggtgagaaaatccatgttcagtatcttgtccaagctttctctagtacatgctattggtgctctatcatagcccctgactttaccacttcaataccagctcagttacaacctccacacttgaaattttgctaaaatctttctctggtcatagaagcttgttttccctatctatatggcaatccggaagtgcccaggttttgcttcctcctgggaattatcttcagccaattataatgtgagctgatgcattaatatcttagctccctcaccatccatagagataagtctgattgtgttcttcactggctcctggagttttcctagtgagtttaagctctcgttgtccagtgctggttggttcccttaatgtttccttcccctccttatctctgccaccaccctatcagtgctttcttcacttctcaaataaactacttgcactctaatgcctgccttggtatctgcttcagagcaaatttaaactgtaacagtcaccatccattcgtcaattggttgacgtggtgtgcaaagccagatttgcttgatgccaacaatatgtttattccactatgtgatgtagccttaaataaaaggcatataaggcagaaaccccatttcgtagagcttctaattttatatagacaatacattagtgcaggaaggttgaaggagtaataaaaagagctgaatcaaagtaaaatgctagctgaaagactaattagaacagccttagtcataagctggtaagtgtatagagacatacatgggtggggagtctccttctaccgacagacatgttagatcttagaatatagtgtataaacaagtgctgtgtatttaccatgtgccaggcaatgagctaaaaagagctttaccttcattattacatttaatgttcacaaaaaaagtatgtggtagaatctattgtggtgtattaaaccacctcataatttagtagcttaaaccagtatccattttataatatctcaccattttgtgggttagaaagttaggcggatcctactagagttcttcagctacttgtgacattgactaagtctcagttgctaggtgatatatggctagtggctgggatagtctggaggatctaaatgaatttgctcacatgctgggtgccttgatggggatatctgggggctgagctcagttggcctttcttgctccatttagtctgaggacctctccacagtctctctagtaggcagaaagtaccagccctcttgaaagctagtctcagaactggcagggaataattttcaatgtgttctagtggagaaagcagtcacaaatcagctcagattcaagaggaagggaaatagaccccatcgctcagtgaagggcgtgatgacgatgatgattactgtcctttttgatctacaatatgcaggcactatattcatccccattttataaataagaaaattgagcccaaaagatatcatgtaatctgtccaaggatacaatgttaatgttgaaccctggaagtctgattccttggtgataaaaacctgttctaaaggggaaactgtgtacatatttaattgaaggcaggtgtagagaagaagaaagtttatttgttagaagagagttgaggcagggactgcctatccagcattcaatattcactatctttttcttaattaaatacagtggtgtttatggtttgttgtttttgtttttgaggaagtaatattcccaattagaaacagtacatttcctagcctccattgagttaataatggccatgtgacattgtcctggaccatgtaccaaaagcagaagtcacaagagttttccaattggcccggcttcacaattatgggcccttcaccgtccctgctttcttctccctggaacataggggtgatggctagagcttttaaagtcattaaggctatctaaggctacagtctatggagagggaagtataagtctagaaagaattctgggcctctgatgatctagaagcaagataccaaccttggactgcctaatatcagacttctcattaacctcaaatgaaataaactctgattttctttgagccactgttttcttcttgatatatgcagtcaaatgtaaatttaacttatgaggatgatttatgtttttgtactttctggaatcagatggagaaactgggaaggaaatgctacaattatagcaaaatcaacagctgtactagaagaacaatgatataaatttccaagaactgatgactctgtgagctggacaatcccttaggggttccttgccctacagaaaagtcagtggatgaatttatgtttgctcacatctgggtcactgaaaccagtttgagctccattatactggcagccacctcatcatgtagcaaagaaaaaaattcaagagacaaaacaagaaagtataacatgagttctgaagcaagagctctagataaagaattctgtaggaggcagagaagggaccgttctctttaaactgagctgggcgggaggttttctgcaggtggaggcttctggactgggccaagccctacaggtgagtgctatactgtaattgtggcatgcttgcttgaagagctaagcaggcaacctttatgcagacacaatatccaatgttttgttctcagttcgacctcaattagtatttaccgaattgaatttgtggtgtgatttgaagcgggctgcaaaacacactagttccaaaatgcctcctatacagaaatcccagaaatatgttttttctttgcatgaaggcgttgaagacttttaaaatataaatatgctgtcttgaagaagagcacagtaagcgatcatcacgcattatcaccttattaggttgccagtcagttaacaacttgtttcattaggaaggaagggtgtttgactctctgggatgggcaaagtttgctgaagaaggttaataagttcggggggaaaatgattgctaaattatgaaaaacgtgtatagaatataatttaaagattcattcactgggagcattaacaattacaaaaggaagccagtgtaccatcctacaggctgggactgggttcacagaggctgggttcaaatctcagctctgccactttctggctgctattttgggcaccttatttaatgtcttttgtttccatttctttgctttaaaatgggcagagtaacacagaagatggtccagtgtcatcaggcccttaaagcagaatttagtgcacattagagatcgatttgtgagaaatattatgcaaacagtcttcattttactcagtacagcaggatggtaaaactgaccacacaagctgaaactgggtaaagcgatcttaataagaactatggtagttccatgacctttaaaatttgtcatcaaagcagtgtgttgtctttccatgtcttaatgctactgtatgccatttctctgcatgatggtgtacttaacctggtggaagctccataattagtgtctcctagtattattatggagcaataactacaaagggcatcctgagtggaatgtaatattgccttgtagtatgagataacctgctacaggttagaatcagaatgcaggagacttggcactaaaaaacacagaaaggcaagtagcactggatactgtatataatggtcacctgtgggaccattctttttttaggctggactccagtcccagagaatagttccacttttccaaattgataacagccaaatttaggtcattcaacttaggctctctggatctttatagaggccagtatacgactcatcagaaataactgacttttaaattgtaaaaagtgtatttcataaaaatgtatatgataaaattacatatatatattagacatcagaatatgtatagcagttagatataactcatcaaaaatgaccacattttaaacacatacatcatatgtgttttattacatatgtgttaaaaaatctcacttggctttcaaagatgggcttacatgtgtgtaactgactgttggttgcctacccagcatccattttgactccctttcctttaccaagagtgctgttacttgttttagaaagacttttaacaaataaaatttgcaatatgcttacatctgtaataaaaagtagataatattaagtcactgaagatgcccagtatggcttttacatttttttggtgttcttaacttcacaacttataattcttcattggagtaggatatatttctatgattaattttaagctttgctaaaaaacctctcttggaatatgcagtacccttgtcttgctcatttcctttaataaagtaaacaacatagctgtaaaccagtacacatgagtcatttattctgactccacatcaagtaaataatgaacaacctaggaggaattatttttgtttctttcagtcccaaagaaatgagattttatatcaacgtgcaaatcctgctgttttttattttcttttttctttttcttttttttttttaagacaaaatcttgctctgtcaccgaggtgggaatgcaatggcctgacgatggctcactgcagcctcgacctccaagtttcaagtgatcctcccgcctcagccaactgagtagctgggactacagaaacacaccaccacacctgcctaattttaaaattctttatagagacgagtcttgacattttgccagggctggttttgaactcctgggatcaagcaatcctcctgccttggcttcccaaagtactgggattataagagtgagccacagcacctagccttcaagtcccagtcttaatgccaacaaagtgatttttatataaaaataagcagaattggcattaggagtataatacctaggagttttaaatttggttatgtagctaaggttttactgattcagcactcactgtcttacatccatccaggggcctttacataatgcatgttatcaagaaacccaattaaaaagtgaaaaattaatttagccaggtagttagtgttcagttgaaataatgaattctcaaatggtagaaggtttgtttactgaattgacttggttatattttttttacttcttgtatcattaatatctacctatcatctatctatttcttcatccttttatctgtcagtatgtgtgcatttttatataagaagactcatggaagacctgtgaagtgccagaccttatgcaatgtcgacccatttgatcattcaaaaacatttatttcccaacttctgtgtccaaggtactttgctaagaagtaacaccaggtatggtggctcacatctgtaatcccagcactttagaattctaaggtgggaggattgcttgagcccaggcttttgagaccaacttggcaacatagtgagaccctttctccacaacaaattttaaaaagtaaccaggtgtggtggcatgtgcctgtagtccctgacactgggttggctgaggtggaagcattcttgaacctgggaggatgaggctgcagtgaaccatgatcttaccatttcacttcagcctgggtgacagagcaagaccctgtctcaaaaaaatagagaaataggtggttagttacaagcaaaacaggaaccctttcttcaagaaactgatgatctagagtggtacataaaggaagacttgataaccacacacatggacacacatgcaattatgaagttagtggaagaatcagaagggaaatcaactgtttttagtgatagagaataagacagtgggaggagggaggggtgctccttaggaaggtgcccaaggaagtcctctgtgaggaaaggactttcagtctggcacctgaaaaaaaggagcctgtcatacaatgcttgggggaaggccaatgggcactgtgaagagtcggtgcatgggccatgccttgtaaggcttgtggagtcactgtaaacagaacagacatcgtgatgtgtggcaaccgggcttgcattgccattccggttccatatcaacagttcatttagttttaggtatcaaaatgctgagaataatgaagaggaatattccctgtgcactcctggcaaagttgtaagaaatattaatgaagttctaatcagaacttggtttgcttcatcaaagagagcgttctggataacatgttgtggatgtaaatgtaaaagtaaagaaaatatgtttatcaaggtcaagaatgaagaagtttgaaatgcatgcacacacacacacacatacatgaatgtcactgattagatgccattattgttgatattaagagatatttattttttcattcactaatttattttactaatattggcttgacacttactctgtattggacactgtgttctggttgatgtgaatgaagtcttgaaaaggacagcctttcttaaagcaagaaggggaggacagacaaaatggcaaagcaaaggcagcctaatagaattaagcaaaatgccttaggaatatggaagttcttttttttttggtttcttttgagacaattttgctcttgtcacccaggctggagtgcagtggcccaatctcagctcactgaaacctctgcctcctaggttccagtgattctcctccctcagcctcccaagtagctgagattacaggtgtgcaccaccatgtcccgctaatttctgtatttttagtagagacggggtttcaccgtgttggccaggctggtctcgaactcatgacttcaggtgatccacacgcttcggcctcccaaaattctgggattacaggcataagccaccgcacctggctaagaatatggaagttcttaacttgctttaactcctacctatctcttcagtgtcatcttttgccttatttcagacagagttaacttcatttttcagtgtcttaaacgtgacgcactacttctctctttactttgtaaaggttttgttttgtgcctgaaacatgtaaccatcttctattcatcatttaagcctttatttgaatatatttattccaagcaatcttttttaaatcagtgtttctcaaaatgtgttccacgaaccatctatatcataattacctgaaaatgtgttctttaaattgcaggtttttgcacacatccccaaccacaccctctgaatgagtagggaaccataaatatacatgttagtacattttcctgaaagttcttttgcattctcagtttgatcactgttaccctagatttgtcaggggtctcttttatgtttccatggacataatgatctccctctactataagatttattgcctgaaatctttgctggtctgctaaattaatccaccaatatgattgaaagctcacagagataggaggaatgtgtttgctagtcattgtaagtccactatcaaacatggagctgtgtctaggtggccaataattagatgtatgttttgcagagcaggtacagaagttatccaggtcataaagggacagaacagtcttccaggcagagagaatcatgtctgagcaagttagctcagatcatacacagcagacaggttggatgtgtagctgggagactgggtgttagtgagtgaatggctgttaagtcaggctagagaaataaaattgtgtttagcttatgaacaatccatacctacagaaaagtgtcacgcatagcataatagaaaaaaaagggtggagggggcctatggccatgaaacctaggtttcaggcctgaattggccttggactgattaatttactttaaacaattacttgaccttatgtgttttgtctttccaaactggaagttgtgtataattgtctcactttctcactttataaggaaaaatatttacataggacatacaaatgagcatactaagataaacataaaagcagtaagcaaatgccaagtgtgtgtgtgtgtgtgtgtgtgtgtgtgtgtgtgtgtgtgtatgtgtgtgtaactaaatttgacaatcctctttcaggattgaaagatttatttatttcttggattttgggtcctccttgtagttaagttttcaaactgtttgtcccttacctgaaagccacaatgaactccagagggaaaaatttttacttgtatatacttctcataccttccattaacattgattctgcttaactatattttaccttgatacaacattttactcttataagcccctgttgtatgggtctgtatggttttgtgttgttacacttcagaattcaagtgtcataagtaacttttcacacatagaaaatgtcatgttacaatccagagcaatgtctgtttttagcgaatttctgatcttttcgtgtttctttcatataaaaaaacacacatacacacacaaacctgcctgcacaaaattatcctggattcattctatcactctcttcctgtaaaacaattgcgaatgtgtaaagtgttgtgcattctgaggctacacttgactctttgctactttctctggcatcacagatctactagatttaatagaggagcatagctttacttacaagaaataaaggtgtttgcaaaataatgtagaaagtcaaattttaaatgcccaaaaacgttagtttaaaataagttaactaagtcattcaaaatttgagtgctacatttgttcaattgtgaatcagtagtaaatggaaatgtagtagagttccacagcaagcatattagtatctacaccatagttctaaatgcaacagtacttgggcatgttgaggggcactgaagccaggcaacagagcttggaactgatgaatagtaggaggagtaaaagattttactattactgctaactaccactccccccggcctcctcctcctaacagtatgctttcattatggcgatatgttagtcaaaggatgaacatttagttagactggagaataagttctggagaaaaaattcaagggacctattgtgcatcatggtgactgcagttaatatattatatatttgaaaattgctgacagtagattttaagttttttcacaccacacacaaatggtatataaggtgatccgccatgtcacgttaaacatcttgacttagccattctacaatgtatgcatatatcaaaacatcatgttgtgcaatataaatatatacaaaaaccaaacaaatacataaaacaccaaagctgcattaatggttattgagctataaatttgatttatattattgtatttatttctgacataattcatgtggtaggtactattatccctattttataggggataacattgaagaaacatggaaacagatatcatatgggcaagttcatgattcatcaacttaggtagacctaatttccaacctgtacctatcagcagctcgtgctgtttttacatcacccttggaggacatggggctaaaatcaaaagagaatcaagaaccttattttgatgatatttaaaatgtattgagtgacagaaactaagtcaatttcaaataagacatttggatatgctgttgttttttctttccaagatgcctttggtttcttaaggcagtgacaagacttttgaacattgtaattctttttttggataagatttttatgttagtagaaaatcttgggaaaaatgaaacagggaacactggtatttttcagtggtgtcgcctttgcttgcattcccattttgtcagcttttgaggagccatattcactattaagtttgtcttcaacatccattctctaacacagcacatgaaacagtccccttatctaactccacatgaatctaatgtaattttaacctaaaaacagaaaaatgaattaggaaatacatttgtctttaatgtaatacagagttcagtgaattctgtgaggcacttaaccaaaataacttgtgctttccttagtttttgcaacccattttttagataatttatgtaaaattattttactctatacaggagatattttggagggttttttttttggaggctgcattgcttaaatacagtttggcatttaaaatcataaagacttgggtttaaatctcaaccctgctacgtgatcttcagtacatctttgaacttcttcgagtcctagttacttcatttgtaaattttgaaggttgagaacacatatccggaagaacttttgaggggaatagaaataattcttcgacaacaattattgcagttgtatgtagctactcagtgagtggtgaatgttgagtattttgcagctttaaaagtattgtttttatcaaattattatagcatactacatatcagttaatgctattataagaaactaaaatcatttagaacctttctaacttttgtcttatttttgttttttttcctctccatctatgtaagaatctgagaaatcatgatctcgagcatcatgcagagcatattttctcctatcagggattcttgttctttgcatttcttttcagaaacacctcaaggtttctgtccttatagtacatctggaagaagcacacttccctagagatagggctttatttaaaacatctcttcattcaaggtgagaatgtcatttgctggcatttcccccgacttatcaatgtgcctattcttacatctggagtatgtcatgacagtcactatagtgatgtcctccaaggacctggacactatgtaggcttctttcccactgagtcctgggaatgagagctggcaatgttgacttagatccttcaggcagaactacaatgacttgccattttccatgttctgaaatcctacaatgcaaaaacctcatgatagtttatgctcctcttcccttgtcttctgcctcttcctctaaatatttctgatctttaactctaccaccaatctgtagctaatgcatattctgaattgtatctgggtacagtgagttctggtgccaccagcaaaaaacatctagtccattaaagttttttgtgagatgctttatgtgggacacagtcttttaatgctcatcataccaaacaaacatatgtgatcctttcatgaataagtagcaaatatataccaatgctgtaggagatttatttgaatatttggaagatagaagttttctcatacatctcagagtccttttatatttgaagaagtgacacttcacattattattggattttcattatcatttttgggaaagttctcacaaaatctcagacctgaagttgtagacagaattatagagcacaaagatgtctgtgtcctaatcctcagaacccaagaatacattaggccatgtgtcaaagaggaagtaaagttgcaaaagtaattaatgttgctcatcagctgtatttgaaacaggaagataatcctgtattatcaggatgaattcagtgtaatcaaaaaggtcctcaaaagtgaaagaaggagatagaagagaattataggttgaagtaagtatgaaagaaaggcacagagaaatgtaacattgcttgccttgaaatagagaaggagtctacagaagccatgggatgtgggtggcttctagaagctagaaaaggcaaggaaatataatattccccaagagtgtcaagaattaatgcagccttgctgatacttgatttttagcccaatgagatcgatggcagacttcaaacacacagaactgcaagatagcacacttgtgttttaagctctttaaagtcatttaagtttgtggcaatttgtcacaccagccacataacaatacacgatttgatttttttatgtgaaaagacagagatgataagttggctcagtttacatgggtgttgatggaggagagtaaaattagagcaaaacttagaaaaggcattattaaaggaggttaatttctcattttcctccatatccttatcatacctcttaatgttgccaacataatgcatgcttatagatcagtggaggctctttgaccatttatgaatcaaaataaaattataatctatgccagtagatgagagagtccctactgcctttcagaaaacaaacacattatcttaataaataaccatctcggtacgtgaagactattacaccttaggaaaaaagatggctcattatgcattgcagttttatataattgcatcatagcagtttgttcaattgactcttttaagaaaaagaaatggaatactgagtaatcttaccaccaatcttgaagaaaacaagacatttgatcttgctatgaatcccaaattattgcatgtccatcttttataaagtctcaaagatactttaggaagttgaatgctgtctgctgtcataaaaaacccatgcacaccaatcagttccatggacagaaccaagcaggtggaaatcttgaatagaaggtcagtctacacaggtggcttaaaataatttacacaataaatctttggaaggacaacattgacttctaatccctctacctctttattttttttctcttgctacatttttgagtgaagtgttgtaatgaacatcatagggtgcttgcactaatcaccagtatccaaagataaatgatgatgcagataatgatacaaattttataaagcacctaaaatacagaacagatttattgtctttgttacagttcataaaatacatgaatgaaaatttagaagttggggaaaatttttatctcaaagcagaaatggccctgacaattttctatgaaatgtagttgatatattgatgcttgcattgggagtggaggtggggaaaggagataaagagagatagataggggagggttttctttactcaaacaataacaaggtaatttctgtaattttagatactactcaaagaggacccagcatataatttggaaaaaacaaaaaaagtaaaggacttctgattatcttttacattgcagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcaggtacactcaagagcatgcacaagggagcttctgtcactagcactactttttgtgtcttcaagaagcttccagattaaagagttggctaatgtgactcagtttttactttgtataataacaggtggctaaaaattatgactgatatttcatgggtgattttatacatatttgatgtagttttatttttaatatgatgagtaattaaaactaaatgcatagttgtgtactttgcttattatgcacgtatataatgcattgtgtatgtgtgtgtgtgtgtttgtatacatagtcactactgttgaagtggatactgctccgagaattgaggtatttagagaacagggaggcagcaagctggtacctgaactaacatgataattcatgtgattaaaataaaccttttttagctttattaagaaataattgacaaataaaaattatatattttcaaagtgtaaattgtaataatctgataaacatgcgcattgtgtaattactatcacaattaaattaatcaacacatcactgcacagttaccctttgtgagtgtgtgtatgtgcatgcacatctgatgaggacacttaagattaactattttagcaaatgtcaagtaaacaatacagtatgaataactgtaatcatcatgctgtacattagttcaccaaaatttgggccaggtgtggtggcttatgcctgaaattgccgcactttgggaggcaaacgcaggaggatcacctgaggtcaggagttcgagaccagtctggccaacatggcgaaaccccatttctactaaaaatacaaaaattagctggccgtggtggtgggcacctgtaattccagctacttgggaggctgaggaatgagaatcgcttgaacctggaaggcagaggttgcagtgagccaagatcatgcaactgcactccagcctggggtatagagtgagactctgtttcaaaaaaaaaaacaaaaaaaaaaaaaccaaaatgtatcatcttctgactgaaagcttgtactctttaaccaacaactctccatttcctgcacacaccagctcctgacaaccgccgttctctctgtttctatgagtttgacttttttagattccacatataagttatatcatatagtatttgtctttctgtgtcttgtttatttcaaattggcataatgtcctctaggttattccatagtgtcacaaatggcacaatcttttttaatgctgaaaatttccaattgtttgtgtatatgccacaatatctttaatcatttaagcattaacagagagtttgtttccatatcttggcgattgtgaataatactgcagtaaacacaagtgcagaaagctgcaggcatctcactccctgatttcaaactatattgcaaagctgtagtaataaaaaaaaaagcataatactggcataaaacagacacatagactaatagaatggaatagagaagccagaaataaacccaggcttatttaatcaactaatctttggcaaaatttccaaaaatgcataatgaagaaaatgttgcttattcaataaattgtgatggggaaattgaatatccacatgcaaaagaatagaattggacctttatcttataccatataaaaattaacttgaaatggattaaaaccttaaatataagacctgagactgtaaactccaggaagggaacataaggacagatctccttaatattggtcttgaaaatatatatatatgtttacatgacaccaaaagtatgatcaacaagagcgaaaatttaaaaaatgggactgcatgaaactaaaaaaccctctgtacagcaaaggacacaatccacaaaaggaaaaggcaatctacagaattggaaaaagaaatgtttttaaaccatatgactgatgaagggttagtatccaaagcataaaaagaattaatataactcaatagcaaaaaaaaaaaaaaaaagaaagaaagaaaagaaaaacacttcaaaaaataggcaaaggatgtgaatagtttttttttgtttttttttgtttttttttttttccacaaaaggcatacaaacatccaacaggtacatgaaaaggtgcttaacatcactgatcgtcagggaaatgcaaaccaaaaccacaatgagatgtcacctcacagctgataatatgatggttagtatcaaaaagacaagaacaacaaatgttggagaggaagtacagaaaatggaacccttttacactcctggtgggaatgcaaattggtacagccattatggaaaagagtagagaggtttgtcaaaatattaaaactcgaatcctatttctgaatatgtaacgaaaataaattaaatcagcctttcttaaaagtagaaaaaacccacagcaccatcatccatacattctctgcttcactaccctctaagtgccttttctatcttttcttagtcactgtcattttgggtgtctgaaaatgtatctgggattttgtcttaatcaggtatgataaggtgacaggcatgagatgattgcctttgaaagaaaagtttatttcttacagttctcaagaaaaagagatacattctaccactcagagccacatggagaagtgctagggttggtcaggagggagaaagagaaaggggaaagtgtggtggggtggctgtgttgcagcttccatgggaaggaatggggtgaaccaggtaggcaagcttgagccagttagaattggatagtttgaataatgtgggcaggatctgcgctacaggggtggtctctagttatctaatacctaatacttggccttgagtgatttaaggcaagagaaatactgggttgtgaatgtgagttagataaatggattagtgtgggagatgggctctggattgattggtttgtgtataaaatgcatgcttgcaggcctattgtttgctatctctaggaatcagctagccctgagaggggcagtgtctccctggccagcaagatcctcaagatgtcaaagcatcataaatactgattaaaaaatgactaatacactgagataaaaccaagacatcaacatgtatcaacaagtcaatataatatagatagaaacagtgatagtgtcttcattctgattatgctttaaagtggtttgtatatgggtgagggagtattatcagatttttctaggatgctttttctaaatccatgggatatatattttgttcagattttgctgctaatattggtatgaaatatgggttttgcaagtagtggtgatgaagaggctaggtctgagatgtttgataaagctcccattttactatggtattgttttaccctccccttgcttcccagcacacactaagaacaatagtggtaggtgttgaagggttctggaccacagtaattttctattacaggcacaattcccccagcagtggtctacgataggtcatgatgtgttagtaggaagataaaaggtgggacatcttattgcattaaacaagtctaggagattttaatatcttgggaaatatattgagaaacacgcactctcttttatatggcaggactcttagccaagacttttagcctgagatctgtagtgcccagtccaatattttgtaaaaattgagaaataaattttttaacaaatttggtaacctgagtaggatatttaaatatttctatctatctactcttccagcaatgtattgcccactcctttactgttttatgtttcaccattttattcttcaaatatgattttgagttctttcaggtaattcttgtgattctcctgttaccttattcatcacacatcttttaagcagctacttagtgttaacttccatagttagtggagataacaaaaaataagaaacatttaaagtccctaattttagaaatctgtaaagatgatggaaggcaatggttcagggaattagggtgtgtcattggatgcccggcactatatcataatacagtgtgagcaatgctaaaggaaaaatatgaacagagttttgggttgtatggaaccaagaaaaggcagtaaatacattttagatgaactaatgatagatttataaataatctggtcatggcaatgcttagggagaagggtttgcaatgttcagaagacagaagcccattacaaaaggaaatatgtaagttaaaattcaaatttctggtacagtgtagcatatttagtaatcagtgaaaacccctcacaggtaaatcattaggtgcaagtgtagaagtccaacatatttcagtaatgaggagttcttatggaatgttagctctctctctatctctatatatacatagatatttcatagagatagatacagatagttgctcaatgtctatctatattattatagtatacaataaattctattctataagaatagatatatagatatagatatgtatgtataatatatacataatatatagatatagaatatataaaatatatagatcttgatctatatctataattatatctatatctatatttatagatcaagatctatatatatgatataaatagatagatacatttaagctgagtcattctttttttgagagggggattaaaactaaaagatagctctaaaattgttaaagacaatttagacacactgtgaagagagaagtactattgaaataaatgaataactaccccaagggttactttgccgaaggtgtccattaagcatggatataggcatggtatttttaacttttgtagtcatgttactgaagctgtcatcatactagatctgaagtattttatttgtagctttaataaatattagttagaattaacaagctgggttaatatatattaatgtatcattagcaaaatttgctagaaatggggaaatctgttgtgaaatcaatgttaagtaataaccaaggttattattttggttaataatgttaaaagtagtacatagactcaataagggagaaaccattgtaagtcggagtaagaaaaaaaagccatgaggctggatgcagtggctcacacctgtaatcccagcactttgggaggccaaggagggcagatcacaaggtgaggagtttgagaccagcctgaccaacatggtgaaaccccatatctactaaaaatacaaaaattagctgggcatggtggtgcacacctgtaatcccagctactcaggaagctgaggcaggagagtagcttgaacctgggaggcagaggttgcagtgagctgagatcacaccactgcactccaacctaaatgacagagtgagactcagtctcaataaaaagaaaagaaaagaaaaaaacaaaacaaaacaaaaaaacagaaaaaggtcatgatctaataaaccataatggatgattcagatttgaatacagtcatgtaccatgtaaagataatggtctgcatagacagtggtcctataagactataacggagctgaataatttctatgacctaatgaagttgtagcaatcataaggtcctagtacaacgccttatccacatgtttgtggtgactctggtatgaacttactcctcaataaaagcctcaggcattttcttcaggaaataactcagaagaaggcattgttatggtagcatgtggtacctcttgcatattgttggccttgaagacctttcagtgggacaacatgaggaggtggaagacaatgatattaacatcatgaatccacataagcctgatctactgtgtatgtttgtgtcttagttttcaggaaaaaagtttaaaaagtaaaaaataacagtaaataaatttaaaaatagaaaaaatcttctagcaaaaggatataaagaaagaaaatatttttgtatagttgtatgatatttgtgttttaagtgttatgacaaagaagtaaaaaagttaaaaaaataaaaagttcacaaagtaaaatagttatagtaagctaaggataatttattattaaagaaagaaaaaaagtcaataaatgtagtgtagcctaagagtaaagtgtttataaagcccgtagcagtgtagagtaatgtcctggaccttcaccacttactcactgacttgcccagagcaacttccagtcctgcaggctccattcatgataagtgccctgtgcaggtgtagcatttatttaaatctcatatttttactctgctctttctatgtttagatatgcttaggtacacatatactcacaaatgtgttatagttgcttatagtattcactacagcaacatgctatacaggcgtgtagcctgggggcaatagtctatactacatgtacagcctaggtgtgtcataggctgtaccacctaggattgtgtgagcacactctatgatttccacacaacgacaaaattgcctaatgacacatttctcagaatatattctcaccattaagctacacatgactgtatttataaagaagcaggaggcattttaagtaggtggagtagcacagggataaacaagaataacaagcacagtggacagtgtgatacaggagatctaataactaaatattttgaatttcctctcttcctgtctccctccctccctttctttcttctttctttcctccttgtcttctacccatcttttaccatacctcatcccctctctccctcccccttttattgactcctctgatttctcattttccttctctttatctgcccgctctctctctgtctctaacacccactatcatcattatcaccccatcgttatcaattggtgacatatatatatatatatatatatatatatatatgttcttctccatgtatgtatgcatgtatgtaggtcatccaggtgtacagagatgattaataatatcaatttccaactccaagttttttccaccagacccaccttatcaatgtcaccagttctgaatacctgctccatggccagcaccttctttaattacaatacccttcccatttgaccccatcagcctctctctcatgttgatttgtttctgctccgatttcaagagtcctaggaaaaggccacccctggacaccacaaatggcataaactaccacactcccttcacttgaagacacaataaatacttaccaaacatctttcacgtgtgtctccacatggctgtgtggcaagtgctgtggtatgaagaattgcgtgtcttggttttttcattagcaagcttgaggtcccactcgtgagactaggatgtgcatgtttatacacataaatgtgtatgtaattaatagtaagcaaaattataagaagaaacaagatttagtgagcacttacgttgtatcagccactgttgtaaaaacaagtatattaacttgtataattcttacaaaaccttttaaggcaaagactatcatttttaccatttgacagagaagaaagtttaaatgacacctgacaggactaatgatgtcatatgggggcttgagttctgttgctgcctgcacatcaccaatcttgatatttttcaagcagcagagaggagtaatagaaagactctgagtgcagtagttggatagctttggtgtgaattttgcctctttcatgaatgatctgtaggacttggacatgttatttgattgtttcaatctagtttccttatttgccaaaggggaacaacaatactcatgttgtagtcattttccaatgatcaaatgatacaacaataataatcatagtggctacttataagtgtatagtagccacaaggtcctgaaaatttagcatgcattatatacacacatataggtattactactctcctttaatacatgtgcaaatttatatttaaaaagaggtcttcctcaatgtcaccagaccaacaaacaacagagcaaagactcagattaaggcctgcgtacccttaaacttgatgctttttcttatatcatatatggtactgtacacacagtacaatttctctctcatcagtgaggcctgctcctgaaggtgttaattctccagcacttttgttctttactgtcaataaactcaggatccttttgcatctgaagaaaactctcaagcagagcagggcatcatgcataggaataggaactgtccagctaggcaacaggggacattaggagcagggtgagggcatgtggacaggataccaccatcctctgttttaaccccttatcttacaatttgcacataaacaaacagggccattgaactatggggtgtgagcagtgcacttcaaatgctttctgcttgtgcatgttttttgagttccttgcaacatatcaactcacaactatttgagggcacctggtgtaatgcacaggtgtgtcattccaggtgggccacactgtaggcttcttgccagtgctttgagtgagaagtaaagtcccatgtcttttactcctttcagatccttttgggaagacagatgagcgggaaccactcacaaatgctgttcgaagtgattcggcagtcatcggaggtaaacaattcattgttgttgaatgcaaaaagacataaacgatcctgtattctggagaaagttatctgaagctttccttaattatggccatccagcactcagagccccctacattacctgcaagactgtgggcttttcatgagtagtcctgtgtgctgaatgatcaaaagcaccctctgccgacaccagcagctctgcggattcatcttgcctctgattcatgaggcagctgagcactgagtcaacagctggagcatttacttacagacagcagctcacattctgctcatttcatacagttttcactgtttctaaaatgcaaacaaagcaaaccaataaaactaaattcggggaagaagccatgttggggcagacaatgggtgaagccgcagtcctgtggagtattccccaccaagtgatttgggttaggtctaatgagcagggtgaagcccacagaactgtagttgcaaatctcactgcacatatggttacagatgcagaccttgtctgctctgctgtgagctcagctctcctgcttttccattttctcattgcctgttggcctccccacttttttattctgcttcagcttggcttcctcctgctgtggcttgatttttccatctgggtctaccaacacagaatgattcccaagctttgcttcatgtaagatgcctgtgaaagaccaaactcatttctatctgagaaacataaccttagcaggtgccgccatccctgccttctggaagcctagatgaactgatccttggcagatggcgttttccttttaaaaacctgcagtacctctccatttagcttatatttaatgagccttgctatgggtcaggctctgtgctaagtagaggaatatggggatgaatgagccagcgaggagatgggtaaacagacaacaagacaaccagtgaagtctgttctgagggaggaggtacaaatggctatgggagcacagaggtgcactcctgagaacatgaagaaaggaaaaccacgcctttccttaaggaagttcctaaaacttctgacctgaatttttgctccagagaagctggaccaccttaatttttgtttggcatagagaaatgtgggaaagaattttgtgcctatttctctttcaataatttcccatttgacaagtggaaaaagaaagacttttgtgactgctgactcctctccagctatttacgtgctctatgagtctctttaaggacagggaagtcatctgaccccctaggaaaattcctggaggcttgcacagctgctgactctgactatcccatgcattgaaggagtaggaaccagtttcctatttcatctcttaatgcagcatcccactcatgggaatcactcactaccacccagtttattcatagacttgctaacttagatgattttactcttacttgttctaacatagttgtagaaaatgccacaaaatgatttaggaacatatatttataaaaataaatcttaatcatggcctcagttctaaaaaaaattggtggaagacatgcaatccatttatgaaacttacaaatgtccatgcttctgtaaatcataattcattatgcccaaaaatagctttctgaaatagacacttttcctcaatatctcctctccttagaaaaatgaaacagcaaaatatagaacttattacaagtaaattctttgcttatcatacatatttttaaatattttcatgctgaaatactacattcatgcagagacacatctgccgcttccatgttttcactattcctttattgatattgcctttcatgttccaagagccttcctggcaaaggtaggggtgagaccctagggtaagcaagaatagcttgcaacataatccagttaaatcacacacagtcagaataaaggggaatctgatgggtctggacagaggtttgccatctcagttgactttgagtttctcaagaacagaggcatcttgtcactgaatgagccttagtttaacagagttcagagcagtgtaaaaatgttctaaatttatagcgatcatttcattattaatgaaaatgttttagcaaaacaaacgtaacataaaacaaatttacatcaggagagcatgtgttaagatgtgagatatttaagtaccattttctaagatgctaaagtaactctgaaatacttagttgtgaggtgacaaaaaaatgggctaattacaaatgattctgacacattatttatagcagacttgaaaaatttacaaagaaaccccttgctagtccaattccatatgtataagatggtattctcagttctttaaacaaaaccttctatggttgaaagtgtctctcgcccccagttagtctgaaagaaggaggttttatagtaattgaagacagggcctttcagcaggtctttatttctgggcaggtggcagagttgcgtttgtgtgatttgttttgttttgctttctctcctacgcattcccctcatctggagggaatccactctcctgagcagatgactcatgacgatttccttctctctttccttcccctttctctccaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaaatagtacccggttcaatgaaagagcctaaaccatcttaactcagcttt

SEQ ID NO: 184 - DNA, 25033 bp, Homo sapiens
tatatggaaagaaatatgttagaacgtggtgaagctgaatggcataaactgttgattgaagaaagagcaaggaaggagatagaagaaaaattaaacgaagccattctcaccttgcaggttggtttatttatctgtaatgtgctttcattcatttcgctgcaaattttattttggatatatacattgtacatgttttctctactttccttacagcaatttgtttggtagacttctagaaggaaggtggtatttgtttctccatttaaatatttttgtttccatcattcttataactaaattgatcttccataagaataattctcactagagaatcatttaattactaaagccagttggcataaaacaagactaatagaaaaagtaaaaaaaaaaattgtgatttagaaattataccatactcttgaactgcttttaagttacgttgttccacttttaaaattttaacttggttctgtcattctttggagaattgttcaacaattcagattcagttattaattcagttggtactggtcataaatatgttaagcttgagcttctttctttcttcacatttttcttaaaattgttctctgaatcacgtacttaaaattgttctctgaatcactgactccaaacaaaaggaaacaaatacacagtaattattcaggttacaattacttttaaaatgttcccttttaatttattttagaaacaagcagcagtatctcatgaacagttagcacagttaagggaggataatactacttcaataaaaactcagatggaactcacagtcatagatctggaatctgaaatctccagaataaaaacttcgcaagccgactttaataaaaccaaattggaaagatataaggaactctacctagaagaagtgaaagttagagaatccttgtcaaatgaactcagtaggtaagtcaatatgcagaatcatagaaaataagttaagctcattaatttgccttcaaaagcatgacttttagtgagacaggttcatgagatttgtgggaagtgaaagctaactagatcatacaattttggaaaattgtaaattatatatagtaaatgaacttaacctttaagtaaaattgaaaatagtaaatgaacgtaacctttaaaatctttagtccaggacagttcctgtctctcctgttttttgggtttatgtggcttccccccaccccttaatattcttatatagttaacctgatctattagggtttcagctaaatatttatgaagcttcataatttagacagtgataccattataaaaattgcttgtcagtattcccttaattcaaaatactaatgaatttaattaatttctggaagacgacagctgaaaaccaaaagggtcaagtacgactactctggacacattctggcactcagtaaattcactttgcttgattgtgatcattagagggtgccttgagaagaagtgtcctgtatagtttttccaatccacataaaggcacacttgtgaagcagagaatgatcaactagggttgaagggaagtataacttactaagtgataaaaaataacaccttggtcagcctgagggggtatatggaagacagaaagggcaggccccacctctgatacatgggccgcagtgttaggagctgattgtcctccatgctgctttagttctctttgatttcagcagtcttattctccccaaggaaaagtcgccgtgaatgattcctcagtgccaaatgctcaagtttttccagataatgggtgaaatatacaagggtggtgaaaacaattgtttgaaaatgtctttgagagagagttttttagacaatctctaacaacatgtattgtttactaaatacaagtatttctagcttttatttttacttttagttttttcttgtatatatttaaggagtacaacttgatgttttgatatatttatacgcagtgaaatggttattttgtcaagcaaattaatatcttcatcatttcacatagttacccttggaatacaagtaattctaatggcatccttaagaatcgtataagtagagtcattccagatgggcaacaagtgttaactatgaagccatacatcattgatagtcttttctgtcccctccctctctttgaactacttgtttgttagaaatccctctagaaatagatgtacttctttagaacaatgttaaaactataattggatacagtaggcatgctctaacacattttcagagttaaaacacggcttatggtatattccatttactcttaatggcaacttttagaacaatcgaagtcatttaggaatcatttaggaaaaaatgaaatactaagcatttgtcttttgcaatcttcatagaactaatgagatgatagcagaggtcagtacacaacttactgtggagaaagagcagaccagatccagatctctattcactgcttatgctacaaggccagtcctagagtcaccttgcgttggaaatcttaatgatagtgaaggtctcaacagaaaacatattccaagaaaaaagaggtctgctcttaaggacatggagagctacttgttgaagtttagctatcttttttccttcggcgttcagatttctgatagaattcttgtatgttatttggtaaaatactcagttacttaattgtcttgtgtatggtaagtaaaagtaataattacctgtgttaataaagagaggagacagaaattttacagttattttcaagtctctggagctctcattcataagagattactcctttgttaactttatttaataaatgtaaccaaactgacacattttaaatttttttaaaaactgcatttaagttagattttaaccaaaggtttactttgatgtgctttgtcttactaattgattttagtttgtctggggttcacttttaatgggtttagtgtgcctggggtcacttttaaagtttttctgcatcatctcaggttttctacccgtcatcatatgtgaatgattggtgtccaaacactaaccacccatggatgtttattatttaaaaggacccaaggtgaacacttttatatgttatataaacctgcaacacttgattaatctgttctttaagttaaaagttttgtgattttcttacatgagtacatctgtaattgctattgcacttaatagtgttttaatcccaattttagtaaaatgtgtctgttgctatgcaatagcacagtggttttgaaatagttaaatcaaataaatatttgaatttttaaagtaaagctcacataagttttgtctctctacctggccataactttagtaattgatgactaagatggcaatggtatctagagtccttcaatagcaaatgtgaccaaacagaatcagttctattcttaataccccaaattccatgtaaagctgcacatggacatctcccctggacatgtaacaggaaccttttagttcaaccgtgtggtttcactcagagtaagagtctatttctggggatttcaaaatggatccaaaaatgacgagctgtatcaactatagagttggtaaggaaaaaaaaaaacaaaacgtagttcaactatgcttgacccagattaaggtatttgtctaacatttgtccatttttcaactgagggaaaattacaaaaactgggcacagtggcacacacctgtagtcccagctgctcctgaggctgaggcaggaagatcacttgaacccaggagttcaaatctgcagtgcgcaatgattattcctgtgagtagctacggcactgcagcattccaatctgggtaacatagcaagattctgtctcttaaaaaaattacaaaatccataaaacatttgtttgaacaacaatagataaatagttttctttgtgtatattgttgtttttaaaattttcaatcgatgcacattggcttatagttttgatgtttttatgatctccttagcgcacagaaaagtagcgcaggcccacatggaatgaacctcaaccttgttgtgtttacctggctatttcgtgtcctaacaaatcatagaagagcaaatctaaggtttcttagatagcattgtggccaaatagcttaaaagggaatgcattaaatgattgttttaatacatagattacaagagcccagctagctgatatttttaatcatattgttcgcttaggttttatttttctgaaaaaaatgagatgatcagcgtccaaatgcctcagtcacgaaattgtaccactgggtactaatgggaaatgaatgttaaatacgtctgtaaatggttaagcaagatgcaaatataatgttctcattagtactatgaaccccccaaatttgagacaagtctcaattaatttagaaagtttattttgccgaggttgaggacacacatccgtgacacagcctcaggaagtcctgatgacatgtgtccaaggtggttggggcacaacttggttttatacattttagggagacatgagacatcaatcaatatatttaagaagtacattggttcactctggaaaggcgggacaatttgaagcaaagggaggaagactggtagcggggagggggcttccaggtcacagatagatgagagacaaacagttgcactcttttgagtttctgattagcctttccaaaggagacagtcagatctgcatttatcttagtgagcagagaggtaactttgaatagaatgggaggcaggtttgccctaagcagtttccagcctgagttttccttttagcttagtgattttggaggcccaagatattttcctttcacaatacttaccagaaaaacaaggtaatgtatcattttacaagatggtgctgagagagtataaaaagcagatgtaggccgggcactgtagctcaaacctataatcccagcaccttgggaggccaaggtgggtggatcacctgaggtcaggagttcgagaccaacctccaacatggtgaaaccccgtacctaataaaaatacaaaaattagctgggcatggtggtgtgcgcctgcagtcccagttacttgggaggctgaggcaggagaatcgcttgaacctgggaggcaaaggttgcagtgagctgagattgtgctgctgcactccaacctgggcgacagagcaagactccatctcatgggtgggggaaaaaaataaataaaataaataaaagcagatgtgatgcaagggaagatttttgaggaactttttttttttaatttctgttttgtggggaagggggtgttcattttttagtatttctagataagtagaaaatttgtttgttttaaagttaatgttaatgtagtagttccaaggcatacctagtttccttgtggggcattttttgcccaatcatgttagatttactaaaagagatttaaaagcatgattatatcaagatatgagtgcttggtgcggaggctcacacgtgtaatcccagcactttgggaggccgaggcgagtgggtcacttgaggtcaggaattcgagaccagcctggacaacatggtgaaaccctgtctctgctaaaaatacaaaaattagcctggcgtggtggcaggcgcctataatcctagctactcgggaggctgaggctggagaatcgcttgaacccaggacgcagaggttgcagtgagccaagattgtgccactgcactgcagcccaggtgacagagcaagactccatctcaaaaaaaaaaaagtggaggtagttgtgaagaatgtatggtaagattagaaaagtcaaggaagaagaaactatttctataagtgttatacagtcatggttctttttcaggctgtggtggataggcagcaaatggtgctcctcattcccttctgagttcagaacacaggagtcagatagatggacatcaacacactagctctattacagactcatgataactaatgggaggatgtggctcagatgtgcagccacagtattttatcccagattaggcactaacccacagagttttaagtggagaaaacaaatgcttgacacccatcgcaggtgcatgctgcttactgcagagatgacagcagacctgaactcatgtcactgtgggcagacacatcttttgaaagagaccctgagccaagcaagcacactgtgtgctttgcccaaattcacccattaggtagatctgatatcctctcaagaggaagctataggtagagagagtctaagtcctcatttgaaacctgaggccaggaaaatgaaggttctcctatcatttatggctggatttaagtgataattgaaattaatcccatgtctttgtatgtacaaattagtgattagaagttggacagacgtgtggtagatggtaaagagaaatctgttttgtgttttcagtttttctataagtaactcacaacatggataattgacttgattgattttcctaaaccacgtcttatttggaggagaatgaatagttcttttaaggaacagttttcttaatttctgcttgcttggttcaactaaagattttctccttcaagttttctgttctgcgttttgaaaaatgggttctttataaattgagtgtcttgactggtactagccagaagttatgatattaattgttctttaaatttgattcataacttacaatttggagagctactattttttgtctcatgcttaaacattatagagcatcatgacagtttatagatgcattttctcttttttttgttgttgttgtttttgagacagagtctcactctgtctcccaggctggagagcagtggcgtgatctctgctcactgcaacctctgcctgccgggttcaagcgattctcctgcctcagcctcctgagtagctgggactacaggtgcacaccaccacgcctggctaatttttatatttttagtagagacggggtttcaccatattgtccaggctggtcttgaactcctaaccttgtgatccacccaattcagcctcccaaagtgctgagattacaggcgtgagccaccacacctggactgtctgagttatttttttatttttattattattattattatttttgatgcggagtctgactctgtcatccaggctggagtgcagtggcacgatctcggctcactgcaagctccgcctcctgggttcacgccattctcctgcctcagcctcctgagtagctgggactacaggcgcctgccaccatgcccggctaattttgtgtatttttagtagagacggggtttcattgtgttagccaggatggtcttgatcttctgaccttgtgatcctcccgtctcggcctcccaaagtgctgggattacaggtgtgagccaccgcgcccagcctgagttatttttaaaaatctgtatttcttttctgaatatgaaggaaggtgctggcatagaataactccaggctcagtgaaagatctgaagcccactcctaccttgtaactaattggttttgtgacctcaggcaagctgcaggctctctgagcctgttttgtttcttatgtaaaattaaggactttgactaaatcagtgacattcatacgtttaagtaaatctctttttttttttaagaatggaacttttttaaattgcataaaaccacattatagaaaacagaagtagtgctgcctgactaaaggaaggatcagtgctctgaagctgtgactttcttatcccttaatccttcagcatcctctgtggaaccttagatttctgtgggacatagcttgaaaaggatcatttcttgaattattacttttataaggcctggatggtaatgctgttgtcatgttacctactctataaagcctatctgtaatgtttttgtcacagaaatgttatggaaaggagtctcaaaatattggtaaacctgttagtaaaacaaaaaaattgacttgacacctaaaatttgtaaaggcattagatatcattatctttatcaccacaaactatctcagaccctgttctaggcatttagtgagagaatacctattctaaaaaaaaattaaataagagcactctagatagggacactggcaataagtttgaaatattcccacacctttcataattaagtagataactataacttgtcagatgcttaaaaaatgggtactaatttctgaaaagaaatcaaagttgtagttaaataactctaaattgttttcctagtttttaattctagacactcatgaatcaaagaaactaagattgaaaactggctctaacctgtatttatccttgcttttatgtaaattttctgaaatctttgtgtccgtatgaatgaagaaatgttaatcataatagcataatgtttttaatcttttgccagtggaactttcacatggcatcacaacaatactgctttcttcaagtatgtattaaagattctgtgctgaattaatagcaaagaacatactttgaaattattattttctaaaagtggagaatggagagttcattgtaaggaactattcattaaagtgaaaaactggttagaccttgataaagggcagagttttgataagaatgggaaagtaatgcattcattgcagaatatgacttgaattgtgtaacctctgtactgataagggaaaacatcacacttttgaaatgacatagatccaacagaccaatattaattgtacttttgtgagattaatctaaacagcataacacatatatgttctccattatctaaacttaaaataggtaggaatttatatgatatttttaatttaagctatcttcaagttaggtctagtctgtaaaagtattatttaaaggccgcattttgtaattaatgctccttaccatgataatgtctcttcttaaacgttataaataatatttgacttatttcagatgcagcagaagttgcaaaatgacctaactgcagaagtagcaggtatgttaccaaaatttatgaattaaatttagattaatatatatctgaaataaactgcaaacgacatccctttccgttcttgggctagtagatactacattaaatattctttcatatacatctaatgaaagatgtgaaaacctgaacatgtataatgaagagcatacttatgcctcatgaatcatcacgttccatagcttgaaaaaaatagctcaagaagtctggctctactcttcacttctgccatccctatggaattgtcagccagcacacagaaacggttctcagaaaacagaggcatcatcaacttctcagggttatggtagtgatttttaaggccaaaacatcccagtctcatctagtaacctattcaagcagttacagtttataagcagtcgcttgagaggtaacactttaaatctccagtcatttacagtgtcattggtttacttttgccctcagaaaaagttccaaattccttaacatgtaatataaacacccacattcatttggttcttgtcaagttactcaggcttatctctcaccacttactttactctgcccctttgctctaggatccagccaaactggactgcacagaattccacagtgctcgtccttctcctccagctctttgcacttgcttctttgctctatctgccaacctttttttctcatccttcaggtatccactaaccatgcctccaccgaaaaacctacagtatcgagacaaaactgggataggtgtccctcttgcattccaatagtgccctgttttatacctgtcagggtatctatgacttggtatggaaattgcctatttgtctgctttttcaggttatagcatgtgattgctgaggggtggactgtatcatcttcatcttgtaactccagggcatagtctagtaccttagcatgcggttgttgaataaatgaatgaagaatgagaaaaccagaagctgtgatacacaaccacaatgatcatttagtgtgcaactatgggcagattcttatctaataataagttagcattgtagtcatacatacttttcattcttgttaacactgaaaaagctctcaactcttttttactgatttgcacttagttaactatgaaatatatagaatataattctttggccaggcatgttggctcacgtttgtagtcccagcactttgggagcctgaggcaggcagatcactggagcccaggagtttgagagcagcctgtgccaacatgacgaaaccctgcccctataaaaaatacaaaagcttgccaggcacagtggctcatgcctgcagttccaagtacttggggctgaggcaggagaattgcttaagcctgggaggacgagactgcagtgacctgtgatcacaccacggcactccagcataggtgaaagagtgagaccctatcttaaaataataacaataataataataataataataataataataataataatataattcttgctttttttttcagctgctactaaatatgaacctggatcctatatagcttctcctctaggatttacacacaaggaaaatctgaatcaagatccagttttggaagtagcaaaagaatatgcacagattttaagaagaaaatacatactctgaaagataaggcaattttatttgggctattcacatgatattttgtttcccattaaatatatgatgtgaacatttttactaaagggaaatattctatgttatacatgtctgatgaaaatttatatagtattttaaataatgtttcttggcctcttcagctaacttttaagtggattttgcaaatgaaaaccagtattactgagttttacatactcgaactgcccaaatgttagctgtttaaacagccaaataatcaagttgccattaataatttagtggagccaattgatggcttgtttgtattttataattttatctttatacatagtgatagatttaagtttagatagacatcattttggtatactggtactgtggtcattgtcaatgtttggatatattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcagaaagttaacatcaatacacttgatcatttcattctcagtttcttttcaagttttcttaattgtctataatgttctttgtagcagaaggatcccattcaggtccatgaatttcatttagttgtcatgactctttcagtctggaacagttcctcagtttttctttgacctttatgaccttaaatcttttgaagagtaaagtccaataatacagaatgtccctccattggatttctctgaagtttttttatgataagatttagatgataatttttttttttggcaagagtatcacagaagttatcccatgatcttctcactgcattctatcaggtgacctgcaattattattattttttattttcatcttttaagttcaggggtacatgtgcaggatgtgcaggatgtccaggtttgttacataggtaaataggtgccatggtggtttgctgcacagatcatcccatcacctaggtattaataatagcccagcatccattagctgttcttcacgatgctctcccttctctcacccgccaccatcccacatgcccctgtgtgtgttgttccccgccatgtgtccatgtgttctcattattcagctcccacttgtaagtgagagcatgcagtatttcattttctatttctgcgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctattgtgaatagtgctgcaatgaacatacctgtgcgtgtatctttatactagaattagttatattcctttgggtatataccaagtaatgggattgctgggttaaatggtatttcaggttctagatctttgaggaatcaccacactgtcttccacactggttgaactaatttacactcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaggtttttttgtttgttggctgcatgtatgccttcttttgaaaagtgtctgtttgtgtcctttgaccactttctaatggggttgggtttttttttcttgtaaatttgtttaagttccttgtagatgctggatattagacctttgtcagatggatagagtgcaaaaattttctcccattctgtaggttgtcggtttactctgttgatagtttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttctttcaggatttttatagttttgggttgtagatttaagtctttaatccatcttgagttaacttttgtatatgggttaaggaaggggtccagtgtcaatttgctgcatatggctagccagttctcccagcaccatttattaaatagggaatcttttccccattgcttccttttgtcaggtttgtcaaagatcacatggttgtaggtgtgtggtcttatttctgggttctctattctgttccattggtctatgtgtcggttcttgtaccagcaccatgctgttttggttactgtagtcttgtagtatattttgaagctgggtagcatgatgcctctagctttgctcttcttgcttaggattgtcttggctatttgggctctgttttggttccatatgaattttaaaatagctttttctaggtctgtaaagaatgtcaatagtagtttaatgggcctagcatttaatttacagattgccttgggcagtgtggtcattttcatgatattgatccttcctgtctgtgagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgatttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaagaaagtttgacttcctgtcttcctatttgaatagcttttctttctttctcttgcctgattgccttggtgagaatttctaatactgtgttgaataggagtggtgagagagggcatctttgtcttgtgtcagttttcaagggaatgcttccaggttttcaggtactcaggcaacaaatagcgttacgaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcacgaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaattgaaacaaaaaaatacaacagataaatgaaacaaaaagctggttctttgaaaagataaataaaattgataagcattagcaagattaatcaagaaaagaagagagaagctccaaataagctgtattagaaatgaaatgggagatattaccactgataccacagaaatacaaaagattattcaagactactatgaacatcttcacatccataaactagaaaacctacaggagatcgataaattcctggaaatatacaaccctcctggattaaatcaggaagatatagaaactctgaacagaccaatcagaagcagcaagattgaaaatggtaatttaaaaattgccaacaacaaaaaagtccaggaccagatggattcacacctgaattctatcagacattcaaagaattggtacccttcctattaacactatttcacaggatagagaaagagaaatcttccctaaatcatttgatgaaaccaaaatcaccatgatatgttttggctctgtgtccccacccaaatctcatcttttagctcccataattcccacatgttgtgagaaggacccagtaggagatgattgaatcatgagggcaggtcttttccatgctgttctcatgacagtgagtgagtgtcacaagatctgatggttttaaaaacaggactttctctacacaagctctttctttttgcctgctgccatccacgtaggatgtgacttgctcttccttgactccaccatgactttgaggcctccccaaatatgtggaactgtaagtcaaataaacctctttcttttgtaaattgccccgtctcaggtatgtctttatcagcagtgtgaaaatggactaatacacaccctaatactgaaacagactaatagacaccctaataccaaaagcaaggaaggacataatgagaaaagaaagctacagaccaacatccctgatgagcagagatgcagtaatcctcaaaaaaatactagctagctgaatctaacaacatatcaaaaagataatccatcatgatcaagtgggtttcataccagggatgcagggatggtttaacatctacaagtcaataaatgcgatacactacataaacagaattaaaaaacaaaagtcacatgatcatctcaatagatgcagaaaaaccacttgagaaaatccagcatccttattttattaagaccctcagcaaaatcagcatagaagggacatacattaaggtaataaaagccatctatgacaaacccacagccagcattatactgaacagggaaaagttgaaagcattcctcctgaaaactggaagaagacaagattgcccactttctccacttctattcaacatggtactggaagttctagccagagcaatcagacgagagaaagaaatcaagggcatccaaagtggtaaagaagaagtctgcctattgctgtttcccaatgatatgattgtatacctagaaaaccctaaagactcatccaaaaagcttctagaactggtaaatgcattcagcaaagtttcagggtacagagttacacacaagtgtgcacaaatccgtagctgtgctatacaccttcagcgaccaagccaagaatcaaaccaataactcaaccctttttacaatagctacaaataataataataacaataaaatacttaggaatattcctaaccaaggaggtgaaagatctctgcatggaaaactacaaaacactactgaaagaaatcacagatgacacaaacaaatggcagcacatcccatgctcatggatgggtagaatcaatattgtgaaaatgaccatactgccaaaagcaatctacaaatttaatccaattcccatcaaaataccaccatcattctttacaaaatgatgaaaaataatcccaaaattcatatggaaccaaaaaagagcctacatagccaaaagaagactaaccaaaaagaataaatctggtgacatcacattacctaacttcaaactattctgtaacaccatagtcactaaaacagcatgatactggtataaaaataggcacatagaccaatggaacagcatagagaacccagaattaaagccaaatacttacagccagctgatcttcaacaaagtgaggaaaggacaccctattcaacacatagtgctgggataattggctagccacatttaggagaatgaaactggatccttatctctcaccttatacaaaaatcaactcaagatggatcaagaacttaagacctgaagccttaaaaattctagaagataacattggaaaaacccttctagacattggcttaggcaaagacttcatgaccaagaagctcaaaacaaatgcaacaaaaacaaaagataaatagatgggacttaactaaactaaaaagcttttgcacagcaaaagaaataattagcagagttaacagacaacacacagagtgggagaaaatcttcacaacctacacatccaacaaaggactaatattcagaatctacaaagaactcaaatcagtaagaaaaaaaccaatcccataaaaaagtgggctaaggacacgaatagacaattctcaaaagaaaatatacaaatggccaacaagcatatggaaaaatgctcaacatccctaatgatcagggaaatgcaaatcaaaaccacaacgcgatatcacctcattcctataagaatggcaatattaaaaaaattaaaaaataatagatgtcagcatggatgtggtggaaagggaacacttttatagtgttgatactaatgtaaactagtacaaccactatggaaaacggtgtggagattgcttaaagaactaaaagtagatctaccatttgatccaacaaccccattcctcagtatctacccagaggaaaagaagtcattatacaaaaaagatacttgtacacatgtttatagcagcaaaattcataattgtgaaaatatggaaccagcccaaatgcccatcaatcaatgagtggataaagaaaacgtgatatgtacacacacaccccatggaatactactcagccataaaaaggagcaaactggatggaattggagaccattcttctaattgcagcaacctggatggaattggagaccattcttctaagtgaagtagctcaagaatggaaaaccaaacatcatatgttctcatatgtgggaactaagctatgagaatgtaaaggcagaagaatgatacaggggactttggggactcagcggaaatggtgggaagggagtgagaaataaaagactacacattgagtacagtgtacactgctcgggtgagggatgcaccaaaatctcaaaaatcaccactaaagaacttatttatataaccaaacaccacctgttccttaaaaacctattgaaataaaaagtaaatttaaaaaaacctcctggattcattgatttttttgaaggtttttttgtgtctctatttcagttcagccctgatcttggttatttcttgtcttctgctagcttgggagtttgtttcctcttggttctctagtcattttagttgtaatattaggttgttaacttgagatctttctctctttttgatgtgggcatttaatgctataaattttcctcttaacactgctttagctgagtcctggagattctgttatgttgtctctttgttctaattagttttaaaacacttcttgatctctgccataattttattatttaccccaaagtcattcaggagcagattgttcaatttccatatagttgtgtggttttaagtgaatttcttaatcttgagttctaatttgattttgctgtggtctgagagactctttgttatgatttcagttatttttcatttgctgaggagtgtttttcttcctaatttatgattagttttagggtaagtgtcatgtggctatgagaagaatgtatattcgcttgttttttgttggagagttctgtagataactatcatgtctacttgatccacagctgagttcaggtcctgaatatctttgttaattttctgtctccatgatgtgtctaatattgtcattgtggtgttaaagtctcccactattattgtgtgggagtctaagtctctttgaaggtctccaataacttgctttatggacctgggtgctcttgtatagggtgcatatatatttaggatagttaactcttctggttgaattgaaccctttaccaacaggtagtgctcttctttctcttttttgatctttgttaatttaaagtctgttttgttagaaactaggattgcaagctctgtttttttctgctttctgtttgcttggtaaattttcctccatccctttatttttagcctatgtgtttctttgtgtgtgagatgggtctcttgaatacagcatactgatgggtcttggttctttatctagcttgccattctgtgtctttcattggagaacacattgagatttaaggttagtagtattatatgtggatttgatctcatcatcatgatgctagctggttattttgctaacttgtttatgtggttgcttcacagtgtcactgttgtttgtactttagtgtgtttttctggtgcctggtaatggtttttccttttcatatttactgcttccttcaggagctcttgcaagacaggtctggtagtaacaagttccctcagcatttgcttgtctgaaaagcatcttatttatcctttgcttatgaagcttggtttggccagatgtgaaattctgggttggaaattcttttctttaagaatgttgaatattggttcccagtatcttctgacttgtagggtttccactgagaggtcggctgttcatctgatggggttccctttgtaggtgacctggcctttctgtctgactgcccttaacattttttctttcatttagagtttggagaatctgatgattatgtgtctcggggatgatctcctcgtggagtatctcactggagttctctggatttcttgaatttgagtgttggcctgtcttgctagaactaacttggggaagttagttctcttggatcctatgctgaagtatgttttccaacttggttccattctccttgtctttttcaggtaccccaatccatcatagattcgttctctttatgtaatcccatattttttgatggtatcgtttgttccttttcattgttttatctctattcttgtctgcctgtcttatttcagaaagatcgtcttcaagctctgagattcttttcttggcctattctgctgttagtaattgtgatttcattgtgaagttcttgtagtgtgtttttcagctctaacaggtgagttatgtttttctctagaccggctattttggctgtccgctcctgtactgttttgtcatgattcttagtttctttgcattgggttacaagatgctcctttaggtcattgaagttcactgttattcacattctgaagcctactctgtcatttcagccatctcaggctcaacccagttctgagcccttgctggagaggtgttgcagggatactctggctttttgagtcctcaggattttggggttatttctcatctctgtgggtctatcttaaactttgaccttgaggatggggtttttgtggctttttaaattgttattgttgttgtttcctgcttgtttttcttttaacagtctggccactcttctgcagggctgctgcagtttgctgggggttcgcactataccctagttgcctcggtttttcccatagctggaggtatcatcagtgaagtctgtgaaacagcaaagatggctgcctgccacttcctctggaagctccatcccagcagggtactgacctattgctggctcgaaagtgcctgtaggaggtggctggataccccagttgggaggtctcctccagtcaggagaaatgggataagggacctgcttaaagaatgattctggctactttttggtagaccagctgtgctgtgttggggatccctttagttcccattcagtttgggctgtccaaaggcccacaggctgaactggctgagaagcttgaaaggcctaggtggcagcctgccccacccctcaggcactccatcccgggaagaaattagagctctgttagccccatagaacatgagtgacctacaattttgatttgcccttttactggtgatgttggcattgatcacaaacagtggtgtctgctagctttctcctctgtaatgttactttttcaccttgtaattaattaatattaatattttgtggggaggtaatttgagactatgtagatatctctgttcttcatcaaactcaatttattcatttacttgatttgatatttacttgtggtttatttcatttaataggttataatttgacaattttttttaacaatttttttctttttagaaatgttttattttaacaattttagacttatagaaaaatagtaagaaaactacaaaacattcttggatactattccccaaatgtgaacattttactgtatttgctttatcctttctcccccttttcctcttctctttctaggtaaatataaatgtaggtgcataatatagactttttctgaatggtttataagttgcaggtatgatgcctctttatttctaaataattttatgtgtgtctcctaaaaacaaggcattatcttgcataattatagtataactatcaaaatcaggaaattaaaaatggtttactgttactatctcatccataaaccttattttacttttttcagttgtctcaataatattttttatagccaaataatttaagatgggtgatgttacaatccatgatgttgactttcataatccatgatgttgagaggtttcagcatttttacgttgattcttcctcatctctgtgggcctatgtacctttgatgtttgaggttgctgacctttggaggagtcgatctgtgtcaaattattctgtctttttagtctcttttagtccaggatgattcctgagtctttccttgattttcatggcatttatgtgtttgaagagtatgggtcagttttttgtggattttctctcagtttgggttcataggatatttcttcatgattcagttcaggttataccattcaggcaggaaggtcacacaagtgaggctaagttcttcccaatgcagcatatctggaggcatatgctgttacttggctccattactggccagtgttgactttgtttgagaatctaccaggtctgtccatgataaagtgactgtctaccctttgtttttcaccaatgtcttatgtgagcatagtttgaggctctgtaaatatctggttactctaaacatctcacccactagatttagcatttcattgattatttttgttgggtcaattattattatggtggttgccaagtcatgattgtcttcatctttcattccttctacgtggataagtaaaacaaaacaaaaccaaccaacaaataggggagaagggaaaatttattgttttgctgttcaggttccctccgctttgaccagtggtagccatttcaagctgagttcatgtctttttgaactgtccttattgttctttgaatacttccttactttctggcataagctgtttcaaccatactttgtattttctctgccccagcccttgaatcagccattttcatttttttccagaagccctgactttctttaggggacagtaattagaaaccaatatctgggcagtaattgtggtagatacgtatggctattggagttgtcattgctcataggcttcctcagtgaacagagcagaaaaatacagctagatggataaatatacaaacatacatgcttatattcatcgatatttctatattagaatatactgaaaaccatgagttcttcctggtgattctaattccagttgaatcacacatggctcattttagttttttttccctttcagtactcttgacctttgaacaatgtggaagttagaggggctgaaccccacacagccgaaaatttgcctaaattttgacttccctgtaatgtaactgctgactgacctgattaactattgttgaccagaaaccttacccataacaaagttgattaatatatatgctgtatattctatgtattatacactatattcttataaaagtaagctagaattgccttagctattccagctgttttggggttcgatataaattttaaaatagtttatcctaattctgtgaagaatgtcattggtggtttggtagctgacttcaaactatactacaaacctgcagtaacagaaatagcatggtactgttacaacagcagacacatataccaatggaacagaatagagagctaagaaataatgcagcacacctacaaccatccaaccttcaacaactccacttaaaaaaagcaatggggaaagcaatgggactgctggatcaaatggcaattctaagttctttgagaaatcgccaaactgctttccgcaatgactaaacaagtttaaattcccaccagaagtgcataaacgtccccttttctctacaaccttgccagcttctgttagtttttgaccttttaataatagtcattctgactggtgtgagatggtgtctcactgtggttttgatttgcatttctctaatgattagtgagtttgagcttttttttcatagccttgttggccacatgttatgtcttcttttgaaaagtatctgttcatgtcctttgcccacttttgatggggttgtttgttttttttcttgtaaatttaagttccttgcagatgctggatattagacctttgtcagatggctaggttgcaaatattttctccctttctgtgagctgtttactctgttgatagtttcttttgccgtaaagaagctctttagtttaattaggtcccatttgccaatttttgtttttcttgcaattacttttggcatctttgtcatgaagatcatttccaggtcctatgtctgcaatggtatttcctaggttatcgtccaaggttttaatatgttttcattttagatttaagtttttaatcctgcctttgcctcccaaagtgctgggattacaagcgtgagctaccacacccagcgaggaagccaagtttaacgtgtgtgctccactcctccaacctggccaaagggcagtcatcatcactggccactactgaccacagcctttagaaactccccttgaacgtgctgggctgaccttcctctgatcacaggcaaggtaaccatacactcaaggccaatgatcccatctgctgtgggctgggtcatgctcccaatgcttacagaacctgggaggcagaggaaaactctgcccatcccatgggacgttacctgtaagctttgaacaccagaatcttgaggcctatctctttctggaaggctttgtcttcctctaaaccaggaagctggagcaattccaccagattctgtacaacagatgcaacaagaaaattcatgaagagtagatcttaggttgaatttttcacagaagaccttgtaagaacagaaaatggtgagaaaaaaaaaccccgaggtcaatacaatggggaaaagcctgtgaagtgacctggcagcagccacacctgctgtcacctccattcccctctcatcttggaaacagatttgccctttacaactcaactcatagctcacccgccttcagagacttcttggcccatcttagctggaagggatctgttccagcgctgagcttttattttgcttagcatctactcagatgccttgactgtgtgtgtctcacagtcctactgactgacaaactccctgggggccgagatggcatggattcaggtctcagatgctctatggcacctgggagcatcttacacaggtgaagtgctcagtgatgatctggggtcactattctctgcagatcagcatgtctgagaggtaggggctcacagactgtggaactggtgtaagacctttgtcttttcccagctactaacaggtcctgcttgtcacagcccttccatgatacaaagttaagtcattttgtgtctgacacaggcaaaggaaaatgacaggcccttgccttcccggtcctcaagggtcagctgtaagatgatgtcataaagccggatcaggtcctggggccgggggaagcacttgctgtcatcctctggctgctgctgcagcagagccctctgcagacctttggccatgctctcattacgcttgattgccattgacagcttgatgt

SEQ ID NO: 185 - DNA, 20865 bp, Homo sapiens
cataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctg

SEQ ID NO: 186 - DNA, 109514 bp, Homo sapiens
ctcctcctcctccctctaatgcctgtaactcacatccgaggctgggcgaggaatccggaggggagattttcctcatgctcacggttgttggaaactggaagagtgagaggaaggaggaaggggatttgtggcgctctctacctactacaagactgacaaggggagggggcacctaaatttgcatcttttcttcgtggtgattgagaactgcaggttcaaaccgatcccactgagcactggcgattgattataaaaaaaaatcgacactgggagaagggaggctctgtcttcggctgtcagactcaatctcggaggtggtattggtgtgtgagtgtgtgtggtggtgtttttttttctttttttttcttttttctttctttctttcctctttttttttttttccttctctcctaggggctacacaatggcagtcttctctcagtaagatgaatcctgctttgccttctgcagatccacccatcctcatagcgatcaagtaaaaaggctatggttttctctttggggatcttttgtgcattactgttctccctgattagttttgatctcagttgggatctctttgcttttctgtttggcttcatgctgaaaaaggattttttctccaaccctttggtaataatccggtggtgatcgaggggggataaatcattcaccctggccgaaaacaaacaatcactgagaagtctcaaagaaatataccacgtgaggggaaaaaactgggagaagatccggaatattatcgtttttcctatggtaaaaccggtgcccctcttcaggagaactgatttcaaattattattatgcaaccacaaggatctcttctttctcagggtgtctaagctgctggattgcttttcgcccaaatcaatgtggtttctttggaacattttcagcaaaggaacgcatatgctgcagtgtctttgtggcaagagtcttaagaaaaacaagaacccaactggtaagcgaaacatgcatcatgttatgtttttcctcataataacctgtctgttgctcatcgagctagatctgcagttctgctatgcaggaaggcaggggaaacataccaggaaccaggacagtgttgcatatagaggtgttgcatgaataaacaagtaacagctggatcggcgtctacgaaccccaaaaccattattggcatcccttggctgtgacacaatccatcactaggagggaggaggaaactttttttttttttttaatgtatttggttgcctatgtttggtggaatagtgaagggctatggcttaaggttgtgccccaggcagctgaagcttcggtagttgccaggaaaaagaaccgcgagctccccttacttctgcagcaggttcgagggacgtagctgggttccgagaacctgctctagactttctgattagcttgcacaatattcgccaccacgatcacctttaccaaagtaaaagaggccccctccctcgcggccccgctcctccgtcagcccccgcgtccctcccccgtccagctccgggtgcccgagcattaactcattccccctgtctgcctctgacacatcctgccaccgggaatacttgagcaaggcttgcgccgggagggaaccccagactgagaggacaagcccagcccctctaatatttgtaattgaagtccccccctttagaaagcggtgtcaaagccctgcgtcggggtcccacagggccaggggtggggatgagccaggccgtgagttcctgcttttaagcctactggtgatcatgcgccccgattccaaagggctccaacaagggaacttgcagtacattacataagaaatgcaaatgcatctgatttggggagtcggatcccaggggttcccgtccccgcgtctcagtccgaggcgattgggggcggccgcggagctgtgggcgagcaacccaggggaggcaggctggagggctgcatggtggtggcggcggcgctggcgaggaggctgggcgcagcctttcccggaaccgctcacgctggcagccgggagtgtgtggcgtcccctagctccgttcagggtggagagggacccggggccggctgtttttgtctggggttgtgtctgaaggagggagcgggcagatcggccgtcccgcagtggcagcccgggctctggaagctcctgacgctggcactgcggtgcagtagatcatggctctccacggcctccctgacgccctgggctctgccgggggccgcactggcacccagagccccagcgactggggcagcaagtggctgctgccctccagcctccgaaccttgccaatgcaacgtagctggggtggcgcgctccgaggggtctgccgcctgcgggtgcagcgcgaggcagaggaggaggaggtgcgggtgggcggggacggaggcggtgggtgcggaggctgagaccgtttgcggccaccattcctgcagcaaaggagaaactgcgagttgttagacagtctaaaagggcagaggctcctatgctggggcggagaagattgcccccagctggtactttggggtggcaattgaggctctggtagtagcctctggctgctccgtggactcggtgctgcagtgggctctgggctctgccctgagtcctcctccctgtgttctagttcttacaccgtttctattcaccccatctgtttcctcctcctccgtccttttaccctcctctcttcttaactcctcagcgtttagcaactctgaaacgacacaccaacctgagaattgcccaaggggaaaacagtgttgtcacctttccacccgcatgtctaattcagctatgaagtgtaccccaagatgtactccaagtccccgacatcaaacctaaaacttgctgacgcttggttcatacaaaaccaacttacatctgcaacactatctcacagcctaatatgaagaccctttttgcaagacttctcaaagtgagaaaggccaagggctgcagtgggaagggcaggggtgactgctttacactgcaaaaatggtggtcttttgaacccttcttgtgtctttctgtgaaaagatttaactctcttctgagaaaggaatagtgcaaaaacattttttatttagatgtgaccatttgtcttagggaccttgaagtcagtccttccatagtactggagagtgggaaataatttagcacagaacagtaagtttctttgtaggcctttataattttttttgtaaacaattttaccggaaacactaaatttctccctatacacgagtcacaatcttattacacttcctccatcccacccactttcatctctctggaatagtttttccccccttccaaggcatttttggaaactgtggaacaaatgacaatttatttttagaacaattcattttgcagcttatgaatgctaaagtatttgggtatgaattgatgggctaactcaaagtgtatctaagaacattaccaactattctaataggataatttagtgttagataaccagggatatgagttccaaccagggagttggagcatttagtatatatatatattatatattatacatatatataatatatatatttaaatgggacattaatgtgtcacattatttatcttaccttctaaaagttttagcctgttaagcttgaatcgaacccatgccaagccattccctttcactattgtacttcgtgagttccattctcctgctagtaacataaagcctaaaatcttttgcaggtttttgatcccaaaatagcagtagaactaaaaagttaattgggtaattaaaatgaaacaaacactaaaattcttttaactgttacagccaaaaggaacagattgactactacctattatgttatcttaaatttaaaaagagaacaattaactggtttcaaactaagaaacttgggagaatactgccaaataccagtgaatttggtgtaaagcacctattcttatttcagagataaataataggttaattttccttcctatatctttggaagttatgaaataatttactgattatttccaattcgctaaactgtcaacaagtgtaggtggttcaagcattcgtggaatttcagagcaccgctatataatcaagttggtgtgaaaataagcagaaaatagagttacgaatttaaggacaaagttattcatctacccaaaagttattgattagctcattattaatacttatataagaggtcttcattaaatagtgttttgggcttgttttatgtaaaatttaactggaagagaacatgaaaaatgtgtttgcacaatatatgctttttaaaataaattccaatagcttaaaagtcctggatataaagtaaatttgctatcttcattaaaacacccagtctaacaactattatcagagaacacacacacacacacacacacacacacacacacacactcttaaatgtcctactttcctagcagagcaacagctatgcatttagaataaatgttacctgcttcaactttcactgtaggagtcatgcaaggtgactttattttaggcaaatcattaaatagggaatactaagtccaaggcatttattttgcttgaaggaggcttcataggtttctttaaaccagtatgatagtttggattgaccaatgtatataataggcccgttctggaaataatctaggtcactgcactttaagccaagggtactaaggaaagaagtgtggttgaaaaaagaaaatccacaataaacataaatactaaggtcatgtcattgctgtctcttcaggcacataatgtaaaacaagcaaaggaagccacagaccctcaaatagatatacccactcaaccacacacaggatatccccaaacttccatggcttggtaggattttggaaaacacagattttaagataaatcataatctaagaggattttattgagtacaaatgtcagtgcccagtgttagtacgaagcagacgccctagacctagttctgcacagcacactgagaacattccatcaattctctttttctgaactcagtctcccgctctgtcgtgtaactttgaggtggaacatgcagggcttggtaggacccatgatcactttctatttcctacttgtctggctgcctttcagctctgcttttgcctttcactaagctgttttaggtgccaaaacacctggtatgccactgttactcatttaaatatacgtttttttaaaaagctacttgctttacatctagggctgtcatggtgtttggaagtgagaaaataggaagagagggaagaagagtgagcactttttactcccctccttctcagcctaccgactcatcctaggttccagtagagctgggtgagccacaaatgggccacaacctctgcaagtctaaacactgagtatatttcaaatgaaaacatcaaattcagactgcacgtctggaacagcaaacagatgtaagctgcttcttctaacatgcttggctgtagagtgggattcaatgtagtattagttggccttagactccatccaggaagcttatttactgaggtaacaaaatgggttttgtagagcagtgccactccatgaaccaaaggatggcattttaggtaggcttcggagtactgccttgttgggagagtagatttttcttttttgaaatgtatatcccagttaataagtgtaaaattcaatgcatgataatctaaacttagttttaacaatgaagatgactttggctgtacaacttgttctcatcttagacagcatccataactgagaaaatttgttcaaatgatgcagtactttctgaaagtgctaaagctaattctatactatacttcacgtttcctacaatgaaccattcctttaaaatgttcgaacccagtcttccatgttttagcaacacaaacattggagacttttgtgaagtgtttttatacatatggtaacaaggacaacaaccaatgttttcactcctttgcacattttggcatcatacctcactcaaattgactcatacgccttctataaataccacgtagatgtctcaaaatggaagcatttattcaaaatagtgtcttttgccttaaggggaaacagttgggctgtttgaacagtctaacaggagctcttctcttcagtgttaaacaagtcattgcactgtgcctatttttaataaaacctttgagcccaactcagtattacctccaggagggactgtggaggtaatactatttacctcctgtaaatagggacagggaaacacctatttacacatctgcctgctcactgccatagtctgtgtggtgttccttaggacttgtgtaccaggtacaaggtttagttatgtgttgaacccgggtactgaagggcatggagttttctgagggagacttctcagctccccgtatacctctagagatgcaatagctcttttgtatcaagaccaactatgtcctgatgttttccctgtgtagttctctagctgccactattttttttactttggtcagaatgtaaaaggtaggatgatgaagagaagggaacaaaaggagggattcttagggacttcctaaacttgaaggcaaaaaggatgaatgtcgcagacatgttttatagggaacagtgaagttcttgtttgattagtctggtaacatcatgtaagaaagtcacccaacaactgctgggcaccactgcctttgtcactgtctcttgacaaaaactctgttcacgacacatggtaggttttcaatacactttaataaaatagtgaaaaataggtatctctaggatagtgaactatgggactacaaagggcaggacgatacattttacttggttaaattcgcttaatgcttactcctttctcaaagcgccaaccaagaatttggctactaaataaagaaaaaagctgttagtggctctttatccgccacgatagggtgctctgaaacccggtcctgcagacattcccttggcccacattttatagcttccttctcagtctcaaggcctgtagtctactgttcacactcgagcctctcgcaaaatacacaagctcaaaagctcatggcgttctccccatctggcattctcggccttagaatagcaaacgttagggcaccattaggttcatagttgccagacccttcattttcttttttaatctttaattttcttcttaacaaggaagacattccgcaaaaaataaactccctcttttgagctcctttctctgaagatggtaactggaactctcattagtaaagaacctcgagttccagttgctttggacggagtttctcgcttagtattttgctctttggcagtttgaaaagcagtaatcttccaacttcgcagctccctgcactcgcgcctaccaccctgatctatttggctttctcctttttggagccactttaaaaggtgcagggtgctgggccgctgtggcctcgggctgagaggcggggagttggtgtccgggaccagaaagtttggcagaagccacggctctgggcccaggccccgggcttccagagaagtgtgtcattatttgttttctgcaaagccgcgagcgggcccacgctgcagctctgcctccaggcgtggaacccctcggtaatccgggtgaagctgggttccgagtgtggactgcttcggctctgaggaggagggagcccaacgggccaggcacgggcttcctcctggctttacccattggcccagagtccccggtcccgccgccgctgccctctgctcacggggaccggccatcaccgcgctcccagcctcggctcgccgggggcttcgctacgcaatgcggcggaagcggcccgttggagccgccgtagcgcgggaagtttccgttgccacggagatgacctctgaccctagggcgtctctgggacccggcagcttgtgctgttgttgctatggaaaccatggcggccggaagccgccgcgcgggagagacttggggcgcgggtcggggctagggctcctgccctggcagagatcttcgctcttccgtggtggccggggaccgggcagtgagcggccggctctgccgcccgcggggcgcgggtttgcaaggtcactcctccggcgttgacgcgggggcaccccatgtgcactgctggacctgagggatgggaaagccacaggtggctgccttggccctcccggtctggcctcccgctagcgggcgccagctctggacccgagacccatctgaaggaaagggaagggagctggcgttgctggtgattctgcccaagctcaggactgggagagaacgagccaagttctggtctcagcttacacactagctactgggagaccctgggcgggtcctgaagttttctgggcttcagtcccctcggctactacaagaaggatattgattagagtaatcccagatcagccccagctctaatattctaggttcccataacgttcacacccagtcctgattgtaagtaaacttccctcaccccttccctgtatctctcccggactatgttaactatatatttaaattgtactctaaattcagagaccatcagagataagaggttgaccttagcgatcacaaacaacctgttccttttacaggtgtggcaactccttcccagtggaggaagcgactgttccaagagccagttttggaattgtaggcacaaacacaggtagaagctttgagccttgggtgaagaaacgcgtattttactggtgacactaggaagagctcctcatgcgcttcatagaattgtgtggttggtgctgaaatagatggcattccatttatccattatattccccagataccttttccttagacagttttaagattttcggggtaggggagggtatcttcactagtttatttttccttctctcatatccatgctattgggaaaaatctttcttaaatcttttttataaacctcatttgtaaattaagaagttgaaaaagattattttcagagtttattacaactctgaaatttatgaattatttcttttaggtccacgtgctttttatcactttttcagtaactacaatctcaaaaaaacaaaaaacaaaacttagtaaacacttaaaaagtgctgctgtgtttgaactgttgatgctggagatacaggggtgaagaagagttcttccttcaaggaattagcaggaaagacaaaagacaggatcaattatgatgtggtgaacaattctgtgtaggtggaccaaggtgctatagggccaaggaagaggggcatggaaaggtttctggagggaataaaactcagactgagtcatgaagaatgactaagagttagccacgtggtaaaggcactggttaggctgtcaaggaagagaaagaagcatactttaagctttgggggcgtcaaagattgtggtgcagaccgagaatatcaagtacaactgagaaatagagggtgtttctagggagtggcaggtagtgagtggggttgcaaggtagtgaggcacagatcgtgagctctcttctgtgtcatgatcatatctaccctttagacaaccattatgactacagcgtggaaaacagctctgggttgggcaaggttgaaggtggaaagaccagggaggaagagcagtgagcagtggtgagcggtccagaataaggcagtgacaggcactagagaggaagtgaagtccatccatcttagtggccagtttgaatttgggaaggaagttgaaggaggagtctggaattttctgattacaggtttttgatttggacagttctggtgagctagtcttctggccatttgccaacagaacacttccatcttcttgagacatggttggctgtcttctgactgtttatattgaggggccgaggtagcttttaacagcaagtaggagacttagacaagcttctctttctagattaaaatttaaatggacagttctgggagagttgctgtgggataaaaagttcatcttgatttcaaacccgaaaatccttaggactgggaaaaaatgctttacaataaagatatgccaaaatgatttttttaaacgattatgtacaattctttgtcaatagcagatgtttttatggacacaatactttgttcagtttgaggagtcaagtagtgcaattaaaagccaagttttcagatttactattcaggtctggcaagaaaagagaaggaagtatgaactttattgaatttacatatgtaagtttgcacacgtgcttttttagataggaatgaatgtagttaaaatgcctttttttcctcctgtagcattttgttgtctgcacaattatagtggatcactgaagtgtgtggtaaccttatctgtaatgctgcatcttaaaggtgtagcttgggagggattgtaatatctgttctttccacttcctgtgtggagcacatggtataatattgtactttaagaaatatgaacataagaaggcttaaagactaaaagagaaatcatatctcataattgtagtcctttttgtttcaacagccacttatttgtagtctgaaactcatcttctttagttgtattgctgctgtataccaggtgttgtaacttttaagcaaagaaaggaccctgtctgctaggagaactgagtcagttttctacgtaagcactcagtagtaaccatcatttggccttagcattttattgttgggacaaattgaaagcagtaacacaatatgctctttcctccttcattgctaaatgagttgatttgtttcctgagaagtgatgttttccattaacttgattattttttcttgtacctttaaaaattttttcaactcacatgacaagtaacataaaatacctcacatctcagacaaataataatgactgttaaatattggaaatacttttaatgagatcagtaccaaatgttagagatattttaatgatgcagttaagaaatttgatataggataaaaattttacatcattattgcttattattatctcttttctagttttcttttaaaatgttgggaataattttaaacaacacagtactgaggccattctggtacatgtgtggcagatgtgactctgtatgggggatactaactgtgacatgaatgctatagttagtatgtggtctgatatgcagccataaagtccgcccagctttgtcagaccgcttgccctttgttgtagcaaagtgcttttccagtactgatatttcatccctttgtctccttctccctgtatttgtactatccgattctagattttgtccttttacatattttttagtcatgtttttcaaaaattttgtcatcaacttactcttcaggcaagatcaggattagtattcaattggatttacctcttttacattcattacattaggaaaatagacccaaaataataaaatagttgtctgagagtaaatgagaaacatctgtctgaacttgaaacatttacccaaaatgatatttattcggcttaagttttttctttctgtacttcaaattaacatgtaaaagaacggtgatgtggatctactgcattatttgattatataattaaatgacttttagggcatggtaaatctctcacctagttttcccgttaacgaatgtatattacacttactagatttttaaaattatattactcttttgctttaacagaaatgttctgaattattttgaatcctgtgttattattagttgataacaactaatctttagagaatgcttctatatactaggcactctacctatactatctaatttcatctttaaaatcacaggaaaatcttttatacttctgttaaaaattatgaagcccaagcatgaaaagattaaggaagttactggagagtacctagctagtaactgaaagatctgagtataaaaccaaaaccaagtaatctgactccagaatacatactcttaaatccctaaattgcagctaccgctctagaaaggatgttgaacagaatgcttgtgaaagtgatcagtatttctcctaatgtttttgtgaattattctgtcctgaaactaaaagggactgtgatatattcactgtttagctatctagaatttttaatgctttcttagtgagatataatttatatacattaaaatgcacagtcttaactttatagcttgatgtattctaacagttgtgtgcatcattgtaaccactaccctagttaagatatggaatattcctatcacccgcccccaaaatttttcttatttccattctgttcctacccatccccactctgagaagcaaccgccattctgatttctctccccttagtttgacctatagtagaacttcatatcattaaatcatgaagtcttcacacttttgagtttgcctttttcactcaacatattgtttccgggatatgacattgcatgttagacgtggagaattcaacatggtagcttctgttttattttttaaaccggaaactcctaacatctaaaaatttcaggaactaccaagggtctcacagtttacccagcttgctagtctgctgcagttacatgatgctggcagaagacaggggactcctgggtcagagacaggggattttatcactcagagcatagaagacagcatgagcttcatgtggttgtcagttccctgtatgtcccaaaatcctttcaggggcaatgctgagtgtctcaggtggatgcttgctcacagcggatttgtgtcattgctcagtggtctgtaatgcagccatatcaggaaattcccaatcttttaaggggcttctagcaaagctgcctaatctttctctgcagggaggtgttatctttattatcctggtcaggaaacaaatctgtcctctaacctggagggaggcaccatctctagatgacaaggtggtttgttatgcaaatatttttgcaaggacagtctggtacaaaagctgttagaagatgtgcagtaatgccatgagaaaattctcatttaaatctatttctgcaaggtaactctttcttccttttctatttctcttggcactgccatgcttactgctctgttgatgtatttactctttagaaaaataactgttatttggaaattatcttaaaatcgatcatgaagttttgagaaggtagtatacatcctatatgataaacttatctgcatttattaagtaactaatatgtgatatgttaacattacatgttagttactgggggagatttaaaacattctataaaggtttggtctttgacccacaagtaataaaactaaatgtatggagaatactagatatgagaaagaattctgctagaaaactcatcgaggatgaaaggggaagaaggggaagaaggggaaatcttttagagaagcatgacctaagttgactcttgaatgtgtgtttctattggtaggagagataagcatattcttggcaagaggagtaatgtgaatgaaagtcaaaggctgggattatttatggatagagtgaaaggtacatgattgggagttatgggaagttaatggaatcatattttagcggcttagtgaaatcatattttggggtccaaaagccttgtagaggaattagctgggatgtggtgaaaattagtgaactagagaacttttccaaaaagagaaacgacatgattgagaatggctcaattataattgggttgtataactgattgtggggaggggcagtactaggaggaaggagggatttttgtactaagaaagcaataaaatgaaaatgtccttctgttagttcgaaatgggaaacaggagcttggatgaagggatggttctgggtatgtaatatgagcaggagagaaattgctcagtaattaggaagggatgaatcgaaggcatacgttgagaaattgtgggccaggaagggcattgctttcttggaacctggaaggatgcgtgaaacagaaggtgtaaatgagagacatgggagtcaactgtggactgtggtgcctcatgggaaagtggcctccatcgacttttggaagtcatagatggtttgttgagaatgtgagataggaaatctagttagcaggtacatttatgttgttgttacatgtagttgatagttgtctgagcatacattatacatctttctatacaatttgagcctactttgtagttttaattttcttatgcaatttggagtcactttgctagccctgatgacgttactggctttctaaataaggggagaatggctttgactactttcttcaagatacactgaacaactttgtagtattgacatactcttcttagcagcattttatttccctgcaaaatgatgttttctacattgagtacacatggacacaaagaagggaacaacagaccccagggactacttgagagtggagaaagagaggaggatgaggagttgaggatcaaaaaactacctatggcctgggcacggtggctcgtgcctgtaatcccagcactttgagaggctgaggcgtgtggatcatgaggtcaagagatcgagaccatcctggccaacgtggtgaaaccccgtctttactaaaaatacaaaaattagccgggcgtggtagtatgcgcctgtagtcccagctacaggaggctgaggcaggagaatcgcttgaacctgggaggcagaggttgcagtgagccgagattgtgccactgcactccagcctggcgacagagcgagagtccatctcaaaaaaacccaaaaactctcaaaaaaccaaacaaaaaaaaaactgcctagtgggtactatgcttattacttggatgagaaaataatctgtacaccaaacccctgtgatacactatttacctacataacaaacctgcacatgcacccctgaacctaaaagaaaagtttaaaaatataaaaataaatgatgatgttttctagtaaagccctgcaactaagaaggactgaaaatgtcataggctatttggatataaggactttttttttttaaccagtttggaccattattttttctgtaagaattccagcatgctgctgtggctctagtgttgatcatatgttttagtaacctttatgatcattgcttagaggagatacacattaaggaacagttggctaaaagcacaacttttagaaataatttttgctttccttactcttttctgttataaaatttgaattgtgtttcaaggggtcagtatctggctcctggatgtttgaatgcttaagaatgacacaaaatttataaagtgatattttaaggaaggtaacttttgtgaaaatgagagcaactaaattctcaatggctattcaaattttataaaaatgtaactaataatgccttattctcagcagttgcaatttctttgatttaaaactaggatccttattggaaatcgtggtttataagactggtatttatagggccacaagcatgattcatacaagaaggggaagggtccattttaggtggtgatagcagtagtagacatactgtggtgggagcaaattggcagcacaaacctgaattctgtcattttagtgggtgagtgagtagtgatttaatcaaacttttcgcaaatgagtgcgaatgcaatagacagctgcacagtactaaatcctgcagcattaaataaacggtttgaattttgtatgaacataactttgaatgaaaaagtaaaatgtacaccctttccatgtagaggtgccacttcggagtcacgaacaaatctgtgtcatatggaaatgtgcacagtttcctacccagcctctctggtgccaactaacttgtatttgtgagagcctgaggaaaggaagtcagggtcattcagttcactctgtgtcttacaactttactctcgcttttgttattgaaagcagaaggaggcattatgtcagcgtatcttgataacagtttttgcctgactatgctttttccttttagtgttacagttttaatgtaagacaaatctttgaccattttttatgtatcctttcaaatttataattggtagaaatacttttaaatatttttgtaggggccaggcgcgatggctgacacctgtaatcccagcactttgggaggctgaggcgggcagatcacttgaggtcaggggttcgagaccagcctggcagacatggcaaaccccatctctactaaagatataaaacttagcctggcttggtggcacatgcctataatcccagccacttgggaagctgaggcaggagaatcacttggacccaggaggcagaggttgccgtgagctgagattgctccactgcactccagcctgggagacagcaagactccgtttcaaaaaaaaaaaaaaaaaaattactgtatattttgttgggagctattcttatctccctcccctttagaattacaagaaaattaaggaaaataataagagttagtactgttaataaatatgccagtgtaagttcaaggaacttcaaaaattgtgtaaaagtgacgttcgggtaaaacacatcatatttatttcctaaacgctatattacattatggcaaaattgctgtattttaagctgctaaatagtgaaatactgctttaacacagtacttcacaggttaaatttttgtttgagttttcccaatttgaaaggcaaatacaaagcaagttgaatgtatttatgggtgtgtatgtatgccagacatttagcttgggacaaaattttaagtgtttgtgcacttaccccatctgttggccattagaatctttcacccaagagagctactcagaaaggattgatattaatagtaatttgaagacagaaataaatagcttagaagtgggttcagtacaaaaataactttttgtgttttaaatttgtgattttgaaaataaaaaatgatatttcatatccacatcagttcatttcatggctttcaagtagcttttgttgagattattttaaattaaaatttagatgctgagatctacagaataggatgtaattgaagaacaagacatttttaagtatgtctgtttcctgtatcaggtttactagtcaggcatcttggttattggtatttattcattggtacagtataaccagctattactcacttcttctcataagtaagtaagccacatagataacttagaagtaagtgttggaatctccaaatgtgtggtatatttaagttacattataggttcttctataggttcagggttgtctgataccatgatttttctgtatactagcaggtattagaagaaaggcagaaaataagatgcaaaagaaaaaatatgtagtcagtaagtctttaggctattcaaaacttcacagggaggaaacgaaaaatgttctgaataattctgttggctgctgtctccatatggtcattgcaggagttttaacatatcgtatatcattgatttctattgtatgtggttagacatacttgacaatagttgccaatacttttaccttatagtctcctaaggactgctatgactctttcatatctccttattaatcttttatgtaaaagaacaaaaggtgaaaatctctggtgtaggtgctgtcctgcattattttttgtttattttgtttgtttgtttttagttttcctttagatactttgtaagcagggaggagattcaaaggttttgattccaagacttccttaaaaattaatcaacttgtgatgactttgagagctgatctccaagttgatcagaagcgatggtttaataaaacagtaaataaaatatgtagactgtggcatgtatctgtaagggtaacatttaacagttttttttctgattagtattgtagggtacagtaatatcatagagtaatctttcatttttgtggctctgatgctatagggctcaagaggagggcatggcaggcttcctgcagggcataaaattctgactgactcacaaagaatgattgaggattagtcgggtaggaaaggcacaaggtaattgttcaagaaagagaaaacagtaaaccttaaatatttttaggggcatgagagagtgtggtgagtaccaagaatgacaagtatacataaatgaggggtaggaatttgagttgatttgccttccagtagacataatgatatgtgaaatctgagagttttaccttatcaagaatatttatcctttgtacctcccaaatatacctctagtagttctttgtcgtgtaatacaagagacagatttgcagccattttttaatttgccacacatgatagataatattctcatgtctaatgcaattttataaatattttttcctacccacaagttttaacttcccttttttgctacatctcaaaaaaaaattataaatcatgtaacagaaatgctactagaaaaatagttttgaatacattttgattatagaaaaaacaaacattgaaaaacactggaacttttttattattaacaagttacttgaataacatcttgcgtctgatcatggcatgtgagtaattggaacaccatgactgagaactgatattacattttaacatatgagagttggtctccttttaaaaaagatattaaaattttttgtaacatttttaatgtgtgataccccatttcagatagttgatttcacacccaacccttcctgaattccttctacatgaaggagagtgcgcttggccccatgggtgatacatgaatcagacagggtcttaatcttcccaaggggattagagggcactggaaagttggataaaaatgaagaattgctggggatggtcaatcctggagctaaagcagtgattgatagaggtggaggaataaacggatctatcctcattccccttttttctcccattccctttctctccttgtcactgccagtcatgacaggagattctactcattggaccagattaggaatagatttggactggaatatttccaaacagaatgaagagtacatggctgtccttagatagcatttgataagttgggtacatttttaagttgaaaagatagtaatatgttgaaaatagtaatagctattacttctacaaagtaggttatgactggaaattggtttattgtccaacaaagctgattgacaatgcttttagggcctttgtgcattttttcttttaaatatgcttacttcaccacaaataaacatatttgtctaatgaatactaacacaacttcaaagaacttttttgttatttaagaaatctaaaataattgatataacaattatttttataacatatttttatgtaagaaatctaaaataattggtataattgatcacaattctagttgtaattgcatttcttaagcccagattgagttataaatctcacttttgtaacagctttattgaaatataattcatataccataaaatttacccttttaaagtatacaattcaatagtttttagtatattcacatagttgtgcaaccattaccactatccaattctagaatattttcatcaacttaaaaaagaaatcccatacctattagcagtaactctctatttccccattccctatcccctggcaaccactgatatgctttctatgtcttatgaatttgcttattctagatatttcataagaatggaatcattcaatatctggcttcttttatttagagtaatgttttcaagattcaagcatgaatctatatttcattttgtttcattattgtatagtattccactgtgtggatatacccctttttaaaattcattcttcagttgatggacatttgggttgttttcattattttactactataaataatgcagctatgaacatttatgtatacatttttacatggacatatgtttcaattcttttgggtatgtaactagcaatggaattactaggtaagatgataatctatgtttaacattttgagtgactaccaaatgtttatcaaaacagctgcacattttacattcactctagcaatgtatgagggttctaatttctccatatctttgtcaacacttgttatgatctgtttttttgatagtagtaattttggtggctgtgaagtatgtcattgtgtatttgatttgcatttctctaatgactaatgatgttgagcatcttttagttgcttactgaccaattgtatatctttggagaaatgtctactcaaattatttgcccatttttaatagggttgtctttctatttttgagttgtaagagctctttttgtattctagatacaagtttcttatcaggtatatgatttagaagtattttatcccattctgtggattttcttttcactttcttaatggtgtcctctaaagcacaaagttcttaatttcgttgaagtctagtttatgtgtttattctttgtcacttacatagttggtatcatacctaagaaatgatctcctaacccaagatcataaagattttgtcctaagtttttcttagagagttttagcccttatataggtctgtgatctgttttgacttaatttagtagatgctgtgaggtaggggtccaacttcattcttgtgcctgtagacatctaatttttcaaggaacatttgttgataatctcatgggacatgtaaatctcattttgaattgacatataaccaaaatacctttttaccattcttaatttgttttaccaaagaacactctaaaaatgtcctggtgtttcaaagaaataaattattgtatattacatgaaatgataatagggatactgtaaacattttttctaacaatgcatgcctacttttactatagctttacttagaacttttaaaaaattaatactcttgtgaaacatataagcactttcaagaaattaatatcctcttgaaactagaacatgttttagcccattccggctgctataacaaaattccttagactgggtatttattaatttctcatgtttctggaggctgaaaagtccaagatcaatgcaccagcaaattcagtgtctggtgagggcttgctctctgcttcaaagatggtgcctacttcctgcatcctcacatggcagaagggaagaacaatcttccgtgagcctctcttacaaaggcaccaatcccattcctgaggggagagccctcatgacctaatcatttcctagaggctccacctcttaatattaattgcattgaagattaggtttcaacatattaattttgggggaacgcagacatttagaccacagcaaacactagactatttgtagataatggagtgagcaatttttatgtacagatggttgctgacttagaatggtttgacttactattactcaactttacagtggtatgaaagcaatatgcattcagactgcccatacaaccatcctgttttttactttaagtacaatattcaataaattgcataaggtattcaacacttcattataaaataggctttgtgttagatgattttgcccaactgtaggctaatatgtgttctgaacatgtttaaggtagactgggctaaggtaaagatgattagtaggttaggtgtattaaatggatttttgacttacagtattttcagtttacaataggtttattgggacataaccccattataagttgaggagcagctatatttatctttgattaaaaatggttctgactctttatctgtgtttatttttcaaagcataggcatttcattaatacactgacaatatggtgctatatttacttttaatttgtctacttagttttaaagttaaatgtaatgaaagtcaggattcactgtgagatgtaaattacacttcttgtatttaaatttatcctggtttctttattaaatgtctcttgcaaaacgtaaacattccttgatttgaatgtaatctaaagttgtaacagaccagcctctcctgctgcagctctctgtgctttgttaggaaaatacccgattgagtagattaaagccctgtcatcataagtaggtagagcctctcctgaagtagctagacattctcagggtcaatcatctgaggaaagttgcagccatgaacttgaaccctgaaactgggagttaactagatagcaaaagggacttcatgctctgtttcatacatttcttgggtttggatatttaagttgctagatataattgggcatttggggcaggttagagctgaatagggaggcactcgtgctgaactttaaactgaaaacaggtaaactatatgcctgttccatgacattctgtttacttggaatgtcagttccatgtatgtcagttccatggaatgtcagtttcatgacattccatgtaatgtcagttccatggaatgtcagttccatgacattctatgtttacttcctttgtattatatctaaatatttggttatcttgcatttaagatttcagccttgccttggctgtgctctgagaaattaagaaaagggacatttacctttgcttaaaccagagtgttaaattcagagagtattaaactcagagcctcactcactattctctcttttgaagccatcattagtgagctatctaaaggggaagatgagtctctggaggcttgaataaggctttcagagacctagctggctttccagtgaaaactttggaggctcttggtttattttcttaaggaatatggcagtttttctcttaaaagataaaccttttgttttatgatagcaaaaaatattttcttttcagttacattgccagagaaaagtacaattatgtgagatgagttgctttacctttctaacttgtttactcgttagataagtaaacaaagttggccttttagaagaggtagacttgttaacatgaacctgttaggatgtaggtgttcttttgccttaatctatatgcacgtgttacattcagaaacatagtaaatgtttgaccactgaactatctctctttctctctttgcatattggatgtgtatatgtgtgtttgtgtgtatgtatatatatatatactttaaactgaaagtttaaaaatatatatacacacacccatatataaaggtatatatatatatacatacacatatatataaatatgtgtgtgtgtgtgtgtatgtgtatatctatgttacctaagtgtacaggtaaatcaaatgtagagaataaaacatatgtacctttgctgtttctttacttttagtgtcaagacatactgcttgatgccttgtgggtttgctgaatgaatgtagttagagtaatattgatttccttgaaaataatagtggtatgtttctaatgcctttaatttagatatctctagcccaaacttgaaagtagagctctttcagtacaaataaccactttatagagatttttgatgatgttattataatgttaaataatacagtgtttaaaaattggaatttcgatttgcctgggtatttccctttaatagacagtgtcctccagaatgaatgaaaaagctcaatcttttatgtcctccttcataggctggacagagcttttggtacaactcctagacagatgatcgtaccttcttttggcttgtactggtcaaagtgtgcccaatcctgttgatatcgatgggccagttttatgtaaccctgtgtaaaggccactaaatgcctctgtgttttcattgtcttactttgcaattattgttagatagtcgtctgttttaaaaatcatttttgttgcttttttttattgataaagacagcactatatgaactttggagttaaagatgaaaattctagctgtaatttctctgtgcctcaggattctttttgtttttttgttttgtttttggtagtagagggagaataccgcctttaaatatgtagtgattaaaagagaagatatatatatatatagatagatagatagatagatagatagatagatagatatagatatatataacatacttaatgtaaaacctagaatgtagatatttatttattcttgcctgtccatttccttgtcagaaacaatgttagtttctttccttcgttctctggtaaatgatctatgctgaaattaatatttttatttgtatagtattttaaagcttttacctatagctagtagcatagggcttataaatcaatgaagtttttaatttttaaagactttatatttttggagcagtttttggtttacagtgaaactgaaaggaagacatagagatttcccttataccctttgcccccacagatccatcacctctccattaccaatataccacaccggagtggtgcatttgttacacctgatgagtctacactgacacatcatcactcagagttcatagtttacattagggttcactcctggtgttgtgtgctccatgggtttagacaaatatataatgtattcaccattatagtatcatgcagagtatcttcactgccctaaaaatccttgtgctttttaaaagtatccaagttaagcttgaaggtagacatattagaggcctagtaagagccttgttctgtcactgagtcttcttttgtaccttgtaggcctaacgagttcttgatttgcaagcctttaggacctaaagaagcctagaacagtttgtgttttgcctacagtgagactggctatagacagacagttctgaagtcttatattgttcttgaattgtaaagaaaattgtcaagttatctgtgctagaatttttttgttgttgttgagacagagttttgcccttgttgcccaggctggaatgcaatggcacgatttcagctcactgcaacctctgcctcctgggttcaagtgattctcctgcctcagcctcctgagtagctgggattatagacatgtgccaccacacccagctaattttgtatttttagtagagatggggtttctccatgttggtcaggctggtcttgaattcccaacctcaggtgatctgcctgcctcaacctcccaaagtgctgggattacaggcgtgagccactgcgcctggccctttatctgtgctagaatattaagatacctgcttttcttgtatgtactctaatattagtcatgtgtatatgccaaaatggatattttaaaatattttctagacttttataatgtatgtatttcacttcatttttactattctcttccctaattatttacacctaaaaataaatatctcaaaaactttgaggtgaattttatggtcattcccattctctgatgctttttactctagttataaatgaacaaagcacatattaaagcaaactaagtatttaagccttagctttgctattggtgattctgctcacacctgaacactataaatagcctgtcctgtcaattttttatattcatgcaaattgtagcctttcctttattcctacctgactactttgtgctctgtcattcacttctttttcttaggaaaaaaaaaaaaggtgacctagatatttgaagactagcttgaatttgcctttttcaaggaccttgtaggaaactctctgctccgtcaataagcatcctgtcttgggtggtagagaagttgggcccaataagcgcatttctcactgcaggcttcaggtcactggggctgttcctcacacttggtgcccatgggcttgtgccagtgacagcaaacaacaaacttctccctttcttgggaatatcattggaaaacatggaattccaatgtgctcagagaatatggtttagagaaacttgcaagtgaagatgacctgattcaaaatgtcaatcaactaattaaataattgatttcctattgaatatttaatatcccagcagcaattaaacttcatttaaagttacttcatacttccttggatattttattatttagaatgttacagaattatagcgagggttttctttttccaggagaggcaatgggtgaaaggaaatgtcttttagagagctgtagaccagaccattgtgtatactactcacaaaggaggcctgggctataaaagccatgatgacatcatcagtgtctgactgctaattgaaaacctgggaatgaatgagggcatggaggagaggcagacagtggaaggaaaagagcacagaacagggttgtattagtctgttcttatactgctaataaagacatatctgagactgggtaatttataaaggaaagaggtttaattgactcacagttccacatggctggggaggcctcataatcatggcagaggtgaatgtggagcaaagtcacatcttacatggtgacaggcaagagagcttgtgtagggaaactgccatgtataaaccgtcagatctcgtgagacttattcactaccatgagaacagtatggggaaaactgcccccagattcaattatgtccacctggttctgcccttgacacatgcggattattacaattcaaggtgaaatttgggtagggacacagccaaaccatatcaagggtgcttacagattccaatagttaatgaaataataggcccagccacgcatttttattgacagtagaaccagcagatttattccttaaaatttcgatgtcaatgtggagatgtactctagatactacagcttcaaaattaacagttttttcatttcaattaggtttgaattcaagaagatacattcaaagaaaatatatattagtacatcctattcttttggttacgatttttgattttacatgtgcagttttaaatttgttgttgatctttttaaggaacaagattggaaaaacaaacaaggcagatagcttttattgatactttaattgctgatttgggtttgggttctcttgagactagaattgttttttcttgcatgaaaagaaactctcatgaatatttttccttactggaatttggaagatataacctaaaataggaactaaagtttatatttaaaattgtagcctcccatataagcagtcttatttattgaatttcgagtatttattttatttcactcagaaggtgggttttatatgtatgattttaaattttttatttgtaaagccttgcctagtcttctacaacgttattaaataacgataaattgagtcaaagagttgatttccagtcattaatttactacaaagtcttatgctttcagttaaaacattttattatttgtattacactatatactggctgatttgatcaccgctgtgtcttgtacactgtgctagaaatcaggatacaggagcacaaaatacttaatcttggctctagctgagcacctgcccctggatcgatcctgcctagtagtgaagattaagacaatatggatgtagatttcatttgtggggtgtaactgtggcagcagaggtattactttttaccagcatgagtgacctttcctatcactgtgtgtttccagttccatttgggtacagtgagctgaaatgattggccagatgttatggctcatttttctaaagtctccctttaactagttgtgttacattactctgcctttttgaactctgttttgtttagttcaaacaaacaaaaagtttagtcaaccaaagcagaatttagcaaatgtgtatttattaatcaaaattctctcacatctcacatattctttatcttgcagaatcagcataattcactagcaagcctgtattttaatgaaattgtttcaggttactggaaatttagttaaaattgcataaactacctatatctcttgaatcacttaaaaatttactttagcccttaattgaaaaaccaccagaagaaattgatttggttttgtataacgtaattccttttggtgaatgtttagtaaggctaaagaatctgacacgtctgcttactgacatatatatatatatatatatatatatatatatatatatatatatatatatataaaatatgtaagatatgtattaaaaaatatgtgaaatatcacctgaaactttaaaatttacttttacatttattattcttcaataaagtgaataaggtatggacttttgcagtgataaaaagaatacttctgccagcctttctacttcacagctgaacataatcacttaaatgaaccatcatgcacttagactgcaaacatactccccttacttttgtagtacaaccatttgtgcccattgaattgtaagttccaaaaaaatctgactctggcttactcattaataaatgttcagtacccacatttttgtgggtactgtgttttgctgacagtagatgctcagtatatttttaataattgaattgattaaattgtttattttaaggtctcttcaatagataatcagaacttgaaagagaagtgtaaataatagcagcatcttctttgtactttgaaactacatctagaaagaatgactgtaacgatgtattcctaatttgtatatccaaagacatttcaggtctgctttagtacgatgtcatagtagggtcacatgtacaattagacatagactttcagagttgaaaggatcctgaaatgtcattattccagctttccatccaatgcttgagttccttctgtagcagttgttctcaacttttgctgtatattagaatgagttggcaagttttaaaaatctcagtgctcaggtcccacctcagcccaattatatgagaatttccaggggtgagacctaagcattgatatttttttagaaccccataggtgattccagtgtgcattcaaggtagagagctgttgttctacaagatctctacaaaatgtttttccaatctaattgaactcctctgaagatgagcacctcactaccaaagtttgacttgtgtttattccatttattcaaataataagtataagagtgtttaaattataagctggtgaagtgaaataacacaaatcaagctcaccaattttaatactcagctgttgataaacaacactgaagagtgacatttaaatttgaattatcttctttgaagtagcattgcagcacttttgaatgacttccaaaaggctgatcataaaaatcacttcaatcattttcaaattttactttagcagcaatgaagttatttggtatgactcagatgaaccttctgctctgtcttggagttattatggtcatttcattttctgcaacctggggaaacagagaagggatgagcagacttgtttttacatgtaccttacatatttaccttacagtgtttatagttaaaagttaggcactttcagaaatgtgctagcttcacaggaaggtaatttaccatgtagaaaatttcaaatatactgaaaaaattgagtggaatagtgaaggcttggattttgtaaagctctttgattttagagaagaattttcagaggaagcgccatgtgaccacacacacaaacacgcaagcctgtattcttgcttaggaacttatctgtcctgagaccatccacctgtatgacagctcttttgagtacctttacatttttggttctttagtaggacctgggtacgaaaagtcaatatataacatcactgataaatatttaagtagttctaaggtcttaagagctgtgtttgagtttcacctcccttcctactcatggtgtagccttgggtaaattattattttcagccttagtttccctatttttacagtagaaagaatgccatatatcttgtaggaatgttatgaagatttatagtagtaatgcatataaagcttcacagtagcccctgcgttgtagaaagggctcgtggacttaaattttgtgatacattggaataccagcattgctgggcagactacaatgacgatacattttcttgtttttcctgacagtggtaggaaaaagtcctgagactagttctgtagagaacatcatctgtatgctcctttataaaaaaaaaactattctgagacatgatcttagattgttcctttaccaaaatgagtttcctgttggaagtcctaatgccacagcacatgggtaaacatgggtctctttaagaatatagaggataggggatggttgacgcccttagattttctctggggaaccaggaaagctagcctttctagtggcatacgtcaaccaagactttcctggcatgtcttcatcgctagtcttctcgtctgctgctttgtagagttgccagataaaggacagccatttaaatttgaatttcggatgaataactagatttctgttagtataaataggcctcagatgttgcaagggacttttatatttattcattatttacctgaaattaaaatttaactgagcatcctgtaggtttcttattttttctaaatctgacaacccctacctacgtgctatgtaggaattttggggttagatgttgggcaggttttatcctagactaatacattactatttttgaatgaagtagagagaaatacttcttagtaagtgaaaagactaaattatagcattaaaatggattcattggttaaaatactacaaatatgattgttacaaattaatatcaataaagaaaagtagacgatgatccagatagaagaacatcttcctacttatctgatcccaagaacttcagggaatcttgaacctaagcatcttccaactacatacttaaggcatattaaagagaatgtgtgatagtataagtatatcctttttaaagaaagtctgaaattaaacagggttgaagtttgattattctttgtttaaagcttgttatgtacattttatttacatatattttacatatatgttagtgtagcaattcctaattactccataacacactgaattctcctttctgtaaacttgtaaagcatttactttgttattcatttattcatattaagtaagcatcttatttaatattcttggcacatcgatcttctatgtgccaagaattgtgcttagtgctaagggtataaaaataagagcaaatctctgtccatgtggagctcatcatacagctctggaaacagatacaatattgacattataatgcaacgtgacaagagctataacaatgaaatgaattgcttctgagatccagaaaaagtagtctgatggaggtttcactggagaagggacatttagactggattttctaggatgaatagaagtttgctggctaagaagggaataaggctattttaggcagaggagagagagagataatgagtaaaaaagaataaaaaaaccctcaaacccagcaccccatcctgtgaaataacctgttgtgacttggaaccagtgagaagatggcatggggaggggcatcctggaaacagggtagaatgtacagagttggtgattcgatttaaagacaggcaagaggagcccatgaagaacattttgtatcaggttataaattttgtttttattgtatagtcaacagggttttaaataagactgaggccttaagtcggtaagacctaattgtttgtttcaggaatatacctggaatatgaaataacacgtggccagaaattattgcaatagttcatgggatacatgaggacaataggaatagtgtagttgcactagaagtggagagatcttgaatgcaagacatttctaagttagaattattaggatttgaacaatttttctgttggttttttttttttttggtatgcggaagaaggtatgaggataaaaaatagggatagttcatgtatgtgaactatgtgtgttatttccttaaggccttaaggtcattagaggcagggtttctctcctaacaaacagtactcaatacattcttgttcaatttaagaagaaacacaaaatgtttaagatgggtgcatttgtgtgtctgtacttcattattattttgacaaatctagtcggtattataagaataacaggatgcacattggcaaacccattttttatctcacttagttaaataaaataatccagttgtctgacacataatgattttatcaaaattaacctttgtctttgataacttctgccctgtgattgttatcatttactttaaaatataatcatggccaggtgtggtggtgtatgcatataatcccagctactcaggaggccgaggtgggaggatcaagaccaacctggcaacatagtgagaccccatctcataacaaacaaacaaaaatatttgtatcaaaacatcacatgtaccccataaatatatgtatgtatctattatgtacccataatcactaaaaatttaaaaaataaaaatataataatgtatagttcttttcattttttaatgtgtcaatagaattgttctttgatgccaggcatggtggcccacaattgtaatcccagcactttgggaggccaaggcagggatcacttgaggccaggagttcaagagcagccttagcaacatagtgaaaccctgtctctacaaaaaatttaaaaaattagctgggcatggtggcatatgcctgtcattccagctactcaggaggctgaggtaggagcattatttgagcctgggtagttgagggtgcagtgagttgtggttgcaacactgcactccagcttaggcaacaaagcaagaccttgtctcaaaaaaaaaaaagatttattctatttgatagttaaagaattcaatgctgggtaattctgaggcagaccaaattgtggactttgaattcgtagttttagctttgtcgctcagcattaaaatcataaaacctgagacaaagaagcaacaagcagtaatgctttatatgtaaggactttcttgttccaagaaatgtatcaccttatatacaacacaatgtactatttaaatgtaacataaattatatattcctatgcattatttttctgttcatgtatatttttatattcacaaatgctatttgtgagtcgagttttacatgggtgtattaagggaggcacaccagttgatgaggtcttgtgtgaggtctttaaacacacccagactctaaggcagcaatggataaccttgaacaggtaaggagcaggtggccttagggtagggagaaagtgcgacattgtaacatccctttggataatgtctgcagccagatcctgtgtcaccatgactcagcatcgaacagacattgattgcacagcataaggagcacacaggaggcaaagctggtctgtcacatggcaattagtttgagacaccacacctgtattcccacagcacatctcattcccccatatctttggctaccacagaggaaagcagaatggatctgggcaatttattgtcttacttttgttgaggagagggagagcagcagaatgcatgctgttccactttttctgtgctgcagtgggcatattggtcattgctgggagcccttcaatgaaggacagtgacagaacaccaaaaagtgtcaggagcttccatgtggctgaaaaaccacattcaaaggacatcagccagtgttctagtgttaggctgtgacttgggcatgtaaatgggccaatgattccagttttgcatggaaaagacacatgattagtttttcagtgaggaagtagacaagttttactaatctgttgactgagaggttataatatactcatgatgaaatctctctggagcaagtcctgtgaaacagtgtaatgacttggcacaggatggctggattcgctttaaaaaattattattattcatgtttatttaggtccaaaggatccattatacttcagctttatatgctattaaatttagagatgacacaagtcaggacacatcttacatagttcctttcatgggacaaaagacctgatagaataaggtggcatttatgggcctttaatatcaacattacaaaagaaggggaattgcattttctttatatgtaagaaaataatgactaatttagagtaattctgaaatgaaatcatggcattattgtcaggattggtaaatcttttaagctattatcatttctgtcatgcagctgcattcaatgtcttaagtaggcaatgtgatattttcacaggaattatcaaataaactcagtatgttagcttctcagggactctggagctttgaatatagaggaggagaaggtccgatgaggggaaaaagaccttctgaaccccccgtggtcataattccagggaaagaaggagaagaaacttaaatatttattaactccttactggctgttaagatttttaatgtatttcattccctttaattttgaaagcaattctgtgagttgaatattatttcgatttttttgctaatgagaaaacaagctcagacaaggtgaacagaaactgacatattaaaacccctatcatgtaggtactgtgtaggaagttaagatgtattttctcatttaattatcaaaataagtattattttatgtacgtgaattaaaataggctagattatactttgttaacaaatagaccccgaatctcagtggcctagtaatataaaggtttatttttcgctcacacaaagtttactctgatgccaggggacttcccaagccagttcctcctgtggttccttggcagtcgaggccaagggaagggaattagcaccacgatgcggtcacactccctggaatgaggactccttgcttgttgccgcagggaaaagtaacaggagaagagtgcatgggttcttaaggcctcagcccggaacttaggcacgtcctcttccctcttagtccatcgtccggggtctagtcacatgggctcaccgcaccgtgggcaggctgggaattgcgagagagaagatggatagcagtgaccccaactgggtctgccatggcactgtcacccccattttaaaaatgagaagactgaagttcagagaggttagatcatgtatccttgatcacttccttggtgatctgtagacttagttcttgaaactagatctctctcagtccaaagaatctgtttttttgccctctactccatcttacccgacacacactccgagtaatttggtggtttggagttaggtgtggatctgtggtcgccagccttcaagatggctcctgtcatccttgcctcttggggttcatgcccttgttgttccctctgtcagtgaatagagctgacctgtgtaaccagtgtggtattgcagaagggacaaagtgtgacttctgggactaggtcataaaagacagtggtgttttcatgtgtcagtgctctctgttggatcacttgctctggggaaagccagctgccatcaggtggggacactagaggagccccagggagctcccatatggcaaggaactgagacctgctgccaacacccaggaccaatttgccatccatgagagtgggccgtctcgaaagtgggtgagtcaacccaggtcagccttcagatggctgagcccaggccaacatcttaacagcaaactcatgagagaccctgggccagaaccactccactaagctgctcccaaataattcttgacccacagaaattgtgtgaaatgataaatgcttactgccattttaagaagctaagttttggggtaatttattatgtggtaatagataacagtacaaacctttttggattatttcctttctctgtgtttttccctcaactctgggacaattcctgcttttaacggtgagtttttaagttagctaaatgagaaagtaattgccacacaatgttattaaattttagttaaatacatcttattatttactttaatcttgtagttctaggcaagctctgtatgaaggtctatactaaaaaatgatatactctgctagttcagaagagagaagttttgaaatttactttccatcagatgtgtatttttctgttttaagatattacctgcttgagattattttatagtttaaattacattgtgaagttttgagaaagaacaagccaagtacatttttattaagagtttactgtcaggaggaagacagaatctagaagtaaccgcttttttttttttttttttttttttgcaaggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatgtgagtaatcttagatcattcatcaaagaacaggttatgtttacaaatataatggttttaaggaatattataattcagcatcttgaccactggtactggtacgacatgttataatatactgtgcttttaagtatttcagtcactcatgatttactctttaatgttgtacaatgtttctgagattgtctctaagctgggcaatcttgtgtttcccagggtaccaggaggggaagactgggtacgagtcagtagtctatgaactccagtgaaaggcagcaggatacaatttctatttgatttaacattctcttaatatcgctgttttaataaccttgtgttgggtgagataaaattttcttaatgaaaaccttttcactaaccattgatgcccatttgctccctacccccattaacaaacacttcctatatatgcactctaaactttctatcttagcttactttttgacagttgggcaaatgacagtggagagaacattgtttagatcaaacaacatattattgttggaaatatggctgtctcatagaaatatagccaagtcagggaaatagtgactatatattatattcacatatacaaattttgtaggtctacatatacaaaaaatacagacacatatacatttccacatataactatatataaactatatataactataattataactatacacacacacacacatatatacataaacaggttggaagtaggagatccccaaggaagtggagactgaaattcagacatgaggaccttagcaaggtgagtgagacagagaactgatgagagattccgtgaaggaacatctaacagattttagtggacaaagcaaaacaaggaatcaaagataacgcaaaagtttctaatgaaaagtcatactttaacaagcatggggaaatataattacaaaattttgatatacataataatttttatgagtagaatccagaggggtggctgcagcaggaattattatcgccgttttgtaaatgaagaaaccggctcaaagaattctaattgatttttttaaggtttcatagttagtcgaggataaagccaaaattggaatctgggggtgttgacttcagatctttccatttccatggattcctctactggctgtccaggcatggccctctaggatccatgctgtgctatcctgtcatgcctaggctgtgtgtgtgtgtggactttcccgattagaggacccagactttgagattctcaaaggggctgtgactcgatagagcttaagaactttgtttctccctggtgactgcctggctcaagggaccaaaaggatgccgaaattagagggatggtcctgcttaataattagatcatggaaaattacattcccacaatggagaaacctagtggtgtaaagacaaaaaatagcaagagcgttggaagttaggtaaatttttaagggaaaaatcttacttgggactgggctaactctgcatcccacttagggaaacaggtcagactgaacagtttaggccacatggatgttatgactaagcaacagttttgcatctcgcccatatgtgtgcggtttccagttttttggacatttctcccatagacagttgtttttgcgctgtgttgtgtgctgatgctcaactgcagaggaactgaatggagaagttcggagagaccgtggtttctgaccactggctgcggtgctgtggatggttccagtgaagggtggatgccttttgttgaaaactcgcttagactttgtcatcaaggtctgtctctgccattgtataatctaaagtcagatctgtttatacttcgtaagtattgttggatttaattggcaatatatagaaatgtctattgagaagtccttcaattgccataattccttttttctcaggagtagtaaataggaaatactcttaagcatgaaatagtgaagagctaaagtgggagggctggaatttgaaactgcctgaacaaactcagtctgtagaagaaccccactactgttggagttactgtgaatatgtgagcaaccttctaaggctgaattgagtccaccatgaagttgtggcctgttatacacatttcaaaaccatgaaaacaaattggaatgaaagtagtgtcatgctaaagcatcctggttgctcttaaacctcaagcgtggtgcctggaaacatattttacagcacaagtgcttttgatcatttgagtgttcactaaggaaatcattgcattgcattattacagatgtgcacatttgtcctgttgaaattgacttaaaaagtttagtgtaaaatccagtggcacttacggcatcttccttataataaaaaagtagcaataacacaatttccttcagatccacaaccacgtacctgggtacccaaatgatctaaaattgttagcttagttctgcctccatctcaggtgcaaacaaggaagctgaaagtgtgtttgggggctaagatattcaaatgcaacaaaatggtagtcaagatctttcttcaggaaaagatccattgaaagatgcttgaccggatcctgcagggcactgagttccattcccctgaaaaatggaaatacctccctgttaaatgttagacatgaaggtaaagaatcttggctatacatttgtggaagacagatagagaagaaatcaatcaaactattcagagtggcaacaggacaaataaagagctcccaacagcggtcacaggcagatgatggagacatcacattagagaaataaagaataatatattttctctggttcaagaaatgccttttgtttttccttcttgcatgataataataaacattaatcttaatggcagaatcctgctatgggaaaaagagccttttctaacggaatgcagtggtggtgtactggaacacatagtgttctaattgagcatgtaccatgcctacatttttagagcactttacagtttacaaagctcttaatacttcttatctcatccaaataggctggagtcctatttctgatttcccagttgaccatgtgaaatacagaaacttgctcaacctctctcagaatcactttcttttccttgcaaaatgaggaaattaatgccatcccaaatgaatattttctttctaaatcagtgaataagagtatgttttctctataaataaattagcaactctaataactggaggtcacaactgatctaaatgttaagtcgattagccattcaatttgaatttcagagtatattaattttaattgtgattggtgcaaaattacatttcgatttctttgttacttaaacatttttctttcagatgtgtatatcgcttaaaacattgaattttattgtatttcatgttaccacaatgaaatattattaaagtcaagtcagtttttatgccttaatggtttaatattcttaacatgctcactatttttcatgagtttttttcctatagaaagtaaatcattctctttttcaacacttcaataaagtaaccttttccatgtggatttaattaacatgtaagtttttcccttcatgatatgattagataaagatagttattattttaatctgattttgaaaattttaccctgcaaaatcgttatttaaaatttgatttttttttctatacttgtatggactttagaaatgaataccaaaataaaattcttttctttcttcttttggcattggataaaatagtggtgtggggaccgtgggttctgttctcactaaactcataattttatgagaaagagagacacagatttattgaacatacaagtgctaagtcaacaaagtgctattgtacatagaggtaacagctgattttgcctgcaggcaagattaacttaccccatatcattctgttcatattgcagttatcctgttgataagatattataatgagtaaagtttccatctcctctgctaaatatttaacctcttagagcagaagcacttttatttatctcaatatctctattccttaccttgaattatgctcattaaacatttactgaattcagtttggtggagagaagttggaagagtccatagaggagataacattcagcaaatgagataatacttgacataggcttgaataataatgagccagaaaaaggataaaataggggtgaggaggaaagtacagtcccagcaaaatcacgagggaatgaaagcttgtaaagtatttgtaaaagggtgacctagtgttaggagtggctagaaatggagatgaaacggttaaacccaggccataattataagggcctggactatcatggcaatgaatttagagtcttctggaacaaacagatcacatcagtttctggcagtagtgaggacactgccagcagcagtggccccaggaagaagggcacgacaatacttcaaataagaagatgaagtcctgaaccaaggcagtggccatggaaattgagaagaggacatgataccaagagacaatgaagactgaaggagactgggctactgacaccgtgaaaccaccatgtcagccctggactgcttttcatgtccacactgttatttgagagattaaaaaaaaaatcctatcttgttcaagcaaatgctattaggttctctgttatatcagttaaaatcataacctaatgaatacaaggaacacatccaattggttcagtttggaagatgtgaaatctgaagttgttttaagggtctagaattcaaaatagtgttcaaaggtaaagacaaaagtttggaaacgaatcccacatgaattcatagctgaaaccatggaactgaagaacaacagcatttgcagggaaggcaaataaggagggagtggcaaacggtgcagaaaacattcagggaaaacagagcagcatttctggaagtggattctgttacaaattcctatagtactggcctgtacgtgtgctatgaaagaaaattcacaaccaacacagcttggctggagtctgagacctaaaatccccatggccagtctacatcttaagcaccatttcctaagacattttggcacctgaatgttttgaacattttgggcatcaggctttgaagccaggttaacttccgttcttctccatgctgtcttttccaacttgatgtccttcaggtgaataatattctgcctgttcttggctcacctcctctcctggaccacagacaagtccaggtgaagagtgctgagcctctgactttctgttgatgatgacatttgcttttctttgaaaccgctctgatttgatggtctgtcttgaaatgagatgctcaaaaaagagcatatcaattaatattgctgtattatataactttttaatttacaatcaagacactgagataccatttgcttagtaatttttacctggagatcttaacatgcactctttttttttaaagttctccaatttagacagggatataatttcactgggagatattttagaattaccttcaaatgatacagcaatctaatcccttctttgctttgtaatttatggccttctttgctttgcaatttgtggctcgtgtgtgtgtgtatgtgtgtgtgtgtgcacgcacaagtatgtgtactgtccagtgtttagaatggagtatacagtgggaactggcttggttaagacacgaggacataagaattgtattttgactgagggtaaaagtccatctaagaagtgttctcagacaggtgtgaatggttgactggacagtctgataattttgctccttgaaattgacttcaaaaggtgtttgtattcttctcgctaatttttctcaacttactgtggaggtattacctgtgatttatgtaaactctaattgagagtttatattttcatcttgtactatctcttaagggtaatcattttaccaagtagctagtactgcatgggatactattttatttgtctcataattatttccttaatttttaatggacacagtcaagctctgtcatttctttttaacctgctctacctcatccatgacagggaaaattttcagtcacgatgctgccatctagatcaacatgcttgggtttatttacctttgagcagatataagtagcacacattttggggcaagtaatttaattattttgtaggctaattttcaaatatgtagactgttcccaacaagatcatctggaaattgtatgctatgccatagttttaaaatcaccacaagctgacgaaagggatgatcttgatccttcttcaaatgaggattttgcacatagcatatcctttttgtgtgtatgccaagatagtggctttaagtagtattaattattgcttaataagagtgaagttagaatggctgaaggggcaaatgagtaatgaatccatatttttatgtgttatagctacttctgatatttatagctctttagctttgttttaaagacatcatcgtgttttttggttgaaattatatttttattcaaaatccagtctactcattctatgttattctgtatactataagatttccttctgttatttttagggcttagaaaaaaattgtaaacacagcaaattattttccccttggactgttttttttttttttaacataaagttgattttggtttatttctcttctaaaccaccatagtagtttcccaatggaattatgttgagattttcagaaagttaacatataaaggaagtgaattctctttttcctactctacttaatgcaaagtttcacttaataagagaatttcactgagatataaagggctaaaaatgaagttttaatttggaacagcagcttataactttaactaaaccactgtacatcttcacatgtactgttaccaattttcaaattgatcatattatttttccttagggaaactgaatagtggaagagctgccttttagctggtgttacgcagaaagaaatgcaaaagtgaaaactagcaagatgtatgggaattcagatttctgtggtattttgattacatcatcaaaatgtggccagaaatttatatactaaaaattatgataatatggaaagaaatattaaggtgcaacaatagtttatattcttgtctgttgtatgtgaagcacatattctttttaatttaatgtaattttaagttcttggatacatgtgcaggatgtgcagctttattgcgtaggtaaatgtgtgccatggtggtttgctgcatctatcaacccatcacctaagtattaagcccaggatgcattagctatttatcttgatgatctccttccccccacccccactgacaggtcccaatgtgtgttgttcccttccctgtgccaatgtgttctcattgttcagttcccacttacaagtgagaacatgctgtgtttggttttctgtttctgcgttagtttgctgaggataatggcttccagctccatccatgttcctgcaaaggacatgatctcattccttttatggctgcatagtattccatggtatatatgtaccacattttctttatccagtttatcactgatggacatttgggtagattccatgtattcactattatgaatagtggtgatgcacattttccttgtggctggcacgtatcagattataaatcttatctgaatctgactaatgaagatttttctagggtttaactccattcattatagagttaatctcagatgagcatttaaaacatttgaaaaagaaaattttataatctgcaacctttccaatatcttcattatctttaatttttgttaagagacgtattttgtggtccatgcagagaatggttttgtgttagggaagtaaaaacaaacacacactatattgtgttttcaggtggagtacagatcagaacatacgcacacacacagatgtacacgatactacttgtagattaactgatgacctcaaatcataaagtgaactgggccttaacagcttgtgcagtcttcactgcactctcgacctttgctggtttattggcaccaaactgttttcagtcctcctagcaaaacagtatgtagttacaagcctgtaagttaggaaacctcttaagttcactgggatgtattggaatataaaatctttataactgttatggtgtcaatgtctactaagtacaaacactaattaaaaatggccctcagtgaaggtcatagacagtgatgataaattacttgtttcatataattaatgtattcctgaaaatatatacatgaaacacatttttgttaatgattcatatttcaactgttaatatgcaatcattatttagaggacaccaagggtttaaaaaattatgttctaatataatttttaaaggtaaataattttaatataaagttcaagagttttaaatataaagttcaaaattttgcccattaaaaataagattttcctgatgtgaggtcaaattggaaataactctggtcaaaatagaaataatctgattgctgttggtgaaaaatctttcccttctgatatctctgcccatacaactgtttggtgtgtaactgctggtataattcctgtgtatctacagatatgtacattttgctctagaggacggtaagctagaccttgagggctagtgtgtgtgtttctctgtgaatgtggctattcttgagacatttataaagtgagtataatcagtgaacccattttcaataataacaccttgcctaccagacaagaacactagcaaaaagtgacatttattgaacacatgattgtccaggcaccgttctaaacacttcatctatactaactcattgaaactccacaatgtccctattatttctgtccacattttataggctatggaattgaaacatagagaaattatttaatttgctcaaagtcccctagctaatagctgatggattcaggattcaaatttagacagtctgactgcagaacatactgttttaacagctacattgagttgcattttaacaaacaaatatttaacaaataaatattaaaatatttaattctggagttcttattctgttatttctggaccttggctactgctattggtagaacttccgtgtatcctgacagacatattgtcagtgccctcgcacactctcccagaggagacctctgggccccacttcagaaagccctggagtgtgcatgcaggtgtggctccttcctcctggagatcttacatagtacactgtgaaggaccatgagggacgtaagatgtataatgtacatcctacaccctcgaggtgtgcaacctggtgtccttgttggaatgtgaggagtttaccatgattaagagctcagatgctttcattaaaaaaaaaaaaacattataatggaagtagcctgtgttagaattaaacagctcagattttatgatttagaatgtacactagtccctgctcctccaccacttcctagcaatagtctcttttaacagtgtgaaatggaactttctagatatttaagaagtatctacagatatgaatatctgtttgtgtgtatatatatatatatatatatgcattttatagattaaaatcatactttacatgttctggcatttttttttttacttaataagttataattatcttccagtctcagaagtccatgtcagtatattgggaattagctcattttaaaaacagctgctgggtattccagaatataaatctttttaatataaataataatgctattaaaagtaatcaaataatttatgtaaccaatgccctgctattggaaattgggttgtgtcccagttgtgtgattcaatgggacagtaaacagtgggacttggacattgaggatagagaggcacaatcttgccctcaggcattggtgcattcctgcctcttagaccatcagatctttagcaaattttcaaggtttttcattaataataatgacaggttttaggtaacatataactttttggtggggaagcttaatgtactctatgtggttgactgacatatgaaccttcactatgttttgtcaggcaagaggtaggcattaactttctgaatcctatatttttaaagcaattacaactctttcacacctgaagttctagatttatgtctaattgcttcagagttatccttctcttgcgaagaactcttcagtgttgtttaaagttgcatggttgcgttttaaaaagttttgctcttagtaaggagcaaagaattgtattaaggaagaagtgatgttttctgggtctagctttacattcagctgagatgttttaagtgcttatcagcaagtaatcatttaagtctcctttctttgacctttgttaaaatgttcatctctttatttttctccaattctccacttaaaaatgttatgacctaatgttaggtagtgaaactattttgtgaaaagttctaaaaataataatcctgagcaagtgacttctaaatggcaattaaattgatgtctgggagagacggggacattgtgctaactcaactgctattctctctgtgcaaagtcacatgaggttttaatagcataggttgttacctgagatggaaaaaaatcttaggcttgaattagtcctaagataatctataattgcattattttgttgaatttatatgagtactttctgtaatttttagaaaaattaatcgaaggaagaattattttaaatatattcacatacgttatgttcaaaatattctgcacaaggttttcagagtatgaagacacaaactacggtggagactatactgttattaataaattgtaattttttaacaatttgagtagagttactcaaaattctgttccttctacagaatacctcatgcttgtatgaattcatgggaagggcagattgtgttatttggggtaacaatttcacacaccttgtgtcatacgagatggggagtttccactgtcctaaggcaaacattcctactgtgtcaaagctgcaaacttccagccagcagcacatacttaactttccaaggaatcaccatctgggggaggcctcagtaatacagcaacaccttgttagtctggacatatctcactgactcattcttcggaatgtgtcaccagcatccaaccaactatagatggaggacttcagtattgtgagtgcagggatacctgtgaaatataatggttgtgcaaatttcattgaacagtcgttaatgtgacctacaaagcctaatgcatttgttttttgtcaggatctacgtaagtccatgctttgttggaatctgtgttagaaaacatgtcagtctattattccattattgttactgcattttgctacttccatcattcatccctcaacaaacattcattgggtaccttttaagtaataggtagtagatacagaaaatacagaggtgaaaaagacgtacctttttccctgaagactgtcacaaaggcaaatagttccatgacagtgtgaaatgggctacaaaatatgtaagaatatgggtcttgatcgcacaaagaagggtatgaccagctgcagctgagatgtgaggggaggtcaaggaagtttttacaaataaggtaactcaaactaggtcttgagggatgaacagattttaccaaatatataggaaggaaaacactttctctccaaagagagaataagaacagaggtgtgtatttaacacattatataaagggaagtgcaaatgattctttcaacaatattgatgaagttgtgaaccaaaagtatctgagataggactcaatcaatttagaagtttattttgccaaggttaaagacacacccatgacacagcctcaggagataaaaaagctacataccttcctcacaatttgcctacaaggaaattctttgtgggcctcaagatgatgacacgtgcccaatgtggctggggtacagcttggttttttatattttagggagacatgagacatcaatcaatatgtgtaagatgtagattggtttggtctggaaaggtgagacaacttgcagtgggtaggaggctttcaggtcatagattggtaagagacaaacagtggcattcttttgagtctttgatcagcctttcactgaatacagaatttacatgtgagagagggggtagaggaagagtcacttttgtcttagtctggctcagtgaatgtacatttttgtataaacaataggtgagaagaagcaatcagatatgcatttgcctcagatgagcagagggatgactttgagttctgtcctttgtcccgcagctgtgaagataagctatcaatttacattgccaaggtgaaatccaactgaactcctttaagataaagatcttgagtcccaaaaggaatttcctagtgggcaaattgtgagggaggtatgtagcttttttaatctttgtagttatcttatttaggaataaaatgggaggcagctttgcctgagcaagttcccagcttgacatttccctttggcttagtgattttggggtcctgagattcatttgcctttcaaaaagtctatacaacagacatggtgaatgtaggctcagggtgggaagctaccagaagggaacctagagaagaaatgagaatgaagtcaaagtaggcttcccatagctatcaaaatgaacttagaagagcctgatggttgaagtggaagccacagaaggattttaaataggagactaatacagttaggaaaaacactctgcagggtggagaatagatttgaggggtcgagagtgtaggatgggaagagtgaatgaagagactgttgcaatcagtagtctaagtgggaggtagcgaggtccaggaagtgaggatggattgaagtgatccatctactttgcaagaaggcagagtgtgggagtactggggactgattcaatttgagaggactggaggtgtgaaaaggaagcttgaattacagcgtgattgtaccaggaggcacctgaggaggaacttccgtggagaagataatgctttcagcttaggacattgtggtaaagcttttcagaaggcagttgggtatctatgtcagaagcttagaagaggggcctaggttggaggcacagctttggggtgatcacattgaactggtattgaagctacaggggttgatgagatcaccaagtattttagatgagaagacaagaaatgatacacagaactttgaatgacaccaacagtgaagacttggatggtgaaggggagatggcaaagagattgagagagaatgcacagcaagacagaaaaacaagaagtttattagcaaactgtattttctttatgcctcactgctctcgtgactatgtctaatatttttccatgagtccaatatacatttttactaggtatattgcttttatttttagatataatggttttcaattccttgtgacttgacactggactccaattattatagacaaggcattttggaatttaaactatatccattcacatagtgtttatagaagatgaaagtaaatctaaactcttgattcaagactctttcaggatagcagaggtgcgcaatgggaaggggaagaggagtgagaattagagcagtctattataagagaggatattttgagaggaaaacttttctctcctaaagacaaattgttttctggctaactatatcttaacatctttttttttttttttttttgagacagagtctcgctctgtcgcccaggctggagtgcagtggcgcgatctcggctcactgcaagctccgcctcctgggttcacgccattctcctgcctcagcctcccgagtagctgggactacaggcgcccaccaccgcccccggctaattttttgtatttttagtacagacggggtttcatcgtgttagccagaatggtctcgatctcctgacctcgtgatccgcccgcctcggcctcccaacgtgctgggattacaggcgtgagccaccgcgcccggccaatatcttaacatcttaaaagaatccctagtttatgtaattgctgatggctaatgatggacttgtcctggtgtttgagtaaatgtaaataaggtttatgagccatttattaaaacaacttgtctccttagtagctaaaattccccccatgttttcctcaaggagtcatccaatcctgttattctctatggaaccctatagctattctgtaggtatttcaattttcaaatgaatgttgcaggtgtgtgtgtgtgtgtgtgtgtgtgtgtgtgtgtgtgtgtgtgtgtgtataaaggtacagatattgtggttgtttgggtattttataatgatgaaatctataaacttgcagctttcagtacatttcaaaggctcagtaatacaccataatgtttgacaacgtcccagccatatttatataatatgaggtgtatctcctttaccaaaaaagctgcgttttaaacatttgcttgtagttaggttgcagaacactttttccccagtggaaataatgtcataagtgggacttgcattcaagtcctgcttactgtggttgtttgaaatatgttcagaaattctttgacaaaaccttcaaatggtagagctaattcctctcccttcagcatgggctggatttagtgacttacttctaacgaatagaaaaaaaagaaaaaagcagaggcaactgaatgtggcttcagagactagatgacaaaagccaccttggctctcttttctccctttctcctggatccctcaccctggggccagccagctgtcacatcctgaggatgctcaggcggcctgtggaaaggcccccatggtgaggaacggaggtctctgaccaaatgccatgtgaagacgccagcttagaagtggacctgccagtccctgtgaagccttgagaagactgcaggcctgctgatagcctcactgcctagaaccacccagctaagacgctctgcatttctgacccacagcaactgtcagataatacatctttgttgtcttaagccactgaattttgcaggaactagttacccataactaatacacccacaaaaccctgtttaattcaatttaaatactctctgaagatttccaatgaaaaactattaaaatataatttcaggcaaaggagacactgtaaacctgaataaagaatgtaatttgaagacatgttcgaggggaaagaaagcacatttaattagagaaagatgaggaagaagatcgttttttttttctgttatgatttaggttccaaagggaaatcctgggtttttaactgggtataattttattatacttgtaactgtactttttacaaaattttagtctttttgattcacataggaaagaaatataatgagagattcagaaggaggaagaataattttcctgaggcaagagttagaagagaggtagaaagggagatggggagagatttccacgaggcctgagaaaggagaggaggcccttagcagttagtggtgagaagcagaagggagtacccagtgctggcctgcaggtctgaggaggagcaacgtgggtgttgtggtggatacctccacccccataagaggagaatctgttgctccctgaagcaagttaggttggaatgacctggagtttggtgagagggaggccgtgtccagtgaccacgcttatgtagaaagcttgcaggagatgaatagacattcgagagaaacttgtatgaatatggctgcatcttacgccactccttacttcagtggaagctctgttattcccacatagcgtcctttgaatttccatatcatcattttacacctgaatacgtggacagttgtcaagaagtacagtgcttgtcggctgactggtcatccccttcctgtgttctatacaaaggctatggcaggcagcttgacttttgccaagtacaaagaggacttttatttatcctaaaaagttgtgcagtttgctaaggagggtgtgcaagttaactacacaagataggaagagagatgggaaaacaagacccatcagagtttccacatgggcaggaagtataacaaggcgtctgcctttgctccacatgagctcaaaggacatttctgtgaagctgatggattctttctttaagcctgttggggagatgatttttttttttttttttaattaaagagggtttcactctgtcacctaggctggagtgcagtgcgatggcacaattatagctcacaacaacctcaaactcttgggctcaagggatcctcctgcctcagcatcctgagtagctgggactacaggcatgtgccaccacactggctaattttttaatttttttgtagagacggaggtcttactatgttgctcagattgatgtcaaactcctggctgaatttttgaggttaaattacctgctgtatgctgtcatataaggatctggtaaatgtgtgttaatttattattaatgaatgttttcacaagtgtgtgtttttaacaggtcaccatagtccatattcactcttgtctcttctccattttcttctcaggtttgtatttgaaaacagtgcagcataattcagtgtgcacgcacatgtgtaattataattttccccccttagtatcagctttattctgaggagaaaaatgaggttcatcatttccatgggactactgattagtgaaagtaatatttgaaaaatatttatagatttgttgcaccacaatttcccatatagtgaaagtacatattcccagaatttgtcctactttaacctaaacccatgggttcataatatgttatatttaggtaaaaccaaggaatcaaacatgctcagggtttttaactttctttctagaaaaattcacttctcagccttctgacttttaagtttctattgataaaaagaaagtcaaaactgtttctggagagatgcatttttattatctttctggagctaaagtttgcagatttttatgactcctgataagtggcattattatggaaactctcttaatatgcttgttcaacacgttcaaatcagaaaacatgactgctaataacatgacatcaattctcttttggggtttgtaagcaatagaatgaatattatattcatcattgacatggagaatgtagctgagagggttgtgtcgcctgagaaaagccacatgtaattaaattgagcctatggagagcagacatggagaagtttgggtataaagggaagttgactatgtcagcacaaccaggatttcacagtgctagtggaactagtttgagctggaggagtggaggagcaaagagatgatgcttggtgtgaatgtagtttccggggcaactgatctggatcatggtttctgaacagcagcactagtgacattttggtctggagaattctttgttgtggggagctttcctgtgaattgccgaatgtttagcagcatctctgccctctacccaataggtgctagtatcattaccccactctcacagttttgacaaccaaaaaggtctcccactttgtgatatgttctcgaggggcaaaatggccagagtggagaaccagtggtctagataaaaccagagggcagcactgggatagaaatctgggcatcagtttccaggaagagaagattgctgagtaagaagtacctttttgctaaaggcatgcaaacgaggttagagagaaaaaggattggtaaagaaaagtggtcccgtgtctgatgtggcctcctacaaacccaacacccggctaaattgctcagcctgggctcggggaggattcttcttcagtttcctggtttcttgatctctctgattcatttgatcccaggtggggctgagagggattttatatttcaaactgtggtttctaggtgatgctgatgcattgcaaagacgtcacattttgagaaccactgctctggaataaccacctttgctgctatctggtgttagacttttctcgattatctttgtgattttctctatgcccaggcttgctacccttagtttttcttatgttggctgcttctgtttcatcttggcattgctcacttcctgtagtccttaattgtcttccttaattcacattctgcactatggatggagggagaaatgcctcttctttctttttcatctctcactggttgtctgttttttctttgcttcaaactacaggagactcagtttccctcatgctgtatcccgtaacatctcccaaggctgctgatcttttaggaaactggttccttaaggctaggttacatataccatggttgtcaataatgtagagttcttaacattttatatgctatttcgactatagtaacacatttttagggaatatctgacttttagatccttttctgagctgtaactgatttcttggaactcatctttctacaggggacatttgaattattttgcataaatgaataattttacacttgcccacatcaaagcttatctgcgaatttcttgcccactcacacatcctcatgagatgtgcttatcagattgctttttttttttttttacccagaaaatcttacttagggtcgtatgcattcttagagatattgctgtatctattttttcttagttattaaagattttttgttataaatagagattgcctcctgggagatcatcactgtttatatttttataaacattccctttgctgcatgttgctaaatgactccctatccatgacaaaacagaatcatatgattccattcgaatttcgggttaaaagtagactgtttcctctctagcatcacctagtgttccgaggcctgattccgcttcagtggctgaccccagtgacccactgtaaagctgacagttctgtcactctggatcttgcaacatgttcctgttaggtgtgtttcatggccagggcagttgggattgccagcgctgttaggagtcattgcttcttatgcaaaagtgcgagagggcttcattgatttccgcagcaggccttactccctcccactctgcacacttcctaaagcctccttccacctttacaaactcagccccctcctggccatgtcaactcctgatgatgtgtcaggtgtcagcttgtacacatccacctcaccatctcaggggggtcttctgtgacaccgatgacaagctgccacactgggtgctccttcagcacctgcatatctcctttaggacactttctacggtagaattatttaattattagcaatactgtgatgagttactcacccatgagttctctgagggcagtgattgtctcttgagtcattgtaaatccctgatgtcgagcatagggcctggtacctagaaggacctcaatattgactgactggcaggtctgcttctcctgtccacttctggaataacactaacgaacccagcttctgaactttgccattttaactggccatggtcatgcatctcaccatgtatttcccctttatttttgggctctgctcggttccttagcttttcttgataggacatgggctccagacctcctaccatgctggctatccacttttggatgttctattgaacacggtgttctgggcatcagtgcaagacacgtgaaagtggttttccactccattagaatatggctgttcttaaatacacaacagaactgctttaatgattgtagcacctgtgtcatattgttgactaatactaaaattctgatcactgcaatgcctcgctagtcacatgatgcattttaactatacaagcaatacatgatcactataaaaactagaaaattcagatgaaaaataataatttaaaatcagcaattaatgccactaccgagaaacatccagtgttgaaattttataaccttgaagacttttcccatgagccatctttattgatatatatgcatatgttatgtgtaatgtgtgtatgtatatgtatgtgtatatattctgagcttatatgttctctctctctatatatataaatatatatggctctgtacgctgccatatatgacatagtctctttatgtcagtaaacagagttccattctgccttgagaagcaatgtgacatagtggataacaatctagggtttgaattcagatggccctaggctgtacatcccattgcttactaattatatgacctgggatgggttactaatcttttctaaacttcaattatatagttatttatagttagttatacatttatatagtatatggaattatgtagttatagaacatatttataatagccatatggtttatttagctatatagtatttcattttatgaatatacctatttacaatgtctttaaattaggtctactttatcctaccattcaatttttgaatcctgaagctgaattttttatttttgtgcttgttaaattttattttattgatttcaaccaaaatacttcaggatttgggataatttaaagatacttttcaatctttatcttttgaatctgtgtgttactacacatttgataatcagaaatttaatccaaatgatagacaaaaatgttaaatgtagtagagaactatatattccatcattgttaccattatagtaactctccccattgttgtcctagggatatgaatacactaataaccagtacactttgattaatgttattaattggctattgaatctatccaactgattggtctgctcctgattaacacccttttccagtccaaaaggagagcaagagaaatcctgcctggagccctgaagaaatagaatatataatctttgttgcattcttacattttacctctccaagaagagtttcataaaagtaaataaagttaggttagtctaatacatgtttagtaaactcatactgcctccctgaaatgttcacagctttcttaataacgtaggagccatggccacatgggtgaagatgctaactcttctagaaaagaacaacccacggcaacagatctataccaacatatacatatgagacaagcatgctccagctttttactttagaaagggatgggggaaaaggcatgctttgtagggaaaaaggaaagaatggaaaaaaagataggttgagagaggatggagagaatttttatttgctttatttgttttcccttgggacagcactgttttttaaaaaaagaatgggaggacatgccaaagtagtgccatgtttaataaactcatcatcgcatttgctttatagaaataggtgctatccacacatgctgtaagatgtatgtgcttgctatttcttgtttgccttgggtagttcatgtgatgcataatacttattattaaaatgacaatattcttaagtaatattgtggttatgttctccaaatcctttttacttcttcaatatacctgagtaagtaggtagagtatctcttgaaagggaagagggatgtagaaaacctaagtgattttccccagatgtttatagcaagttagtgctggaattaagaccataaaccagaggttgtattacatggcccctcacttgaaattcagtaaaatttttcctcatcctgtcttaggagagtgagccagcctcatgttctagaagaacatccaggttccaggccttccctgcttcaacagcgtggtttcccacagcttctcattctaggtacatcaagctaccagtagttgttccctgcaccaatgctgctccatacctttgtatgatattttaggccacgtagattcatctatataaaatgctctttgcacctttctttacctggacacactactctgtgtcaaactctaagtcttcttctccaggaaaccttctttgaacctcatgtgcatgactatgctagccctggaccttgtccttgagagggcaatgatctcttatgtgcctctcttcttccttactgcagatcctttgtacatccagagactgacaggcagtgagagctcaaatactatgaaagtggcttaaactgacaggttgtcttatatcaaacaggatatgagagcaaatctcaatcaaccaacagataatactcttggactacattctacttagaaggaaatttagtttgatttttaaaaatacatttttcaaatgctctggtaatagatgttgtgttgttacacatctaattagtgttttgcccaagtgggcaaacataggtattctttacccagaagcaacacgtattataatctcaatagctaataggttttgtagggttctttagagaagcagttctattttaattcagattccttaagaagttggaggatctttaccagaaatcgtagcattttgacagtatctctcttttaaaaaatattctgacatctaagtgatttgattaatttagtttttaataggtgtgaggtaattttaaaaatatcatagccgcaggataatttattcatggaggatcatttcgtaagtgattgagtttcatgccttcttttctggtagaagtagaaaaaagtacgtggattgctgctaacttaataactttactgataactaagaatggaacagatcttgctgtgaattacataagcagctttaaaagcactccatattctttctgtgacagagtacgaaaaacacaaggcagagaatatggttatgagaatgttttcctgcaaaagcttaactatgttgtatttagtagtatagtcagggaaagatggggttagaatgatcataacagccgcttgaaaaatgtatcttaatgtcagccttgaatggcttttctttttcctgctaagggaatctaacaggatattaaaaaacatattaaccttcaaaatatgtttagattctgctatgcttctaaagaggcaatatgaatgtgagagctatgtttagtagaagttttgacccatagaattcgtagaaaggggtcacttaaatttagtttggaagccaacagtctcgcatatgactgtctgtaatatcacacccttctaatccattctctatgcagctggtagagttatcattctaaaagaaaatctgattatgtgattcatctgtgtaaagccctttagtggtgaaatctagatgccttagcttggcagactaggtcctgcttgagcaggccttgcaacaactgccctagaaatccatgtttgagctataagggagcagctcacagtgcctagaattcctcagccagtggctacttactgcagtcatccctgtctacctgaaatgcatggtctctgttcatcctccccagggattgaccaatccctcctttgcaccaataatctgcctttacatcacagttctttcaagccactcttaacaatttttgtattcaattacccttctctcttagaccctaagctcttattatctctgcgtggtcattacccttccctctttgactctaagctcttattatctctgcgtggataggccctgcatgacaattagttgagttgatttataaatagattcactgatacctcagagtcaaaactattgactgtgcctactctcaaaaactgtatccttcgtggaagttttgcctgcaattccaaaatagtcttcatcttactcttactgattttgtattaatgttgtagttgaaaacattggagactagttgcttgggtttctaatttcagttcttactcaaatacttatattcctacagaagaaaatactttaggctaagaaaaacagcattgttgctaaaattctcaattttgagccccacccaccccacattttatctatggaaatgtgcctattgacccattttgccctccactggtgttctgagatgggtttagaattttgtaggaagcatatagaggaaaatgacatcaacattttttagctagactcctgtttggcttcctgtgactattaagattggttctgttattttgttccttgagctatcactgatcttgattactggattattgttatttctgagttactgaaataatataaagtcatatattagtatgttcagtattatatgtagtaatagaattagtcattgccattgctgcaggcttaaaagtaattaccaaagtagacaccatcactggaatgtaggttgaatcagagaatgttaattttgtccatttttctttcatatttttttttaaagtttagaaagctgaggcccagaatcttaagtaacttatgtaggatttcatggcaaattaaaaatgaagccctgagtccatgcaaagcatttccaaaatgccttcctccccttttgtatttgagaatcattccagtagcacgttaatgtagggactattcaggagacatcaggcttggagctgggagttatgccaccgcttactttccattgctcttcattgttcccctgcagaaaagtgccccaggaacgataagtcctcaatgaatggagagattgagacacataactccctcgtaacttatggctttatctaaatggctttaaacttgtaggtgttgccttaaaagtatcagaaaacactgattttctactgaaatcaacagaaactttgattgcgtgagtgaagattcccagtctgttattacttgtgttgatgagtgggcttgtttccctgtagcttaggaggctccatatcaagtaggttcagtttggatgacaacatggagctatggagaagctaaccacagaggcaaaggagagaaagcagtctcagagacaaatgcaaatagtcttgggaatcctttctaaatatattcactcatcaatctctccagggcacctatctggtattttccctcagtaggtcaactattgttgcttgatggctttaatcattttgcaatttcaagtaaaaagaagagtaataccatagctgtatgtcagctttctgtcttattcataggaagaaggacataaacagttcttgaaaaatgccgtgtcttggaaaccttgaaaggtggtcgccttctcaatcatacaaatatttcaaataacagctttgtcagccttcctgctttgagctcacaatagggatggtaggtaggttggggaaggggaaaagaacagcctttaattatacatcagcagcactttcagggaaggaactatatgttttttgtattcttcaaagcctgctattgtcttcaacacacaatctgcactatgaagtgtctgctgaatgaatgaatgggtagatgaatggatgatggatattgtatatgtactttctgttatttggaatgaagcaggaacccaaaacaaatttgtctcctcataatggaatgatttttctttcttttttatttgcataaataattgtcctcttactcttctctagtctcatataaaagcattttctctactctgtaaagctattcacttttattctggattaaatcccatcctacttcttttttttgttataaaattgtcagaaacaaaagttgggttttttcccaggctaggggagtcttttttccccccttttacttttgttaattttgccctgaaggtacagtgaaagtggcacctcctccttgaagcttctcattggttattctaccttactccatttctatttaacacatatttagttttcttaccataattacaccggcaacaagtgtaatagcacatattttacttaataaaaatctcagcatcaaattcagtgatgagcagatagtagctgattagcaaatccttcttgattgagtaaactattacacatgcatgggatattcttgctttcttgggtaaatctgattgccattttattacaaactctgaaagcccacgaaagtacattcatcatggtaatttaactgattaccttgcctttagctactgtaataagaagccctttgcattttatgactgccttcttgatccacatatagattttaagttttgtttgttggacactttctctatttcttttcatatttaaaggtcattctagttgtgagctattgtttcagaatcaggaaatatgatagttagacaaaaggactgatgagctaatctctgatggtaaaagatattttgggatgtatcacaaggttttagggtaaaaggcttgtatattttgtgaaccttctggaactgatgaacactctttttttggcgtgtgtgtgtgtgtgtgtgtgtatgtgtttgtactgtggcaaggatgtgcgggcaaagaatagctagcaatcctagatgtaactcaaaagagaagcaagattattatggctatgcttttctgtcttagtttctctgaaataaaaatattttttgatgtgaaacgcaattgcttctgattctaaactacatggctcccctctaagggattcgccaaaatggcaaaagatgtggggatgggcaatttgaatctgaaaacattgcaactggaaagaaattcagggctgggcactactagacagaattgtaaatgagctgaatttggttgcgtttccattagtctagtaggaatctgaagatactaattactgtgttttttttctttcttttcaaaaataaactaaacaagtccaagtgcctttgaaattctgttaatctcttatccaaacactagtaggctcctttcttattccgtgtgtcgttaacctcaattttgcctccagttgcctcctagcaagctagtaaaaatggaaaatggaaaatgaattgtggtgagtgcttaactcactttagatggtgtggtccttttttattcttttttactgtgagtttacgtagcccatgctatcattgttcaaacttctttaaccctttttatgtgggaccttctatctcttggatttcctattatctctcaccatgatgacttcttgataaaggaaaataatatgtgatattacatgtctaaaaatgtctttttctatcctccttttggattgataattttgctaggtgcagacttatagaatgaaaattgtttttccttggaattttgaggatatcactgcattcgattctaactttcaataatgttgagaactatgatgccacttaaaaaaatcctttgtatgggacctttgctctcacctcaccccttggaatttttaagcatatgatgtagatttttactgattttgttagacattttcaattttagagatttacatctttcagttataaaattttgtttttaaaattatgtctttgatcatttccatacaaattcttttgtttggtcttttctactgaaactcctgtaagattttggaactcatggcttttctaaataatttctttatgtttgtttgtttatgagtcctttgtctttttattcttttttggaacaaatttccttgaatctatcttttttaatttttacatttttttattttcaatttttgtgtttaaatagtaggtatatatatttatggggtacgtgagatgttctgatacaggcatgcggtgtgaaatttgcacatcatggaaaacggggtgttcacaccctcaagaattccttgtttttaatcttctaatccccttattggattaaaaaattacatatttatatttttattttcagggaacttttcttttctttcttttttttttttttttgagacagagtcttactctgttgcccaggctggagagcagtagcacaatttggctgactgcagcctccacctcccgggttcaagggattctgctgcctcagactcccgagtatctgggattacaggtgcgcaccaccatgcctggctaattttttgtattttaaagacggggtttcaccatgttggctaggctggtctcgagctcctagtctcaagtaatccacccgcctcagcctcccaaagtgttgggattacaggcataagccatggcacctggcccttttcttatttttttgttattcctttttatgatatcttgtttttaattcatgggcacaacatcacatctttgatgatatcaatgatagattatttgaatttttcagttttgtttctcacttttgtttcctattttattctctattttaaattggaggctttctcaaacgtggtaatctttgtttttctacttatgttcattaaacatggatgggaagctttgtgagaaagttacattagttcattgatcagcttttctataaccagccagatcatttttggttgggggtccccaaatgtcagtcagtatgtccacattttcccccactctctccagagcaggattctccagtctccttttaaggaagcagaaacttaactgtttacatcctaagctgggcagaagggggggcatggatgtcagtgtttctcactgtcaccctccaatgttcctaagaatctcagactcaatttctccacctaatatttctcaacattcctgagggaaggaacaatgggtaatcatgtaatagattgtgttggaagtagggatgcaagaaattaaatgttccttatggagactttcaaaatattcccttgtatgcatatgtcatctgattttgaaaaaacaacaagaaaaaaaaaaccagacaaaatattaccatgtttttcaaccctttcccttgaatgtacaggcataccttggagatattgcagacgagcacagtaaattaaatgtagaaataaagtgagtcatgtgaattttttggttttccagtgcacataagagttatatatacactatactgtattcagtcaaatgcgcaaaagcattttgtctaaaaaagcaatgtacacatattaatttaaaaatactttattagttaaaaaaaatgccgacaatcatctgagcctaccatgagccgtaatctttttgctggtggagagtctcgcctttatgttgatggctgctgactggtcagggtggtcgttgctcaagtttggggtggctgtggcaatttcttaaaataagacaacaataaagtttgcttcatcaatggactcttcctttcactagaaatttctctgtagcacatgatgctgtttgatagtattttacccaccatagaactttcagaatttgactcaattctctcaaacccttcttctgctttatcaagtaagtttatgggatatgctacattctgtattgttgtttcaacaacactcacagcatcttccatcaggagtagattccatctcaaaaaaacactttctttgctcatccataagaaatgctttctcatttgttcaagttttatcatgagattgtaacaattcagtcacattttcaggctccacttctaattctaattctcttgctttttcaacccaatcagtagttacttccttcactgaagttctgaacccctcaaagtcatccataaggattggaaccaacttcttccaaattgcagttaatgtggacatcttgacttcctcccatgaatcaggcatattcttaatgacatctggaacagtggatcctttccagatgtttttaatgtattttacacaggcccatcagaggaattactatctatggtggcaatagctttacaaaatgtaggtcttaaaggataagacttcaaatttgaaatgattccctgactgatgggctgcagaatgcatgttgtgttaacaggcatgaaaacaacattaatctcctgtacaatctccatcaaggcttttgagtgactaggtgcattgtcaatgagcagtagtattttgaaaggaagcttttgttctgaacagtaggtcttaacagggagtttaaaatattcagtaaactgtgctataaacagttttgctgtcattcaggctttattgttctatttatagaggacaggtacataattcttgagggctctaggattttcagaatgatgaattagtattggcttcaacttcatatcgccagctgcattagtccctaacaacagagtcagcccctcttggctgagtttgaagctttgaagccaggcattgacttatcttctctcactatgaaagtcctagatggcatttccttccaatagctggctgtttcatatacattaaaaatctgttgtttagtgtagacacgttcatcaatgatcttagctagatctcctggataacttgctacagcttctgcatcagcacttgctgtttcacgttgcacttggatgctagagagatggcttttttttccctaaaccttatgaatcaacctcttttagcttccatttttaattctgtggcttcttcacctctctcagacttaatagaactgaagagagttaggaccttgccctggattaggctttggcttacgggaatgttgtgactggtttgatcttctctccagaccactaaaactttctccataccagcaataaggcggtctcactttcttatcattcatgtgttcgctggagtagcacttttaatttcctttaagaacttttccttcacatttacacttggcaaactggtgcaagaggactagcttcagccatcttggctttcaacctaccttcctcactaagcttaatcatttctagctttttatttaaagcgagagacatgcagctcttctttttacttgaacacttagaggccatgtagggttcttaattggcctcatctcaatattcttgtgtttcagggaatagagagggctggggagagggaaagagatgggggaacagccaattgctggagcagtcagaacctatcacatttatcaatgaagttcacggtcttacatgggcacagtttggggcaccccaaaacaattacaatagtaacatcaaagatcactggctacaaattactataacagatataacaataatgaaaagtttgaaatattgcaagaattactggaatgtgacacagagacacagggtgtcttggaaaaatggcactgatagactggtgcaacacagagtccacaaaccttcaatttgtaacaaagcacagcatccgtgaagcgcattaaagagaggcacagtcaaatgagtcatgcctgtactcctcccttgcattgtatctggtacttccaactcctaggctttttgtgggttcttcagggtaaaatggagtgcaccttcttggtctctttctttcataggcattcgggcttttctttcctcttttctgtgaagtgttttcactatattttatttcttggtggaatggggtttgggttgtgtctgctaaaattacttaatcttaacaaaagactactcttattgagaacccttatggttatttatggaataggccagtgcatagatgtagatgcatagatagcaattagagataatttagaaaatccatgaggtccaaaatctaacaggggtttcagcaggaaagaccaaacaaaataatagtattgaaatgatcaaagaataatgaaatgaaggctagtgtggcatgtttgtgcattggtgaagatgttgttgtctctctttccagtagcttcagagattgggccaagtaaaacagggagtctagcttggaatgcagagatataaactgagatgtgatgtattaacaagtcaccatgagctaccttcatcgtacagagacacagggagggccctgaaggaatatggatatgcaattataggaaagtagggtttgatggaagagggtatagacgggaaaaaagcagaagatgtgacaatgactctaagatgtggcttctagtcagtgacggtctgcttggtcacttggggtcttactgtggattgaaaacaggtcctttcttgaggatggaggggtgcctctaccaacataactgctgaaatggtcctagatcccagaagttctcttgttatcataatgggttattttgaaaaatctaggacatccttcacatgatcatctcaaggataactaaaaatgcaagacacgttttagggtacaaaaagcaaaaattcaaaacatcttagaaagccaaattatttctatttgagttcataaatactgtgcatataacatgaagttagaattctgatcacagaagccttatacgaacactttttttatcccaactaatctgtagtgattggcatttctttgtaatagatcataaatcttggtgcaatgggaggatcatcttgaggcaaaagagaacatctcatttgttttatttcactgagtagagctacatgacactgctgtttctgaagagtggccatcatctgcatggcttgctgcagagaatttttctggctgcagtaatttaggggcatttgaaagctgagtttgaaggtgcactaccaaaccatcaggctaatgctgaacatcatgtcttctgaggtgggtttcatttagtaggttgtaagcaacgtgcatttttcttgactcacggaatctacccacctatatgtctatcagataggactaaaccacagatgttcaaatcaacttaacatttgcctagggaaataaacttaaaaataattgtgcctgccccaatccatgacttgattgaacttggctgctaacagaggagataaatgggtgggctactcaggctgagtcttccggtttactttgggtggctcattaatggggctgaagcacaccccttttgacgtcatctttctgtgcatgtttggagagactgggacctgaacagatggcctctatatgggctcccatgactaccaggcatgccaagcaggcagatgagtgatctggcttgttccttctcttttagattgctgtcagccagggaaaagtggtgaaaataaatcaatggctccctcctccagacccagcatgcacccttcagtcgtcaaaataagaaacatcctgtggtggctgttgggtgatttctctgatgggaagagccctttacacgctggtgattaccataacaaatgaccaaatacctcttttttctttgtcctggatcaaatgttggccctaagtggcagcagctggtttggagtgagcattgtttattcactcctagacactttacgtcctttctgaatgagttcagtatttttggtaattggttgacagctgtttacatgttccatcatcagaacacaagaaatcataaacaagaaccatgctgaatatctctgacattgcctttgtgttcctactttaccgaaagcccaggggcctcttcttgcgtaacatccatggttttgactcttcagtgagtccataggaaacggtatagcaggggactcagtttagaaccaatgacataagctttaaatcttgcttgatcttcaaataacaagttgaccctgggctagactgttttatgggccagctttcttttatttggaataaagaccttcctaccttgcttgcagatctatgactcatattctcacagacacacactgattttctagttataaatcatggacatttgatgtgttttcaaacaatgaacacttcgcatatgtgagagccacgttgggttaaggtagaagggaagttttactttttggcatgaattacatatatataatcaagaggcttttcaattttggaagtttcatatggcccgtgggtggcatgttggatatcccaagatttacttagtgcagtatgataatctagttcccaaattttacatagcttaacacatagaatttgtaatgtttctagaaataccgcatatagaaatatcttcataagagttctatgttgtgatctcctttaagttaattctcattagttagctagaagaattatgggacagtcacatcaaggaataaaaaatgggacttctggtcttagttctgatttgtttgtaactgagctatttattgagaagtatcacttatcatgtcttttcactgatgcttaaaatatatatgcaaactagagctgtctaacttgcaaagcttttggggggtcttcttttataagtgttaagaaacttataagtaaaaattattattaataactgacatacttagacctgtcaagaaggatggtaacatttcaaccagcacttgagaggagacaggtctgctgtgagttagtcatcatctgtggatgatgtatttgaggacatgatgcacagaagttgaatttataaaaaaaaatgttggtaaagctctttctggagaaatcatgggttgcagccttaaattctgggaaaatggaattttcctagttttacaaacatggcagaagggatcctcactcttgcatttttggattctcattaatgtttcatacacacacagagttaataaaatctctgatgattaaaaatgtgattttagatttaagatatatttttaaaatattaacatacaatggcatctcagaataatgagtgttttacttctactgcatcatttatgcattttctttggggaaatggacagtcaactctttttcatacttactcttttttcaaatgttttaatttttctatttattgaaatagaatgtgatctttaggatccactgtcctaccacagctctgggagtctttaaaaaaactttaaaaagtttcccatcttttcctatctctacaaattacaatcagtcacttaacatgctcttaaccctactgactctgccgtttagtacaaagaggagaaaaaggacaccaagaagtaaagttacttattcaaggagaatttgggcagagccacaaccagaattcaggtcatcatacccttaattcagttcttgcacaaatatttattgtgttgggtgctgcgctgattgctatttctgtgccctttctattccattaagctgcctgtctgtctctgctatggggaatttactctgtggaagtttttcccttccatggggaaggattttcttaatgcccattctcttcacataaactcagtggatcgcctcacttttctcatttatattgtaaggatgctatactaccaattcgaaacttttatgattctcttgtccaccaattatgtatgaaaaatgcatttgaaccctaaaatccttcattgtgcgtttcatgtagcttgtgttcattatactgtgtttcagttattttatttcaccttgttcttaaagatggcatgagaaataatgctataaatcaatccccttggagatgcattgttcaaaggaagagtgaagttattttaatcagatgttgacattttgctttaggtctcttcacatcattgtgggtggttttctgtgcttttctgggtggtatgtgcacccacacattaggagcattgtgaactacagtgtgaatgtacaataatgaagtcaaatgtttaaccaatacatgcaagctgatgatgcacacatgtgatggagtagaacagcatttccaatatgggtccaagctattgggattataccaatatccatgttaaattgcataagctgaaactatgtctttaggggccttgggatattaaaatatgagaaaatggagcagttcagaatttaatcattaaaacggctttgtaccttttgatctgggacaatgtaaaagtggccattcatttgttggttgttttctgtgtcccaaggaattttctgactgctttatatataacattttatttactttaataattttatgacatactttattatccacattttacagtgaagaaaactgaattgcagtgaggttcaatgacacgtccaagcaccaaagttgctgttcaaatggaggacggtctgattccaaagctctggtgttaattaagcactatgctataattctctcacatccattcattaatttatttaacacatatttattggcatattgctattttagatgccagaaaaattgcagaaaataaagtagacaaagaatcctgatttcatggcactttcctacttgtagaggggagacagatagtgaagaaataaatacatgcatggaacgtcacatggtaacggaagctttagaggacaatgaggccatgaagggaggagggagtgatgatcaggggtgtggagcttgcagttttgagtagggtggtcaggaaggccttgccaagaaagtcaccttgcagcaaaggcatgaacagaggtatacttgaaatgggagtggggcgggattgaaactttattgtagatagctaaagagaaactggaggaagaactggaaggagcaagaatataggcagtgttttggagttaggtgtcccaaaattattcctgtgtcaagagagtatgggatttttttaattttgtaagacttgagatattatagtatgattaattggtaaaagaaaaatagatgatgcaggagagagagttgagaattgctatagcaatgttcttgaataggtgagatgggatgggatccagtacaaaagtgtaggacttgatcatagataagaacagagaaaattggttcacaataataggaaggaaggcagcggataggagcacagatgctggtaggtgaagagatgaacttgtgggagttgagggcattctcttctgtttacttctattttctcattgtgaaggcaaaatcagatcttgagctgagtgcagacagggaggctctgctgaaatttggagtggagaacaatactgaattgtcctctagaagagggttagagtgacagaaacacgtctctgctggctccctgcctgtcagcattaagggtccacttggggttagcggttgtgtgatcagagtgagaataactggcacgattgcgggtttaactttggggaagtgaacatgatgctcaagtcaggttcaggattcacagattagttggtgaaaatttaggtttaaatgtgatcagagttttgccagaagagtgtaataaagagctaataattatgaaatataagctgagaagtgagggcataaggtgggggtgcgtaagggccatggaaagggtgaggagatgaatggattgtacaacatggtagggttaagattaaaggagtaaggtggaaaacaggaggtgttgatctgagcaggggtgcttagtaatgaggtcattcaggagattcagtcttcttggatacatccacaggtctgagcagctgaagttgaacagagcacaaggttggaggaaagatgcaaggaactgaaaggccaccatgaactggaaagggaaatcaccaaggattattttgaatactcttgggtagattgatgatgaactaaaagttgaagaactccaacagggaagggagtggtcagcaggtggttgcaatacagagcaagtggttgatgggttttaagggaatgacaaaggtctgctcacattgagtcctgctcacaggcagtgcagaagagctataggtctttcgggagggggaatggagagagatctggcaaagaacaaggaggcttttgacactactgttggggtcatgtggaaaaaaagcagccttcactcacagggctaataagaagccaaatcttcagaggagagccagctctcagccttggagcaagaagctgaagggtagagtcagagaagttgatcaaatagtgggttgtactaataaccatgagcttttgtactagtagccatgagctttgatgtaagctcatgggtattaatgcaaccctctatttgctcaactgaaagttgaaagtgaaagaacttcagcagttaggtcatagtggatagggccagagaggaggatgtacagaaccatatggggtgacagtctgagaggtcaggaacgaactggaactcctaggcttcttaaaaatggaaaataaacttaggctgtaggaggcctagggacattatggtggtgaggcttggtgtgataaggggagaggagaatggagggtttgccaagagcatgtagggcttcaggattttcctattcctacaaataatggcatcagtttcaccggaacaccagaatatctggaatactcttataactcctggaatatgagcagtgttagggctccatttatttgttagggctccatcttaatttatacatgtataatgtatcttaatttatacaagatatttatactaaggaactcattttcccctttaccactctacgttattgctcctccttcgtgtatcacacgatacagctattctaagcatccacaatgtaccaggcagtgctctagagctttaagtgtgggagtaggtgggagctccatgaatggacagaattcttgctttgaggagttcacagtctagaggggcagactaatattctagcaaataactacaaggaggatagaaacctgtgctttatgtgggaaaatagaggaggtagagacatgtttagatgtcagtttttctagaaatatggaagataaaatagtctatctggaagacaaattcacctattttagccagaccactcacagaattttatagccacttgcaaagaatttgatttctgcccagttagtgcttggcacaggtttatacatagttaatggtcaaaatttttgataaataagcgattaaataataaatgtacttatgaagaacttcaaccttcaagatggttaacttgaataagttgcaaatgtttgtttatgttaaaattcaagtacaaaataaaacagtgagacttcactgcctttcattccagaagggagaatggagaagaccattcgtgctctggtttgagataatagggagacttatgagttttaggccactttcatttttcttttcatagcagtgaagaatttctgctaattcacattccagcatttattctgttttttttttttttgatccttccaggttcttttatcctgccttttgcttataaaccatttatttattttttatttatttttatttttatttttttttggaaatgagtcaattcttgatatcctttttttttgtttgttttttgttctgtttttttggagacatggtctcactctgtcagattggggtgcagtggcaccaccatggctcactgcagtctcgacctcccaggctcaagtgatcctcttgcctcagcctcccaagtagctggggccacgggcatgcactaccatgcctaactaagtttttaaatttgtttttgtagaggcagggtctcactatgttacccaggctggtctcgaatttctggctttgagtgatcttcctgccttagcatcccaaagtgctggaattattggtgtgaaccaccacacccagctgatctcctctgttttcatgatcgtagtacagtcgccctctgttagataaaagagatttatataagtgatttggccaaatctatttatttgaattaaggtaattgtttggagttggaggcatctgttagtaattcaatggatacttgcccttgcattgtatattggtgtaagcttatgcgagataacaataataattagtggtgacttttaagtggttttatgttgtggtgtgttgacttgacccactgctccctgccaagtcaccttggatcctaacagatgtgttgcaaaccagccaaatgtgagaagctgtgtttataattttatattaacattaatgttactgaaagtaaagaaatagggacttaaatagtttatgcaatttggaggaccagaaatctacaccaggtaggctggtagaccattacttggcatttttgaactttattttgatgaagacaccttgaactgtgatcatagttgctgggaaattctatttatttaacttgtttcaatttgggcttttggattttttctgtgtttatcttatgctgggttgaactattattatggtttaacacatgagctgaacagaactttcccttcaggttcagtttccgtggggaataattggggttatcttgactgtttcaaaatcatattctactagttcatatattttagttttcatgatccctcttttttagtcacaatttcccatatctgaaacattggtttgctcatatatatttccttccttccttccttccttttttttcttccttccttccctccctctttccttccttccttccttccttccttccttccttccttccttccttccttccttccttcccttcccttcccttcccttcccttcccctcccttcccctcccttctcctccctttccctccctttccctccttccctccttccttcctttttgagctattttcttgtgtgcatgtttcttctatcccccaaaccccatttcatagccaacttataaatagataagtacttttttcttccttcagcgatgaggaagtagtgctaaatatttataccattcattatttatttaccaatcactaatatgtcccaagaaaagagtttactgggccaagaaaatcataagcaagaggtcagtattcttcttttgggtttgatttatttaaattgaacttaggctatataataattctatataagttcggcttaattatactgatagttttatttgcattgtgcagtttgtcactttagcatatttaatggcatttttcaatacagtattttggctgacatgttttcagtcaagaaatttattgcattttcatttgatgcttgcatttgatgctttgattgttattcctgggcttctgggcttatttacaaatttcatttagttattatttgaggttatgctttaaaatttgaattgaacaatactcatagtgatctgaattcatctcacatttcaattctacaagtaacagagatgattagttttcctttactcttaaagatgcccaatcagaagtgctaggctattttgtttggttttgcttttaagcatcacctatgtccattggagcaagtatgaaaaaaattataggtatttaggatttattgaacaaacactttttgtttgttcacattagtcacagtttatattcaccagagtacaccagtgaacagatgaatgaaaacaaacacaaatgaaggcaaaattctgtgccttcgttgagcttatattcattttggactaggcaggaggaaacagacaaaataaaagataaacatggtagataagtagagcacatagtgtgaccgaggatggtagtgttagaagaaaaataaagcttaggtaactgggatcaggattactaaaatacgggtgaggttgcaaattgaaattttaaattgtaaggacagtgcaggcctcttgaaggaaggaagggccttacccatgatacactccagacgatagaattccaggcagaggaaacagcctgttagtatgcctctttgcacattcaaataataccacggtgcccacaatggctgagtggggtgcacaagagggtgtggtaagacccaagatcagacagaaaatgatcatgaaaaggaagtacagtctttgaatggccccaagcaatattgtaaagactgttggtattgttttttcttaataaaaagagaaaaataatttcacaacgtttttctaaaatttttttcttctgttcataaccttgatctaacaggatgctctccatttcttttcaaaattctttggaaaaaaaaaattccaggtttaattaaaaacccagtataattttttcatctttcctttgggatcctttatgccttgtttctgtaggctatttgacagctgtttgtagaagtctggtcccatcttttattttcaggtttcttccatttcctttgagcattttctctttgatgtgctatgattgcaaggatcttttcctctttttttaaaaaaatcttttgatggtgctgtgtgtgcatatgtatgtgtgtgcttatgatattgaattgagaatcacagtaaagtttttaaaaattcacctttaacatttgcaaaattatcaaaaaaaaacaaatatcaattaatggttagcaggcgatatggtacagtgaaaagggggtgagttttaaggagttattatttaagtgtattcacatttgtaacacgttttgaacacacagatcttctcatataaaaatgcaatatctgtctttaatagagaaaaacaaactataaatgggccagacatcttatcttattagccttagtttcctaatatgtaaaacaaagttaataacagttaccctattgttgtggggattggagatcatgtcacctgacacccggtgataattatcctcccatgaactgacgttttttgagggcctgctctgttctagccactgtgtcaaagactttgatgcatgagctgatctaaccctgacaaggaccactagcattaaagctccacaaggggtgggaagaaagctaggtattgtttatgattgcatctcaggatgcatagcgcccagcatgtatcagacattgaagacctttttttgttgaatgagtaaaaataaatgccccattttacagatgaagaaactgaggcttggtgagattagataaatgactcaaaggacatacttagtaaatggtagaaacagaatttgaacccagtcagtctaaccctagagcccaagctcttcatcacaacacatatgaggctcttattagtgttgtagggagggcactagaaagagggttctctccctccattccttaagcccacagccgcttctttccacttttatcttagagttaggatatggcattaggcacactgaattttatagctatgattattgtccttgagtgtaaaaatattatcatagctttctttttcccataaaatcagacaaggatatatatgataatgcctccagatgtgtgcctgtgctcacatacaacagcacatgtacagcaacacacacacacacacacacacacacacacacacacacacacacacacatactgcacgttgggatcctttaaagagtcatctgatatataacattctgttaagcagtggtttgaaggcttaatgaaataatcactgacctgaactaaatttgtttcctttagttgtacattacaagtgggagagcagcaaattaatctcagaacctgaattcaaatctcctatgagtatgagattttattgctactaggaggttaacttaattccaatttgttcttaatgattgatagaatattgattattgtaggtcatttatcttttcaaggctcaaaggtcaaaaaatatagagggacgtctggtaaaatcttactgctatattcacaaaggagccaatacagtttttaaaaagaaaggactcttggtaaatttaatcttgattactacacaaatgatatgatttcaatttgtctctgagataagcttttgatctttaccaatgtcatatcaatgcctttcaaatggtgaaaccagtcttttatgtatttattggttagacaacttatatgaaaattataaaacagactttaatgaaattcagttagcttacttcatcaataacaaagacaggaaatgaaataaaaagaagcaagttaatgaactacagaaaatatgaacttataaatcctttataactacatataatcctgatttaatttgaggactcagaattccaggtattcttagagaaatctgtgactaatgcagcttaaaaggtctcaaactgacatggaacaatttttctcagtgtttctcatatactgcgatgtgtcaaatgctgacacagattaacaataatttataaattgacattgcagcaacttttttaaccttacacttgggcaaaaatggaaacaaaagcctttggagtcaatactaaccaaatttactttatgagcagaaaccacagggcttctgtttcacctttaagctgtttgccagtttaagaaatgctagcgtaaggatcaatttgtgagaaaagcaaggatcaaagaggttaaagtaggatatttctttagcttatactttgttttgttttcaatatcacatggcaactttttttttttaatgttaagtttggtgatagactggaagaggtagagatgggacagtacgggaatgtatgtgtatttgtttctataatagggatgtggaattagaacacatattataatgcatgttttaggaataatttagacacattttagtatgaagctacaaatgtattcatcctctgaaattctagaagttccatgcagccctgtgttttacattgtttttgccaagtcaatgatgataattgtaccaaaaggaaatcatgcagaagacagagaaagagctattgaaccacaactttatttataagtatgagaagacttcaaatttaagacaaagttttggataattttttaaggattatgtgcatcttaggagtccaatcagtagtcggtgaagtgctctatcttcataaatgcccatgactcaccaccagccattaaaatcatggcagttataggatccccaaaagcctcagggataaattatacattggcattgtgacagacaggcctaataggtctttcccaccagtaataaatatgttcctgcactctatgccaaggtacattttactgacttcctttgataccatggtgaagcctcagtcttagtagtaaaggatgtttccgtttaaagatgcttcacggcaagcattaagccactgagttaactgctcaagaagttcatggcaataccctgtacatcttagcatgacatttagagacaatatgtaggtgtgtttagtaaagcaatgcttaagctcttcctagaaggcaaatctccagcccattagtttttcattacagtgaatgctggaaggaaaagggcttgtcagccaccctccttgtgttccagggtttgggtgcctctctccaatctcacccttcctaggctcaatctaatcctgtctgggtcaaaccactctggcttggatctgacttaggaaatttggtctgctcccagtacagagttgaaaaacatttaaatgccactttctacctttgggtttgaagacagttaaaatgggacattggcagggggtgctaaattaatctgaaccaattaatcaggataaaacatgattctttattagttatggaatccaaactactgagaattgatagagtcatcatatacttaatgctcctgattatgaactagatgtggaatctagttttgttgtatttggtatgccctacccaagtttagaaaacacattaaggcctaatcaaaattagtgaaatgtaagcagattttggcagtaggtccctattcagttacctttgcttgtaataatctcacatgcacacaaacgtactttaaacaatagagtatggaaaagccactaacaagaatttatcaaaaatttccaataattagcaatttaaaatatatggataaatgaaaatttgtgtttataatgaccctgggaagcattatgtttcaaattcatttaaaaattgtattctatatgttgcattgttaaatacttattttttgcattatgattctttgagaattgcaaattatatagtaactccatatatggagttacatggtaatttcaagttaaccaaaatgccataccatattatttatcgactaccatggaaattaaaacagtccatataacttgaatttccagcactgaattgaaagctttttagagctatagctttcaattcagtcattttattgagaaaaaatgtgctctattgcaatgaaggggtctgtccaaggatatatagacatttggcagttaaggagacactgtggtctggcctcctgacttgcaaattggtgcccttacttctacagaatatcaagcaggaatcagacattccaatatttttgaatggccaaaacttttctacgtatgaactgtaccagctacccaggttataaattgagcccatattagagagaggctattttgagtatagccatactggtcctattgggagtctattttatgtagagttggctaagaattcagtgtgaaaggtgaatgggagggatgaaggaaataggaaatgaggtattgctccttaaagagttcacaatgaacattcactatccattctcctatctcatgttgctattttttcagcttttggcataacatgcacatctttagccccattcaagggaatatgtaggtgagtagatagatgctgctcagctatatctccatgtgcttctagggaggtcctcccacattggctttcaaagagcacaaactcctaggggaggagctaccttgcctcctacctctaattgtgaaccagcaaaccagatccctttcctttaagactgtatgacaaaataagtctccaaaacaggaggaaatgggaatgaaaaagaacactgaagaggaaattggtttagtcaccattttccctaggataactccagtcccacagcagagactcaggatgcagtcatatggcaactccagtgcagcaccaactgaatgcatgccagggaggtgcccagaagtgtttgcagggtcaggagagattaagcatgtctccacctggatgaacacaaggttgcctgaaacttttgccattgatttttacctttgttgacttgtgaagtctcatgagggtcatttttttttttttttggagttttcaaggttctttcacataatctctttaattgcatgctcatactttgggtgatagaactcattctttccatttttgatcagtggcaagactgggactcaaatctaggactcctgattatctcccgaacgattattctgtgcagtcccctacaactgctgctttgggagcacacacacgcacacagaggcacatgcatgcattttgaaaatggaaactatataggtgtgtatctttccacaggaatactatggtaggtactctcagaaacaacaccaacaatatgctctataaatctggaatctgtagttcagtggttatttggggatatcagcaaagtggctttcatcagtatgcatgtgcatatatatgaatatatacatacatacatgtatatatagcatttggcacatctatgtctatatcatctctattatatatttcatcatccacatatcagtcactatccttagctagtgcccaggtgctccaaaaaatgcacagtggctatcagcataagctgatagagttaattgttttagagttaatagaagaacacaagcaaccggtcatttggctcaagaactgagaaacttctttacattcagactttcctgacactgcttacatttaagtagcaattgtaaggcatcgcagctggttcggctcctagcagtgacaacaaagttgttattgtatgcaattggtggccttcctcccactggccatgcctcaccatagcgcagccatgctgtatggtgtctgcactgctgtgtgctggtgggggcaagccccagagagggatgggggaaggcaggaggcttggcacttacaggactgaatttccaggttttctgggaaattttcagaggttgttgatggcgtctgtatctaagcagagcagggggtgtgttccccagtccaggtgtgcagttgccaacctttgccaactatgattagacatggattcatgcatctagatgtagtccatcatttgcatatgtaattaattataatatggttagttctttctgatctccctttcctataaattgaattactcagggactctcatatgacactaaaatctttttaaaaagtacacatgacattttgaaggataagactaactgctatttatagcactccaacttcaaattcagagccttctgctgtgatcagacagcaaggagtgccttcgtctttcagcaagcagcctcagaaagctcgcagcaacggcttctctcctcaatagtcttcaatgctcaatggtgatcatgaaaatcacgacaccccaagttaaagacttcttcactggcactcagaaaggatgattcactcatgcattcgtttatttaactcacatgtgtattgagtaccaacctactgtgtgccaaaccctgtctcagatgatctacaggtagccatcaatgtcattcctggagttatgggttgaaacgtgcccccctcaaatttatgtgctgaagtcctaatccccagaacctcagaatatgaccttacttggaaattctgttgttgcagatgtaattagtcatgataaggtcatgctagagtagggcagacccttcgttgaatatgactgtgtccttacacaaaggggaaatttatacacagatagggactcggagaatgccagtcgaagaagaagacacagatcagggtgatacttctacaagccaaggaaagctgaagacaggcagaaaaaccactagcagcttggaaaaggcgtggaccagagtctccctcccagttctcagaaagagtccactctgccaataccttgatctcagacttccagcctccagagctgtgagacaatacatgtctgttgtttaggccacgcagctgatggtgccttgttacagcagcctaggacacaaatacatctgagtgcccagtttgggtagggtgggtgctctaaggctgaggatacgcagttgggaccccctgctgccagcagctcctatggcacccagggcactccctatgtgagtagatttcaaactgaattctggctccttccaggggtttagatcttcccactgcttggccctaaatgtctgcaggtgtgctgaggtgttgatcctctcagctttcaagatacttgggaaagacccaggtggctggggcctccaactccctccatttactgaaaatgccagataccattatcagttttttcagacatgatggtaacatgatgaataaaccctagtctaagcaaacaaaaattaaaaatcaagcatgactggggccgatgtctatggtcttgcaattgttgtagtaggccagattgtggaaggggaggatttatctgagctggactctaaatagggcagcttactgaaaggctctggcaggaaccaagcaaaggtttccacatggtcaaactggacttttgcagtctggctgctgcccagtgtgtgggagggggacaggaaatccagctcttaacagaaggccaagcaggcaagttgtcacatttggtagaagccagaaggggtgggatgtttcctccccagtagtgaagggaggggcgggtcctgtccaggactgagggatctgctgctctccttggttctcagcttactcaagcctctcaagtatgttaaaaatttggtcctatattttggaaagtgtttagaaaaaaaacaaaggtttaaaaaccagaatgtctcaaagctatagagtaaaaattcattcatttatatttaagtgatataatttataacagagacagaagcagaaaaccaggagaaaggatgaaacattcttaactccttcaatgtgtgtaaatgaggaaggaacatatcagttggttcataatatctatatatatatttaattcctcttgtttttggggatctttttttttctaatacttattaccactatacagaatgcaggtgggaataaaggaataacgaaagaatataaattactgaatcgatcttgcaaatgtttatgtatggttcaaattatttacttctagaaaaggtcttaagaatcttactcagaacctttatactcttattttctcacaaagctagtgactgtatagtgtaaattaatggcttcttgcagaataaatgtagcaagtagttagtgtaggagaaatgcatctgtgctagaggcaggcatactgacatcggtgcctgtctatatcacatgtctgagaaggtacgtgatggaatgaaatgaattaatgaatggaaaatggcccaaaaaaagatggaaaatggcctaaaaaagccatacaatcaaaagaagtatcatgagtatcatgaggtgaatttactgcatgtcagagctactctttccacatctcaatcatcctgaaagatgccagcatttaatatcagtaatcatgatgataaccctgagaatggattacattatttttactataatttctcaggtgtttcagaggttgtatgattaaccgtgcaaaaaggagttaatattttcaaaaattctgatttttaaagtggtctgtttcaggacatctgaacaaaaaggttaaagcctacaataataccatggctgaaaaactacacgccaatatttgtaatattttatatgcatatatatatacacacacacatatacagagatagttcaagagagtgattcaaggcaatttgtaaatgtattttgtttaagttgtcctaagtggttctcaatgttttaacatgtttagtttcatagtcaacttgcatgatgtgtgggatttctatgtgcaagatatcctcccttttaaaaattattcatttatttttaattgataataattgtatatatgtatggggtacagtgtgatattttggtctatgtagaaatattcaggcgagcgaattaacatatctgtcaccccatcaacttaccacatttttgttgaatgttcaacccttgatgtgcatgttgagagactattgttggtaacattgcttttgacatgtcccacaactgattgtatgtaacatgatagtatgccatgaaaacttggttgagtactgtggcagaaaggtcaggattttaggatttgagaaagttaaatttttctccagtcacaaagcttatccttctgttaatttctgttattttgcagtctgctgggtttaatatgggactccaagggggctcctagtttagacccttgcctcctggcaggacatattttcccctaatgagacagcactggccaaatgctttattcttctctgcacagtgtagctgtgggattgcatagggctcattatgcacccaagtagtcatgtcctagtttctgcttttttgcagtgctggtatattcatgaaagagtgtaatgtaatatacaacaggttttttttaaaatatcttgggatattgtaaaaaggagtaatttgctagaaaggtaagaagagggaattaaagcttcaataaatctgtgttaggctcactgccttgctgtatttgaggtcttacctagtttatttcaagcttggggttctccctaaggtacacaggacccaagctgatatattttagatgcaataatatttgggacagaaaattccaactcttgttttgtgaaatgctaggggatcctcaactatttcaagaaggattacaagacagctaaaaggaaaatgattttaaaattaatttaataaactaacccatgccattgagttccctttttgcagtattgggttatgacccaaactgtgccaaatacaaggcatttaaacacaaatggttcataatgctggctctcagagaacttagtcaagtaaaagaggcccgcaaaaaatgcagtgaaatgttacaggcattgcctacaggggagggttgagagaagtgatagtttttgaacttgaggtagggcttcagggaactgctctactgtcccctgaaggggtgcaggctgggaggcactttggaagcagtatcttctgtctgtgaaagtgtgactgactcttagagcaatatgtgtttcttttcaaaaagatcccctttacagaaaggaggaatgccagattttataatattttttccttgctactcatttctttgaccgatttattagggaaggcatgtgtgtgtgtgtgatataatattcacacaatatacatatatattaccacattaccacaaacatatatacatgtttgtacatatatgtttgtatatcctatgtatatatgcatatatgtatacatgtttgtatgtgtgtgtaacattatgtgaatcttttattatacattaatatgttatttataataatgtatatgttatataatatattaatataatatgtataattttgtacatttattatgtatttttatatataaatttttagccaaagctaatagaagtgagatcaataaaacattatatttactcccatgtcgagaaataccaaacccttctggcaggtgtgagcaagtacttgctttcagagctttgcaggaaattcctgaattaatacacaagacgactttttttcctgatagcagaaattaactttcagaataaaaacagtaactcttgttgtaaacaactttgaaagagtgattggcatttgtttatttgcatgtacgtctacctgtttattcaccaaatattttctgagtgtttactatgaataattgtgagtttctgtgataataaaactatactttcagctctctgagggcaggaaagcttttttattaatcattggatccttgtatctagtacagtatctggaaaatgcagacattccatatagtattaatatgttcggtttgttgaagtaacatataccgtgaagacacttggaatggtcccttcagttcaggaaatatgtatagcgcgattgaggacatattcagaaggaactagtaagtagtcaatatagaatgggtgctgcttaatttgtgcatgtaatatatgtttggggccatcggtggagagagacagttccagctgaataaaacatgatgatacacaagtgaatacactttattgatgacttcaatttgtaagatgatcaggtcaggcaaattacattgttgctaactgacttcaataaattttgactgtacaagcagcagaaagaaatttctgtctcttatatttcaactgacctctcagaaaattagccattttttttcaatacgtaatgcctcatgaagatggcttgcgtggcccctgaagtagtgaggtgcattttcttaagtggactgaacatcttggtcgtctgtgtgctggctgtgttctccggcctcagcctggcagagttgtttcgtaatggctgcattttctgcctgagtgatggaaaacacgtttggtagttttagagaaaataattggtattttaatttctctgtcttgaacgtctagtactactttgtggaggaatttgtgacgtgatgttgttgctttccatttggactgttgaagaagtcatgagggttgatgcctgaatgattttccatagaaatgaacctgaacagttttggtgaaaaccttctttaatgcaaacaagaatatatttcttttggggttggggctgaaaatagacattttaatttcattatgttattagtttaaaaatctattaaaaccaacaatgtgaactgttttgagctcttacccccctcccctgcccaacgccttaaaaggtaaatggagtatttctgagagaattcccaaagagtatcttgtttggaccaccaactacaattttgactttcactttctcaccatttcctgtaaaatcgggactgtttcatcagtgatgatctgcattcttttatgcctttccctgagacgagagtgcccttccctggctccaacaaacaactcctgcttatctttcaagattgactttaaatgttacctcgtgagactcagtttctgagttctccacttctgttgtaattgatgaagagactaggcacataattgtaattgagctatttccacggctgctttccctgtgtgtgagtgcttccaggctcaggattgggtttgacattgcctggtgccttccaggagcagtgccctgcccacagtgaggtggaagacactgttgaattgattgttggatagctgaatgtgaaccttgcagaggggccttgcttggccctgcctttttccctggagaactgtaaggctatcagtgcttggaaggtgctctgttgtccttgaactaaatgtctgctcctatggctgtggctcaggaaggagtaggttggtccgctacaggaggaggagaactcacttgcttttgtcagggttgtgtctcctctctaccccacttgacttttcacacagcccctgagtgatgtacctgccgagctctggactgaaagggatatctggggctgtggacggagtccagaagtagggcttcgatggaagagctaaatgtttctttattcttcatatgtctctgaggatgttgttgatagcagaaaacaatcagcaagaaatttctgctatcagaagctttcaaatccatgccctgaaaaacaaaacaaaacaaaacaatacacttccttctcctataagttctaattcttatatttttcctagggctatcactgatgtctctatccctttaagccatccaggggggtagttggaattcctaacagcactaggattaatagtgcagtggtataatgccattcataagtgtttgtggggaatacaatttctagtggatttgattttttataaaacatacagacattttaaacccttggcccaagtatcagtcctatttattcttttaattggcattagtttggtgatcttggatctgaatttctccttggtaaacagtaataaatattagcttccaaagtttgttgtaagaatgaaagacaacgctgtaaatgaaacctccttgaaaatagtatttttgaaaattggtattgtccagaagtaggttgctaatataagctctctcccacttaagttttttttttctgctttcatttaaatgagcaagcagagtttgcctttttttttttttttttggtttaggtcttgtacttgttcattatgtaataaaatggaaagtcagagagtacaaaagagaggacaataatggtttcataaatcgtagacaaccttaaagagaatggaatactttagcagatagggaactgaaactcagagtaggtaacataccaaacgtcaagcagttcttagcggcccagctaaactaaaactcaggtcacttggttcccaaattaaaatgttattaacccataaatatgaaacattaaaatgtgtgggccaaattgaacaaatgttggaaaatatgagaccctagtaacattgagatactcatttccctttggcttacctcaatatttgaaagagactttttagcacatcggtaagttgtcttatttattcttctggcaaatgttgtgttatgccttctgtatttctaagaaccataaagggatgggggataacttgttcagctctcatctatgatcacagatattcgagaagtgtttgtagttgtgctttaaaatagctcagttctttgttcgtttcaaatatcctgtgttacacgctgtctttttaagccctttgctttgcctgacccttaatctcttctgcttactttctcctcctctctccttttctacagctttatttttggttctggtagtatgacagcacttctgaattgtaatgggagtgtttttccacacctccaacctgtcccaaatgcatgaggtgacttttaaatcggcccgattcagctgtggggaaggatggactcttgccagcaggggcattgtagctagaattaaagacaccattatttcttggggagaatcattgacaaaacttagttttactttaaagagctcacatagaaaagatattttcttcaagactgatcagatagctgcccctagtatgtcataaagctcaactccccagggcccagaaaccaggccaagagaaactcctaatgcagtgtgatctgttcatgaccctcttagaaaagaacatccttgttctccctaaggaatgcatgtccaaatgcatctttcttcacacccttaagaaataacctcttcccttggaccatgctgaatgtaatgaatggaagaacactgaatgagggtgcaacggagcagtctagcctagttaatggctgaccgaatcctttttaaattgtgtgtgtgtgtgtgtatgtgtgtgtaaattttgatgcaagtgggccatatgggacacagctgatcatattaacagaggcgatgctggtgtggtagaaggacacaggcttgaattaggtcacgccctggatgcagttcttagctcctgaaaatgagaccctggcagtgacttcccacccccaagggagaacaatctggtctggaatctggccccaaatgattagttaactcctgagaccagggacttcagacctgctggaggccaagcttcctttacctagaccttggggctggctaccttatagaaaaaggaaaggggagttttctagcagttaaacaacccccacccccccccccccacacacacacagagagagagagagagagagagagagagagagagaaacgggaagagagagacagaaaggaaagaaggttttattccttgcctccctctatctcctggcccagaaagacacttttcagtcccttgtgggcacaaactctgaagacagatacaacaaagatgcatatggaagctcagctcatacttaaagcaaaaagacttcattctaatttcaaaaagtaagttctcttctcctttaatacttattagttccattcattccttgtgctcctcaaggtcacttctatttttaaaattcgggaattctgcctgttaggatttctcactttaaatagttggtgatccaaacaaacaaacagtaaaaatatactctaagtgaggaaagggggaaggatgtgtgtttgtgtatgcacacacacgtgtgtttcattttaaccaagaccaaagagggcaagagtaaaactatcctcttgtttttccttcttctcaccttctgggcttgttagaattaaagcctttccaaagttttcccaattcaaagccaagccatttaaagataaactgatgccagaatgacagagctattatagaaggaagcaaaccttttcattttatagggtaagaaaaggagttctaaactggtgaagtgacagcttagagtcacacagagatgtttgtggaagtggatgccttatatatttttaagagatatctgtgcatgggtaaaaaacaattaaaggtcatggagaccttatcagaggtttctatccagatgagattgctaggttcaaatgaaacttgtccaagagttgctgagattcaaaggctaaagcaaatgcaggatgaagattcagagaggtccctgccatcatatatgaagaaggaggggaaaagagccaggatatgtgctctaagaagattttaaattctgagaattttcatttatataatccctttgatggataaatatgtggctgcttcatcctttgcaattttataataggcagcactaattttagcatattgtttattaaacatttcagtgctcatccgatttttgcatttgattattgaattgactttttcatgattcagttctttttacccaaattgtatggtccttttgtgcaagagaaatcacttgtgggcagtaaaatgcaactttctcatctctttgattctttcctagcagatctaggcagaatcccatttgctctgtggtactctgcagtaccagaaactataaaactgcacttcccagggctggttagtgcaggctgatagccccgtcatttcagccggtgaagtgaatgcctttacctagctgatgaaagcatggggctttggagaagttccagaaactcctttatgcttgtaggagaacgtggtagcgtttccaggcatgctgtgcgctcagcgagtttggtgcagtgcagcaagcttgtgtaatagcaccatgttgatcggctcagtgctccacttgaaggactgggaggcactcaacgcattactgtgcgagatgtgtgtgtgtgtgtgtgtgtgtgtgtgtgtgtatgttatgcatgtatgcatttgtgtgggtgcatgtttacttttcatttaatcccattaaccaagtatcaagtacatcagccattactaacatagcaaggttactatttctggtgtcccatttttattcaggtcttggaaaactcactacatttctgcagatactttggagtgctctttttctagggtctgttttttttgtgttttttttttttttttttgtataagaaaccctcctagttcatatacaaagtggctccgaagtctggatgtttgccatcttctgcccccaataacaccccaggtaccaggtcccactccagtcttattgtttagcacattgcctgactgtaaccactctcttgtgtgagggcagattggcagatttcaaagagcagaatcgcagaactcagaactcagaagatatttgatatattgtagactgatccttttattttacagatgaagaaatggaggcagacatgtaaaatgacttgttcagatcactcaggcagagctggggctagaaactaggtctgctaccttttagtccaattctttttttcctgacataattgcattgaattttactagaacattataagaagttgatcagacttccccctttatacatcctgtaagtttctttagggccgtggtgttacccaaatgtgttactgaagcccttttaacttctcttgaaagttataaagtataaatcagtacccctggagaaattatacctgtttggatgttcgttgatgctcattatattgatctgctcatagtggacatccaatacatgttgagtcacttttgtaatcaggattgaatgtaaaaagtgggaacgtgattgaaactttttattgttaaacacaaatatcctcagttgtccacttggtggatgtgcagcccaccctctgccaatggagaggatcttgagtatcttagggagatatctggcttgatccaacgtctggaaatctgttaactgaaatagtcttctgaaggttcttagggaaaggacatcttcaggtagccacacattgttgatgccagcccagccttctggtgtctcgaggacaccctggatgtctgagagggcctgttctgaggtcagttctggctttagcagcactatttgttcattgtgagacaccttgaaagttattaaaattttctaggccccaggtttcttatctgaaaatggggtgctattggggcattagtgcactagtgaatgggaggtacttggcctattacctagaacacagtatattcctaataaatgcttgctcctgttagagagctgcaatgggggttgagtggccgtggcaccttatggatatcctttctgtctcaattccctcatctgtaaaatgggaatcgtaatagaagttgctttataagaatgttgtgaagattaaatgaattaatacatgaaaatgattggtacagtgcctatcacatcctaacatacatgtacatatactaaaaatattagtgattattattgctatgtgaagcacttagtacaataacaagtacatggtgtgtcctcaataaatggtaccacttattagtcttaaaagttcataaaaataagtggtaccaacatttctggatattgtacagaatttagttttataaactcaaattataagccagttcttgtgactccatttttaagtgacaaacagaatttattggtgtattagtttttttaatgctgctgtaacaaattcccacagatttggtggcataaagcagtacaaatttatgatcaaacagttctgcaggtcagaagtctcctgtggatctcacctggctaaaatgaaggcatcaggggcctgcgttcctttccggaggttctcagacagagttcatttattgctcacttggatgttggaaaagttaggttccatatggtcatgggattgagctctccacttccttgttggctgtcagctggaggcctctcttatgttctagaagcctctctgccatccttgcttgtgctctgctacatcgaattcatgtcacgctgccatctctttgaccacagctgggaaatctccacttttaaggcctcctatgattgaactgggcccactttataggattagattggacccagagaaatgccctgggtcattcaggatactctttccatctcgaggtccttacccttaatcacttctgcagcaccctctttgccatgtatgataatatgggcacagattctgaaattaggacgtggacgtatttgcagggggtggtctttattgtgcatacaagttagaatgtgaaaatatatgactctggcctttttctgatagatggtggatagttctaattaagtatactgtgcactgcaaatttcattgttcaaaaggttaaaaggcctgaacactttgagagtaggtatgctaatttctttcttcattcttttggccttatgggcccttgagaaatacttatgtgattattattttttaagcaatgttttgggcacacagtcttactttgcagaagctccagctttgtggcatagggtcccctcttaccttgtcaaagccagctgtccattgatgagcttctgcctaaagaccaaactccaaggtcatgattttcatgacatcctttttctgtaatgctctgttcagcctgtttagtacctattttttccagaaggcctgattcttctctttgtcttcccctccatcatctgccttctctcaagcatgatatgtcttccctgccctgcaatgtctatgcgtatgcttgaatctcccactgatcatgagctgctccacagccaggaatggctcttcatcttctttgtatccttagcaccaaatacagtgcctggtagaagataagatgcaatgtgtgttggctgtattccagtgtactgattagaagaagagtatttgtctaatctgtcactcagtagtgatctattggccaaaaccaggatgcaaaacttggggccagaggcagagccataaatagacacagttctggtaacctaggggtttacagcccaatttctagggaagcatcaaagtggtacctctccgacaaaatgagttgtatattcctcattaggggatgaatgctaaatgctttatttgtgggcagggcagggcattgaaattatttagcatttatctcctaaatgcttccccagggcttcaaaagagaagccaaatattatcctcatgtctgttgtcttcaattttagatttacagcagttcttctctgtaatgtgtgatataacaagaccagagtaaatattggcaaccttaggtgcatctataagttgggtataccctatttcatctgtttacttcaatatctgaaaattgactgcagttgacaatgtgggttcacttggctgagttcactctctgtaatatcactccaaggaggatgtcataaatcaggaagaagaaaaattagtttagaatgactgaactcatatgtggaatgatttatgttcaaatttctagttggtttagcaaacttgtatttatataaggaagtaaaatactgatgtaattacaatgctattctgatattaacaccaaactttcatccttaaggcaaatatttctgttttagtcctggtcttgatattttctttcataatcacaccctgacattgtctttaagcttctgtattgtgcatctgtttctatcgtaggcaatccacatttgattggttattattatattttaaagcagggctactgcattaacagcagaaaattatgcttcttaatttttttttaaagttcagagtttaaagtttaaagtcattggagctctgtttttttaaattagttaggctatttgtgctattttacaaacttattgaaatactgatatttagggctctactgacagaagaaaaagtcagctaaaagcttttcataaagactcataataaaaactctaagctttgtaaaaagacaaaatcattgttttatctgttttatatatccaatacattttcagtgctgagttgaatttctacacaattttctttgtcataggactcatgacttttcaggtttactttccttacaaatggattttgtatgcacactgttttagttattttttgctgcataataaatttccccaaaactcagtagtttcaaacaggaatagacattcatcatttcacacaatttctgtgggtcaggaattcaggagtgtcttagctggatggttcaggctcagagtcttttgtgaggttgtggttagagtgctggctgaaggcacagtcacctgaaggttgactgaagctggagcaccctcttctaagatggtgccagcatttggatagcaagttggtgctggttgttggcaggaggcctcagttcttcactaagtagacttcatagggctgcttttgtgtcctcatgacatgatcactggcttcctccagagagaataatctaagtgcaaggcagatagcccagtgtcttctatggcctaatctcagctacacaggttatcttatttgatatgagaggggcccatagaagaatgtgaatatccagaagtgagaatcactggagtccctcttgaaggctggttaggaccaccgattcctttttcttacttcttaagcctatctgactgagtaatggtgattctgcaaaatttgaaagtacaatttcaatgtatttagggttgaatagagaacccgtgttagggaagaatcaggagctggtagaatgtagagttgacagtattggacatagtagggctgaatttaggatcagagtagcaacaggaatctgaggcaggaagacaattccaaaacagagtaggtattgaaccaagtagcatctcagggtagctgcttcctttaagcaagaagttcgtggggttcagtaggaagacaggactctagggactgggtttcagagaagaaagcaaggtgtataccttgctatttatcattagagaaaataatgtaatagatttttcttgtttgtgcatatgatgatgatgatgatgatgatgatttgggttcagtagtgacttggcaaactgattttaataacttgaacatttgcatcaataaacaccaaccaacttttgagggctaaattgaagatatgctaattccaaagtcacagcattcatttagcaatgaataaagatatactaattgtctaaaatcgctgttggtaaatttgttgcttagcaagctacacagctttttgaatctgataagttatcattcagtgctttacctactgtgtgcagtttgaattttaaagacactaattgcagatgcttattaagtgtttaatgtacactaaggtcattatctaggttcgtggcagtgacacaaccataagatacatggaatcaatttagaaaaacaatgggttgggatgtgaagtgaagcaggcttgagtgtctgtctcaagtccaccacatactagctatagctgtgggacatttggtgagttatttgatttctgttagccctaactttcttatttgtaaaattggagtttacagtacctgcaaaatactgaatgaacctgatagatggcaaacacccaataaatgttagatttgattattcatataaatatctttttaaaatttccactcaattattcatttggcaattctttattgatttccttttatttatagttttgaaatctgtgaaacagaactgaaaaaaatgatcaaatccccatcctcatggtgtgtttataaccataaagtaagcacaacaatacaaagtgtttaagatggtgatcaattctataaagaaaataaaacagaaaaggaggagagcaagtgctttcactgtggagcagatgctgttttgtgtaggatggttaaggaaatcctcactgacatttgcccagaggacagaaagagtggcagaaagagcatacaggtgtctggggaacacagacagtctaggcaaagggagcagccagcgcagagatgccgaggtgggagcattcctggcttgggcaacatcaagaagtccactttgggtggagcagagtgagtcggggagaaagtggtaggagatgatgtcagagaagcaggatgttcttctgggggcagctcatttaggactttgtaggacatagtgaggggtttgcctttaactcctaggggacaggaaaacactgaagggttttgagtgaaggagtggcaggatctgacttatgttttataaggaccactctggctattgtgtaggaatagatggcaggggccagatttagaatgaaatactagagattgtgcaggcacaagataatggttgggtggacaagggtggttttggtggagagagtagagagaggtcagattctggacatatgctggaagtagacttgacaggagtcaaagatcattcgagttattttggcttgagcaactgggcagagagagttatcactgagtttgggagtttgtgggaagatatctggcagttgggagcaaatgtctgggttcagacatgcaacatttaagaagcttttaagagatgtctaagtggaggtggtgagcagagagttggatttctgagtctggaatttggggcacagggtgaggattggggatgtaaatttgggagttgttagtaactgagtccatggctccacctggaaatcagtatagatagtgacaaggcctggtttggagctggactgttgggcaggctgatctttacagcacagggatttgaggaagaacctggaaaaacatctgatgggaggaatgagcaagcatgattcctgaagccacatggaagagtgttttaataaagaggggagattaattgtataaaacgctgctgatggatcaagtgagatgtaactgaggattaaccactaatatatctccaacatggttaactggcactccattcaatgctctgcagaaaacaattcaatatgctagatatagtattttaaaaaccttttgaattctccttaatctggtaagaaagcaaagaatactcaaggagaaaaactgctgtggtaatgctcttgaacaagcagtgtgaggaaggatctgggatacaggtggaggaggaggccctatctaaaagtgtggacattttgacaaaagtagcagaaaggaagacagagtgtctggacacagaggcaggtggctgtcagatatggtggtgggcatgtgttcttccgatgacacttcctttctttctcagtgaaggcagaagtaaaaccattatctgagagtaaagtgtgtgtgtgtgtgtgtgtgtgtgtgtgtgtgtgtgtgtgaagtacaggaagatttgagaagaaaggaggtatagaatgatctccagggaatactgtaagattgccttccagcactaaaggcgcacttgaggttagtcgtcatagattgaagaaaagtgtgcttgtggagctgcctgtttcccctcaggtgtgctcatctgcatgcatgcagaggtggagtgagtcctgactggtaagtccaagttcaagagggaatgggtaaagcaagatgagagggcaagagggagaggacagaagctcagaagtcaaagctttctgtttttccactttgtcatggactataatccacctcctttattaatttacatttttatctacctaccccaatagctgaggagcccatgttttatttggtgtttccaacatactcttagcaggttttattgtctgcaaagtaggaaattcataactgtcaattgaattgtgttttcctatttttcttagtcattatacatcagctacattatgtgaaattttgttgaaaactctttttaaaaagtcaactccatataaatatgtataaggaactattccattccaaaatgctgcttttgattatagatatatcagcaaggctgagataaattaaacttttaacaatatggccaattttgtcaattaagtagatggatgaaactaaatatttcaataaagcatttggcctgatctatttcatttgactgtttacattttatcaaattgactcattgcttgccaattttccactttattttgaggaaagcctagaagatgaaaaaaagataatagcctaatagcctttttcttttaaaaataatttctatatagtgattatcaatttgaaatgttgttaaggttaaacgtgtgtgtgtgtgtgtgtgtgtgtgtatgtgtgtgtgtgtgtgtctgtgtgcatattggtaaggactttggggcgtcaggaaaacagggaatataagcaaatttagatcagtgttctgtgatgggcaaaagatccctgaaaatcctctcatgtgtgattatgtgaaatataaaggctaacaactaaaataattgcctttagatatagtaatatataactttagtcaacaaatatgcactgtgtatcttcttgtgccagatatggtactgggtaatgggtacagtatttcaaacaaatctaatattcttactatgatagagcttaaaatctgatggggttgtaaattatagtccgtacggagatagattgggcacactttggtaactgattagagatgaggggccagggagaaagggttatagaagattatgtagaagttttgctcttgagcaactgagaggatgaggttggcattaacttctttagggaatacaacaagactgtcaaatctggagaaagacacttttcagctgttgaataatttgctgaggggggtacatatggacatttgtttagaaatgtccagcaggtattaggtgagattctcgaggcatagattacatttaacatgagaagaaggcagatatgtatgatgatgctgtagttttcagctggagagaagggaagatttgaggaagcaacaagaaggttggtgggagagatgagttatgagccaggttctaaagagaagaatgctcactgttgctcatttataaaacaatcagttctggtatattttaggtatatagttgattctaggctttgaatctaaggtttgtattttcttcacacggctgattttaaattatatgagaatgtagcagaaactagaagtgtattttaaaactgattttggtggtagaacagttagcttaaaaataccagttaaataaaatttaatttcaaacacacgaatgatgaaatacacatatcccagaagtttgtttagggataagatcagcgaacttttaatggttcaattcaatttttgtgttcagtttacatatatgtttttctctcatatttgtttttactcatattttgtgttacccaagttgatgtgttctcaaaaatctaaccttcctagggcctagagcatttctttggtgctgcccctcatcttgtttgcttatttcctcatattgtgcttttaggctcaaggttaatgcttgtaggaagcaaagaaaggaaaagaaacagggagcctatgctatcctgagacctcgcttccggggcctcctccttccttctgtcaccatccctttccctctccacctcccgctgtccagccaagtctccttgcctaaatcgggaaaggtgcaggtagaaattcaggcagccccagtggttctactcctgtttgattttcctcatgatctcttgcctgcttgctagctgggatttctgacaatagtatgatcgtaatggaaacagaaaaggtccagccaagccacacgctgaaattctcctaacctttaaatgtgcacatggcttaatcctaagaagcactgcttttggattgtttgcactgctttatattcttaaggtttggttgcatccattttgactcccctggattggtttctcaagtatatttttataaataccctatttaaaaaaatcacttctccaaaccatacttcagactcaaccaccctaattttttaagaagcttttcgttttcggtgaacagctgaatttgtaaataaccgttgaatttcatttgttgtatccttggagcatcttgctattcttttgcttagaaaattctaacagcttggaactattcaacttcgattagaatgagttttctaccaatgtagaaaaatctgctttatcaccatcattgagaaagatagattctgttaaggaaggtaaagtatgtcttagtgatcttgctctcagcataaaacaagaaacagattcacgtctagtgtaatctgtatagtgcagaatttattacctagaggccaagagagaagcacatcacatttattcagttctcatcttcgctcctacttaagagttcttagaaaatagagtcacttaattttgaagaaatgatgttttctcagacaccggaattttaaaaaataaaacaacattttaaagctcttttgttcttggggatatttttcctccagctttcatgtggcactttgcactgttcatctaagaagccacttaactaatctgcttcttataagcagcacagtataattaggcaatcacccttgtgtctagagtccaccagggaaaaaaaggtgacagaagtgcacaacgcatttattataaaacagtgtaaaataaaaaccggaacttaccaaataaaggacatatggtaaaagacatactgtaaaatactaacacataaaaggtaaaatgaaaaatcaccttcaatagaatgtcttcgttagtcaattgggatcaggagcaactggttaattgaaaagataaattcacaaaaatagagagtaaaacaggacaattattaaaaatgatacacacatgccttgaacattttattttatattaaatatataaatgctcattcatcagtactttgagatagctccaccctgtgttctttgattagggttgaactgatctgagttcctgcagaaatcacacccacgatctatgatttctaattttggtgtttttaagtggagcagaacttgaagaacataagcaagctgagtgcagcatccttcttgattttcatgagtttttttcccccagtcgtttatggcatgagaacacatgtacttaaataaatactcttagacatttgcctctaccgggttttgccaaatcatccaatccatttttcatagaaataactctgtcttttgcaattatacttgtgatttcaaaaattcttacactgcaacagtacaatgtgtataaacaaaattacggccatgtgttgttgagacgagaacttccctgcatgcacattctgtgagggcatcccagccactgtggccagctttccacgggcaccatcacattgaactgtaaaacagaagagataaaaaatagttttggttcatttaataatgcagtcattaatgacttcctgggatcaagccatcctcccacctcagcttcccaagtagctgggactgcagatgcacaccaccatgccctgctaattttttgattgtttttttttttttatagaggtaggatcttgctgtattgcccagactggtctcaaactcctgggctaaagcaatcctcctgcctcagcctcccaaagtgctgggattataagcatgaacccctatgcccttttttatttgtaataaaccttttatttcagaatagttttagatttacagaaaagttgcagagagagtacagagttctcattatatcccacacccagcttcctcttacatagcctcttatgtaagtatgttacatttgtcataactactaatgaatcaatattgatacattattactaactaaagcccacaatttactaggatttcattagtttctacctaatgtccttttcctgttccagttttccatataagataccatgttacattgagtcgtctgtctttttaggggtcctctagactgtgacagctttgcaaactttccctgtttttgatggcctgaacagttttgaagagctttggttcaagtattttgtagaatgttcttcaatttgaatttgtctgatattttcttcatgtttagaagagtattatgggttctggggggaggaaaatccgaggtaaaatgccaccttttcccatcacttgaaggttatctaccaatactatcagtatgacttatcaccattgatgttgactttgagcacctgtctgagctagcatagtcatgttattccactgtaaaattactttttttgttgttgttgttgttgattaaatgattctagtaggtagatcatgggtaagataacttctgctatatttgtgtgatttttatgctggggtgatttactacactaaaatggaaacatgtaaattatttcagctatgttatctccatgatagaatgcaatagtttggcctctttatgaggatttcatgaatagctgaaaggagtgcacttaattttgtcttagcactgctgctgaattctagtttccctgggttgtttcacatttcttgagctttagcatctaactgaagtaaagacagtctccaaagctgcttttctgggggaagtggtttggaaggagaaatggagaactatggatgcacaattgtgcttctatagttgtgtgatttaggtcttcaagctcaagactaaatatgccattctttggttcagttttagttgaatctgtggttagcattttgatgacattttaatttttcttattactcttaagtgcacttagcaaaaatttagttgctaattgccttgcagtacatcagggattatcaaggccaatgaagtgtccataagtccattgccctattctgcagaccaccccaaaaatgcaaagtgattccaatacggtgtgcagaggggttttgtgcaccaagctgcaaaccacgataactcaaaatcttatacttttcagaagaagttgcagaaatcctaagaaacaattttttaatgaagagccagactcctacactatgtcaatctattggaaaacattttaatatagaacacaaagagatctctagaactcagagaccatctgttttctttgtgggcctgggagacatgatgagaaatgtcacaccaacttcattttacctaaatatctgaaggggatgcaaaacttttaattgtagagttgaaatatacaaataacaatggttttctaaccttccaaaaggaacagaaacagtggtcctgacaatgcaaactcagttctacataaccaacattaaggagcaacacgactgaggtcaattcttctgttttttttcttctatagttcaaagggactttatttttcaactccattttggatggatagggaactcaggaatctattttcgcaatctctgcatcatctggatggcctcagtgtgaacttgacccagagctgctgaatggtgtaaatattttactgcccattcagacattattttatcgtttctgtcattttcttggtcgctgcccattgcggaggtatttgcttctgctaatatggttgtatgaagcaatgtgttttgggtaaaagcaatgtggtgctgtgaaaaaacctttggagagaaaatcctaagacttggactttatgtttctctctggtacttctaattctgtaatctcaggcaagatcctagcctttgattttcagtgccctgagggagaatgagggaataattatgcctgcttcgccgacctttagaaagttggttttaggatccattgtgtaataattgtgcaaaggtatcacaaaccacacagtgcaaaggtatcacaaaccacacagtaccgtacaagtcaaaggacaagaaaaaaacttaaggctgctaaggggcaaggaaaagtctagagtaactaggaatcctctttgcctacaccacgaaccattagatatcacagtgcatggtggagtgatgatctttactgttcagaagatgttgatgagagggacagagacgaaagtgaatttgtagatacggttgagaacatctccatgccccgagcttagataaaaatgcgctccagtggcaccagaatcgataagaagtataactaactgaggaacaaatgcctggtgataatcataatgatgaagaacctcctgtagaagttggacaacatgatttttatggttctttctggttttaaactcctatgggtggccaacttaaaataatcataccaactacttaaagtaaagtaatccacaaactgatgggagaaaaacaaatcaaagtaggtattttaaaatattttgaataatagcattcacaatgaaatcacttcaattttcaagttgagaacattaacacagagcttactctgtgccagacattgttctaagtgctattgtaactcatttagtcctcacggtaacctcaggaggtagatcaggaaactgaggcactgagagagccgtcttttgatagaggtcacacagatggttctgagggagccagaacttggacaatggcagtctaactatatagactagggaaaagtgaaactagaaaaatttcactaatattatcagaaggaaacagctattttgaccactggagaaatagtggaaataagaaaggaggggagggcaaacagaaattgacaatctagttcccagcaaccactcaaatattcaaacacaagtgacagagttcaagccaagtggatgccacggggttaaaagaatgcccctggagttaatatttagaatgtgtttatttttagagataacatgaaataaattccctgctgatattaaataaatttttaaataaagcagtcctagtagttttcctaatcattcaggatgtgtttgttttttttttttggaccaaacagtcttctagaaaaaagcagtggaagatgaagattaagcaatggagaaaaggcctgttattttaagaaaattagttgttaaaaagtcagtggaagatgaagattaagcaatggagaaaaggcctgttattttaagaaaattagttgttaaaaagtcatagaaaagacattttatttgaataaatatgttttcccattgacttgagtactttagttgtagcagatcattcatagatttatgccataagattttgactagagaagcctcttgtattatgattgcataacaactgctatgtttcatttgttaatttttgcttggtatttgtggatgttaagtgtttgttcatttttttcatatttcagatttcaggtttctacttctacatctccagccctgaatactcatggaatatcgctgtacctatgacaggttgcatgatttttccccctctgtgcactcaatttgtgtattattgtatcatatgacattctgaatcaagtgctgctagtaccaagctgctatcatcagctgatgccaaaaatattcgttataacacttctcagcatgcaagtgagagcacttcaaatcacacagacagaatttccagccattgttcttttcttctttgcttattatacagcaacaagaatcaaaacaaaaggggatttattagaaaataatgcttcagtaaaatgttataaaacatgaggtttattgtttgtgaagatagagtgaaattcagtaccacattatagataccacctcagaggcctattttccccttcttttctcttttctcaaatgtttttcaagtggcatctttttttcagtctttgattacattaaggtgcaaactatttatccatctggaaataagcaatactgtcaacagagaaccaggaaatgaaaagtgcagccggccatatgccttctctacggcctctttatgttactgtgctgatcaggacaaatgcagtacctatggtagcaatagggagagtgaaaatatgtattctccaagggaagacaattaaaagacaaattccatcaggaagatttgtcattttttgagagtgctgatcctgcatctatcagcaaatttcacataaattaattcattttacagagtgaatgctgaaacttggaagccaactgacaagatgccagggatggcatggcaaggaagagagagccttcatggcaattttgaatacctgatctcttgctttcatcatcttgtctaggggaagaaacacggagcctggtagttgggaggtgagaggcaggaatggataccagagatggacagacagtggggtggtgagaagggagctgcaatttgctaatccttgtagtactacctgtcaatcatcttgctttccttaatcatcgatcctggagagactttgaggaaagggctggtggagttgcgcagatgtgatcttcatttcagccttatgaatacat

SEQ ID NO: 187 - DNA, 63907 bp, Homo sapiens
gctaatgaatgaatgtgatcatttaaaagaaagtctctttcagtatgagagagagaaaacagaaggagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcctcaaaggccattggaattttacttttattctgagataggaatctgttggaaggatttgaacaggtgattgaatatgttaggaactttgaggctgagttgagcttctgagatgattgaatgttggaatgaatctgttgtgtaagtaagagaataccaatttggcaggaagagaacatattctgcatccctcactgaattcagtaataaataaaaatgtgtacatgtgattaaaagaaggtgaattgatatgtgtggtgataattttcaaagtagatatgttagaattaaacattattaacataatttaataaggcagtttataaaatcagtaacaaatattttatcaggtggttgtgagacaacttcaacaagaagtggctgacagcgtaaaaaaattaacgacgttagagtctccactggaaggtatatcacgttgtcacattaatttggatgagacacaggcctcaaataagaaattatttcaagtgaaaagtcaagtatgtatggaatttaacatgtcaacagttattctgtagctagttgaattatataacgtgttttaggatactaattttggcagaagcttgattttttattttcattataatgaatgatttccattttactatctttataatgtactatttttttatattgtgactttcattataccattttgaaaaaccattgcataccttttctcttacaatatgtacccttggaaaagttgagaattatacatcattcctcatagaaaattgacttttttcctgttaaacagtatttttaagtaatttgtgtattgctctgatgaggcaagccagattaaatcagaggagaatgtttcatggaatgttccagaaaattgtcttatttcttcacttttgtgaatggacacagaatctgtgtctatttgtttcacagattctaggttaacttgtacagaaaggccattatactattctttgaaatgtgcatgttttaggttaatttacaaactatttgaaaagttaggcattttctttatcttttatttaaaatatactgtaaaactgtagaaatatttagatttgatatagcatgtacatcaaaaattaagagttgagaaaattatcttgatcctgcctttggattttaaaaagattcactgagatgtcattcacatatcagacagttcaaccatttaaaatgtacaactcagtgtctattagtatgttcacagcattttcgtcaccctgaaaagtgaccccacatctcctaggcatgactgcagccttcctccatgtccctccacctacccctgttgtaggcaaccaccgtctacttttgtctccatatgtttgcctgttctgcatatttcatatacatagagttatacaatatgtagtcctttgtgactggctttttcacttagcataatgttttcagaattcatgcatgttttagcacacattcgtagtttatttcttcttatagttaaatgatattctattccatggctatactggttttccattcgttcatcagttgatggacctttaggttagtttccactttttagctattatgaaaaatgctgctgtgaacattcacttacaggttattatgtggacacgggtttttatttccctgccattggactttatcctcagagttaattgggcagatttcagcacttgtcttgctcatgctattctttctgccttctcagtttctgttcatctagcctcattcattcagacctggcagacaatttttttgttttcatgaagctttctctgactgttctgtcattgaccttatgtgttagcaatcgttgtctagtctgtgctgaaaaacttagtccttaattttacatggcttttatttttttatggaagataattttctctcattataaatttgcttaatgggggaataatatataatgtgtatgccacctatccttgcatacattgaaaatattttagcttagaagtttgtagcatacaattcaatcatttataccataccaattatttcttctttgagaccttgacacagtaaggttatattctaaatatatttttagcaattaaatatcaaatctaacccaattagtctaacacaggagatgcgttcaatcacgtgtttatgtttttctctctatgaaaaagaatataaattggccttttttcactatgcagccattactgtgtttctggactgctcccagtctgtcagctgaacagttctgggtgcagcttgtctgatgaaggatagcacagcccctcaatctgagtgctcagcagagtgcttgtgaaggcagcaccacagcaacagttgctcagagggaacggattcaggagccttgacttagcaatagagtccagggttttcagctcagtgtctttagcctgtctctgctggtcatgtcagttacgtactattccatccaggaggtgctatttacattgtagtacatacacagtcattgcctaatgagtcatacagagagaaaagtaagttataaattatgtcccccatttgctgcaactctcagtgttaagaatgattcagtgcagctataggagactacttccattggcatgccacctgcgtaaatacacaattttgttaagatatacaataaaattattatgctaatagcaaatattttatgtagctcactatgttccatgtagtcttctaagtgcttcatgttagtccccatttaaacacctggttttggaaggctgaggcaggaggattgcttgagcccaggagtttgagaccagccagagcaatatagtgagactctgtctctaaaaaaaaaaaaaaaaatttttttaaacacttagctgaggcatggtggtgcatgcctgtagtcccagctacattgggaggctgtggtaggagggttgtttgagcttggaatattgaggctgcagtgagcagtgatcaagccactgcactccagcctaggtagcagagggagactctgtctcataaataaatcatgttgtatagattcccatagaagtgagttagacatcaggcatagaattattagccgctttgatgtctgccttgggagtaaaacacataataaggggcagctttaaaccatctcaatcaatagcctctaacttctccagaaggttcttatttcatgaatttctaagcaagggactacctggattaagacatttggtagacaccattttgagatgaagaatcttgaatgggaagaagggagatctctacttactgaagcttcccgatgacatagttgagtgtcccccaaaaggaactttagaacaagatgttcatcatgccatatctctatggaaaaggaaattatttaaaagaaaacaaaggcaaacaattgataatctgattctcatgggaaagttttcattatcaaagaaaaagagggctgggttccatggctcacatctgtaatcccaacactttgggaggctgagaggggtggattacctgaggtcaggagttcaaaaacagcctggccaacccaacatggtgaaaccctgtctctactgaaaatacaaaaattagccaggcgtggtggtgtgcacctgtagtcccagctacttgccaggcagaggcaggagaatcacttgaacccaggaggtagaagttgcagtaagctgagatggcaccactgcactccagcctggatgacacagtgtgactccatctcaaaaaaagaaaaggacaaagtatattggtccaaaaaagaagaaagaatgaaaaaaaggacaaagtatactggttagtatcgtaacagtgagatagtccccctttgagattagaaaataacagtatactcaaagtaacatcaataagaaccaacataaaatagacaagattcactatctacaaaagtaatctgcaccaagtagcaatgtatgagcatgtggtggagaatattgtctataatatgtgtactagaaggaagagacctcaagaaaaaggtcagagctggaaatgtagattagggaatctaggtcaaagttttgagattttaggagtcctgagagaatttaaaaagcgaaatagccaccgggcgtggtggccacacccataatcccagcactttgggaggccaaggcaggcagatcatgaggtcaggagttcaagaccagtctgaccaacatagtgaaaccccgtctctactaagaatacaaaaaattagctgggtgtggtagcacatgcctgtaatcctagctacttgggaggctgaggcaggagaatcgcttgaatccaggaggtggaggttgtggtgagccgagatcatgccactgcactccaacctgggtgacagtgggagactccatctcaaaacaaaaaacaaaaacaaaacaaaaaaccagaaaaggatagggctgaagaacagaggttgctgcatttagaaaggaggcggggtcagaggaatagaaagggatagggctgaagaacagaggtcactgcatttagaaaggaagtggggtcagaggagcagagggagcatttggtcactgctctgctgagtaaagcaggataaagtccttcatgaccgttggacttttttattggaattattaaaaatcagatttcaatataaaaaacacaataattgatgaaaaaagatttctgaatgaaaccatgtgtcatagagtccaatggaaggggagaaacaggataatagaaaagccacaaaaagtagacgaaagttgtttttgtttattgtagaaaaaaataaactttatttaaagagaaatggttaagagaaagggaaaaactgaaacctgtgggtgaatacttagaatgacagtatttagctcagcctgaagacagatgaggatgaaaaatgtaatgggaactagataagagttttctaaaatttgtcttagtaagatgtaatttaagagaacttggaatatcttaaactgttaaaaacaatatttctagagcatctttaaaaactaaaatgtaaatataactactctttttttttttaactaacccttagtattttgtgtgtaaaaaccctcatttgtaacaaacattgttggcagtttaaatttcagaaaagataatgatgaaaatttgaatcatttttagcagttttaagaaaagtgactattattgaaatctgaccttattggcatcaggtttataaaatacactttatacacctgcataaatacgtattactaatccacttatgagaaataatatttttgagataaaagagggtctccagattttacaaaaataattttaaacactttttttaagcctaaaaaagaaaatgaagaattaagaaaactttttgagttaatatcatcactgaagtataatgtgaatcgaataagaaagaaaaatgatgaattagaagaagaggcaactgggtatggttttcatattgtagaacatgttagccatttattaattgatttaactctaattttacttgactaaaacctagatacaaattcattttatgtttgcattttcataattaaatgaattctgttttaaaatgtatttcagaaactcacagcacaactttttagacgtgtgtcatgggggtgggagtcagctgagctgctggggcaaggtgaaattttttttgaatgccaaaatattctttttttttttttttttttttttgagaaaaagtctggctttgtttcccagactggagtacaatggcgcggtcttggctcactgcaacctatgcctccaagcaattttcctgcctcagcctcctgagtagctggcattacaggcatgtgccaccacacccggctaatttttgtatttttattagagacggggttttgccaagttggtcaggctggtctcgaattcctgacctcgtgatctgcccgcttcggcctcccaaagtgacatgagccaccatgcccagccacttattctttaatgattttgaaaacaatgaccacgccttggacatataatgtccagtgcactcttcattatctggtttgaatttttatttctgaagatattttttgctgtctgtggtcattttttcttccttttgtagtatcctctgctgcattcaaattgtttaaagaagacctgtttgtgtcattctttaacatcaaatttatcttgatatgtagcttatattttgtttctgctttttcttttagatataaaacgtggaaatttactcattgtacatgagtacctctgttgtatacatgaagtatacatgttattaaacttgttttacataaataaatttcatatatataaaaatatacgtataacttaaagaaaaagtaaaatgaacattcatgttttgatcacagattttttttaaaacaatggaatctgtctttgaaaccctgaacacagctacttttctatttatttactgagcacttaatttggttttctgattagaatcaacatttttctgtcattgcttttctctacatggttttgtatctctttcattttgttgacattatgtcagcaaagatgtctagatctcttcttcaaagtctttaaatcgtcacacatctctctgcccctttccttttttctaaaactgcctgtatcctttttctcctcaactcagatattaaagatgttttcttctctttttctacattgaatgatctccttgatgctttttgtgtgtacttttttttcttctgatagactgtggtcagtgggtatcaaaatgtacttttgtgtctttttaaatgtatgtgttttacttttttatcttggttactcatctctgggttatggcttatatttagtaatacgttattttacttagcataccaacatggatatcagtagtttatttacaaaaagtgtatggttaggccaggtgtggtggctcacacctgtaatcccagcactttgggaggccaatgtgggtggatcatttgaggtcaagagttcaagaccagtctgaccagtgaaaccccgtctctactaaaaatacaaaatgagccaggcgtggtggtacacacctgtaatcccagccacttgggaggctgagacaggtgaatcacttgagtccaggaggcagaggttgcagtgagctgagaccacaccactgcactttggcctgggcaacaagagtgaaattccatctcaaaacaaaacaaaaaacaaaacaaaaacactgtatggctataatatcactttacctgccatatatgccataaaattgttcttcatattatttatctaagattataatttcatatagaatgctttcaaactatgttcagttgaaactgaaagtaacatagtttatagatttgtttctttgatatgccataacagatgtttaaacaattattaaatatttactcttaaaaatacttgacttactaattctgtacatttctgcagatataagaaactcctggaaatgacaataaatatgttaaatgtatttggaaatgaagactttgattgccatggagacttaaaaacagatcaactgaaaatggatattctgattaagaagctaaaacagaaggtaatttaaaaaaattattttatcttaaggtctagattacatgtgtgagacgtgcaggtttgttatataggtaaacgtgtgtcatgttggtttgctgcacctatcaatccatcacctagatattaagccctgcaggcattagctattgatcttgatgctctccctcctgatcctaataggccccagtgtttgttgttcccctccccgagtccatgtgttctcatcattcagctctcacttctaagtgagaagatgcagtgtttgtttttttcttcctgcattagtttgctgaagatatcagctttgagctcatccatatccctgcaaaaagcatgatctcattcatttttatggctccatagtattccatggtgtatatgtaccacattttctttatcccgtctatcactgatggacatctgggttgattccatggctttactgttgtgaatagtgctgcaatgaacatacaaatgcatgtatctttataatagaataatttatattccaacgtatggtaattttaaatcagttttggtattaaaaatcatgtaattttggaaaatattgataatggaaaaacccaaattctgccaaaatatgttgagaaaatagagggtaaatatatcttttcagactttgaatgcctcaggctcttagttaatcttccccagatctgggaagacctagaaggggagagattgggctacattaatgaggaccatttcaatctcttggccctgcagcagccatttcaaaatatgacaaaaaatatattttggggtaaaatattttgatttccttcagcttcttctctctgtgatgctgcaccagaatcaggttagaaaggaagccacattataagagttaataaaacccatctgatgagatttgatagtttgaagggtgtgattcccagaccctttagatagaaattggggccaaggaaaacaaggtcttattcctcaatataaatctgtcagtgctttaagcagtgaaagatttttcatttaattttacagacttgaaactaatgaaaaggatagcttttaaaatatcaatctctttttctatgaaaaggacatgctgttgattctcttaggccttgaaccctggccagtgatctgaaaccaagcagtacctgtctccagatcactactaccaaaatcactagtaccaaattaatttggggtggggggtaacaggtttattgagaaataatgaacacaccatgcaattcactcatttaaaatatacaatttattaacttcagtattttcagagagttatgcagtcatcattacaatcaattgtagaacattttcatcaccctaaaaacaaaccccacatcatttagctatcttcactagttttcccttcctccctcagccctaggtaaccacccaccttctttgtatagatttgcctataagcctctgaaatgaaaagcaagtggtctactgtgactggcttatttcacttagcataattttccatgctgcatctgtgctgcagcaggtattgatgcagggtttttgctccttagttcagctcaatctggtttcttctctcatgaccaggaaaaattaagcacacagacacattgaagggtgaggaggacagaatttattaagtgaaaggaaagctctcagcaaagaggggcgtcctgcaaacaggtttccacctcacaattgaataccaggagcacaggagctgaagcggccaggctcctgctctgcataaggcgtgaattcctggtgactccaccccatccccccagtgcttgtgggcctcgggtctgctgccggcatgtccaggcaagacaagtccaggttcccttatctgcacataacgtctggtgtaaacacttgtgaggcttgttggggattctccggggacccttccttatctgcctaggcattttgctgtctcctcctaatacagtatcagtacttagtttcttcttattgctgagtgatattccattgtatggatacatcaaacagtttatttatccattcaccaggtgatggacctttgggttctttcccacccaaaggtgatggacattttggttctttccacttttcactcttattaataatgctgctgtaaacatttacgtatgagtttttgtgcttgcatatgtttttgattttctggagtatatactcatgactggaatttctgggtcatatggtaacttcatgcttaaccttttgaggagctgccagtttgttttccaaagtggctgcaccactttacatccccagcagcattggataagggctttaatttctttacatttttcctaacacttattttctcttttttattgaataaaggtttcatcctgtggtgtgaagtgataccacacgtggttttgatttactttttcctaatgactaattacattaagcatctattaatgtgcttattatccatctttatatcttctttgcaaatatatctattcaaaatctttgcccattttttaaattgggttatcttgttatttatgaattgcaaaggttctttatatatcctacatatgtaagtcccttatcagatacatgcttttcaaatactttcttctactcagtatcttaccttttcacttcttgatactgtcttctcaagcacagcagttttcaattttgaagttcattgaatccatttttcctttggagtcatagctaagaaaacactgccaaatgcagtcacaaagatttatgccagggttttcttcgtactttatttattttttgcatgtggatatccagttgtcgcagcaccatttgttgaaaagactattcttttcccattctgttcttttgttaaccttgtataaaatcaattgactgtaaatgtgcaggtttatttgtagattatcaattcttagtttgtttatatctattcttatgccaaggccaaattgaatttaatgagaagattttttcaagcatgttgcatattaccagttgtcttatatcataataaaaattaaatttagtggaatatctttaacttcaccttttgtgcctcaaaggaatctctggccagcttataccttacttactctaagacatgatggcaagtcaggcttacaagacactctttctttttttctctattcaaacctttagtctcttttccattgcctccctctatagttatattttcagtaagttttcatcacaggatctgctgatgtagtctaatatttagtgtattatgttttgctaactcattataattcatagaatcttccatagatgtttaccatccaggaaggagaagtctgagctgccagctttcctcagtggaaatcatgtgaagtcatcatgttgtagttcgcagatcctctttccacctggtagctggttctcttgggtagctctgcatctaatcctttacttggtgcagatcttgcattctcagaaaccacagttccctgtattgacctccttttactgaaacagagatgcacagctctgctttctagctcagtagaggattcttgggatataaagtttaactcattccaagaaaaagtcttaggagtgcagcacttcaaaatcaggtaatgttcaggcaatttatcagagacaaatagtagattagtattttgacttttgaaatttcggagccaagttgtgtgctgtagagaagcattgtggtataatacagagatgggatggtcttaacttctccatacaaacaagcttgaagtaagataaaggagaaattgcatttgatgtcttaacactcaaagcatattgtgcttattttacttctgtgaagactaaaaatcattccataatgttctccttatttcctcattgagaaaaggaaaatgaaaattgaatactagattgattaataaatactcaaagcttattcttttagaattttcattaactgaaatcaggcaaatgtctgattttggttatctaaccaagtatttctagttgtttttcaaatcatacttcttctttctttgcagtcttatttcctaacttgaggggaaattgtaaggagacacccttgccttgttatcagagttcataattgaagggggttttaggaaatgttcctcctcagcagcttatgtctctctcctggttatctactgcttctcaataatgtttgccatcaataaattaatctcaacatttattagatcctactttaaaggagactcttttctctgcataagttatgtttcctgttgtctctttttaaaacttatttttctaacaattatccaggtttttgtggcttaaaagaaaaacatttattttgttcatgaacctatggtttgaaaaaagcttagccaggacaggtcatctctgctcccctcagcttccctaggaatagctgatcagttggggaaatggaatcctctgaagctttgctcacccatgtgtttgatggttgatgctggccattggctggaaccttggttggagcaggcagcatgaatattgacactgacactcccaggctgtctctctggcctgatctcactcacaatctgggggctgagttcaaagggaaagcagtctgagatagggaagccacatgatatcccttttactgcattctattcattagaaggaagtcagtaaggattgcccatattctgtttttttaatgggataaatatagcttctcttttgttttaattgacatgtatatacataattttggccaatagagtgatattttgatacatgtatatagtgtgtaatgatcgagctaactagcacatttactacttcaaccatttttcattttttgaattgtgaacattcaaaatcttctgcctttttaaaaatatacaataaatcatagttaaccatattcaccctacaatgccacagaacaccagaactcattcctcttatctaactgtaattcggtatccattaaccatcctcccctcccctacctctgtgagcttttttgttgttgttaagagacagggccttgctagtccagtctgggctctgggcatctgtagtcacccagactagagacagtggcttgatcatagctcactgcagcctcaaactcttgggctcatgtgatcctctgacctcaccctcctgagcagctaggattatgggcatgcaccattgcacctgtctgatttttgactttgtagagctatctacctatgttgtccagggtgctctggaactttggcctcaagtgattctcctgccttggtctttcaaagtgctaggaaattacaggcaatagccatgttgcccagccctcagtttttctttagctcccacatatgagtgagaatgtgcagtgtttatctttctgtgtctgcacttaacataccatccctcagactgatccacatggccacgaataacaggattgaattcctttatacggtgaatagtattctactgtgtttgtgtgccacagttttttgtccattcatttggttatggacatgcaggttgattccatacatcagctattgtgaatagtgctacaataaacatacgagtacaggtatctttttgatctattgttttcttttctattgcctgaatacccaatagtgggtttgccggatcccttggcagtcccattattagctttttgagaaaacctcatgttgttttctatagtggctgcactaatttaccttcccaccaacagcatgttagagtttactgttctctggaacctcaccagcatatgttatttttttgtcttttcaatgatagcaatttattcaaattgaagcaagattgtatcacattgaagatttgatttttatttccctgaggattagtgatactgagcgtttttaaatttatttattggctatttgtatttcttttttctaaagaaaagtatagttagatattttgcccaattttgaacccagatttttttttactgtcaagttttttgagtttcttgtatattttggatactagtcccttattagatgaatagttgacaatattttctcccattccactggttttctcttcactcagtttgctgggcagaagctctttatcttaatgtaataccatttgtctatcatttggtttttgcctatgcttctgatgtcttacccataaaaatctttgtgcagactaatgtcctcaagcatttttcctccatttacttagagtggtttcataattttaggccttaaatgtcagtcttcaatcaattctgagtttatttcattatgtgctgttacataggaagctagtatcattcttctccatatggatatttagttttcccagtgccattcatttgaagagactgtccttcccccagtgtatgttcttggcacctttgtccaaaatcagttggctgtaaatatgtggatttatttctgggtgtgtattctatggcctttaccccaagaatcattacttcgtaaaatgcaattcaaattagcatgaaacatttgcagtttaaggaaaggcttatggcatcagaatccttatttacaggattcattattttgtgtttttttgagatatggtctttgtctgtcatccaggcagaagtgcggtgatgtggtcataattcactgcagccctgaactctgggtacaagccatccttttgcctcagtctcccaactagctgggtctagaggcatgagccaccatgccaagctaatttaaaaaaaaaattttgtagacatgggggtctcactatgttgctctggctgatctcaaattctggcctcaagtgatcattctggcacaggcttttaaattgctacaattacaggaatgagccaccatgcctagtatagagtgttatattattttcaaagtcttattctgagagccatttattgactttggcctaaataactcaatatgatatctctgaaacttttttttgacatattatggggaatgataatgagggaaggtggttagacactttttactaagagataacttagtgccatctaaggaggaacaaaaatgaattatcagaaaaataaaagtaagatgaagtgcaaaagttctgtggcaaagatgatgatagcaaataatatatttttgtgactcatggtagctttaactttgttcttaaaattctgagtaatttaagggttcacatttgaagaatccactgcattacggataacattttattgcaagtaaatgcatttcaaaatttgctattggttttgtattagattattctcagcctacttcattatcaagctatattattttattcatgcagtttgatgatcttacggcagagaaggaagctttatcttcaaaatgtgtcaatttggctaaagacaatcaagttcttcaacaggagtttttatctatgaaaaaagtacaacagcaatgtgagaaacttgaggaggataaaaagatgttgaaagaagaaatattaaatcttaagacacatatggaaaacaatagggtagaacttagtaaactacaagaatataaattggagctagatgaaaaggcagtgcaggcagtagaaaaattagaagaaatccatttacaggttagttttttaaatcaggtaagtttatctgtaatgtgctttcatttatttcaccgcaaattatattttggatatgtatatattatgtttcctctgcctctcttgtagcaatttgctttgtagagttctagaaaaaaaatggcatctgttttttcttttaaatatttacatttccattattattataacaaaatcaatctttcagagtaatgattctcactgtggagtcatttgatgattaagatcagttggcataagaaacaattgtgatttcaaaattatgtgatacttttgaattggtcttaagctacattgttcattaatcactttttaaaattatgaatggattctattactttttatatgaccagattacattaatactaacataattatgatttcaaatttttataaatcagacaattctgaattcagttattagttttgatcttgctgataaatattttaagcttcagcctcttttactaacatattcacaattgctctttgaatcactgactcaaaatgaaaggcaacaaacatataataattaggttataattgttttaaaagtgtattcttttcctttgttttaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaagtaagtcaaaacatacactcatagaaaatgaattaagctcattaatttgttttgaaagcataatttttagtgagatggcttcaggagattagtaggaagtgaatgctaatctaataatgtaatttcagaaaataatgttagtaaataatcttacctttaaaatgttagtcaaggatagtttctgtcccatttctttctctctctctctctttttttttttgcttttgtatggcttttttcccctgaaaagtctcatgtagttaacctgatctgttagtttttgtcactaagtactttcgaagctttataattaataatgtgatcttgttataaaattgcttgtcagaattttcctaaatagaaatattaatgagtttaatttattttttggtagatcacaacctaaacccaaagtttcaagtggtactgctactccgggcacaatcatttttgattgtgatctttagtattatcactagagcgtgcctcaagaaagactatttgtgtaacattttcaagatgttacagaaaggcatccttgtgaaatagggaataattatcaaggaatttaaagaagtgtaattcacaaagtggttaaaacataactagaaataccatttgacccagcaatcccattactgggtgtatacccaaaggattataaaccatgctgctataaagacacatgcacacgtatgtttattgcagcactattcacaatagcaaagacttggaagcaacacaaatatccaacaatgatagactggattaaggaaatgtcgcacatatacaccatggaatactatgcagccataacaaataatgagttcatgtcctttgtagggacatggatggagctggaaaccatcattctcagcaaactatcgcaaggacaaaaaaccaaacactgtatgttctcactcataggtgggaattgaacaatgagaacacatggacacaggaaggggggaacatcacacaccggggcctgtcgtggggtggggggatgggggagggataacatttggagatatacctaatgttaaatgatgagttactgggtgcagcacaccaacatggcacaggtatacatatgtaactaacctgcacgttgtgcacatgtaccctaaaacttaaagtataaaaaaaaaaaaacttgttcagcctgaaggggtgtgtggaaggcagaaggaaaaagccccacctccagtgccttggtcacagtgctgggcgctaattgccttcagacatgctttagttctttttgatcaccaaccagccaatctagttctcccccaggagttgttgttctgaattattcctcagtgccaaatgcttaattgttcctagataatgggtgaaatgcacaagggtgaaacctaaaatttgtttgctaaacacaagtattcctaaatttttttgttgttgttcattttagttttcttaacctacattaaggagtacaacatgatgttttgatacaattatttctagtgaagtggttcttataatcaagcaaatcaacatattcttttctcacattgttaccctttaaatatgagtatttctaatggaatcttcagaatctcacaagtagagcccttttagaaggcagcaagtgttacctgtcaagccatatatcactgatagccatttctcttccctgtctactttgtttgtactgcttgttcagtataaatcaccttagaaacacaggtgcttctttagaatgattttaaaattatacttgcttacaacaggtatgctctcacacatcttcagtgtgaaaacactgtttagtggataatttggtttgctctcagggcaagtttttaaaaactgcaagtcattaagaatcattagaggaaaaatgaaatactaagcgtgtgtctttgctatctttacagatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcttagactgtggttagttacatgaccatttctcttttgggtttcatttctctaatataattcttgtttttaatttggtgaaatactgaattctgttgacttatgcatgttttgtaaagatcataattagctgtgttaacacagaaaggaaatgggaactttacattttttaattccctggagctctcattttcaagagatacccgtttactaactttattccataaatgtgactaaactgacacatttaaaatgtctttaaaagctgcatttaagttaggttttagaaattgcatattattgcctgataactgatgatatagtttgagatgctttggcttactctctaattgattatagtttagctgtggttcatactgcccccccttttttttaaattgagacagtgtttcactctattgcccaggctggagtgttgtggcaccatcttggctcactgcaacctccacctcccaggttcaagcgattttcctgcctcagcctcccaagtagctgagactacaggcacctgccattacacccagctaatgtttgtatttttagtagagacagggtttcaccatattggccaggctgttctcaaactcctgaccttgtgatctgcctgcctcagcctcccaaagtgctgggataacaggcatgagctaccacgtccagcccatgtcacttttaaagtttctttgcaccagccaggtgtggtggctcatgtctgtaatcccagcacttcgggaggctgaggcaggtgtgtcacaatgtcaggagttcaagaccagcctggccaagatggtgaaagtacaaaaagtagaaaaaaaaaattagccaggtgtggtggagagcacctgtaatcccagctactagggaggctgaggcagagaattgcttgaacccaggaggcggaggttgcagtgagccgagatcgtgccactgaactccagcctgagtgacagggtgagacttcatcttgaatataaaaaatttaaaaaaaagtttatttgcaccatctcaactcttcccacccataatcacaactgaatgattggcatccaaacagtttaccacatatagatgtttattatttagtagaatccaaaataattgcattttatgaattaaacaaaacactaaaatgttcatttccatttttatgttcaaagctttgtgcttggccaggtgccgtggctcacacttacaatcccaacattttgggaggccgaggcaggtggatcacctgaggtcaggagtttgagaccagcctggccaacatgatgaaacccatctctactaaaaatacaaaaattagcaaggcatgttggcaggcatgtgtaatctcagatacttgggaggctgaggcgggagagtcacttgaacccgggagacagaggttgcagtgaaccaagatcataccactgcactatatggagactctgtctcaaaaaaaaaaaaaaaaggtttgtgcttttcttacataagagtacatcctctgactataaaaatcctggaagaaaacctaggaaatactcttctggacttcatacttctcaattaatttatggcaaagtcctcaaaagcaattgcaagaataacaaaaattgacaagtatgatctaattaagctaaagagcgtctgcacagcatgagaaactatcacaggattaaacagacagcgtagagaatggaagaaaatattcacaaactatggatacagcaaacgcctattatccagaatccataagagatctaaacaaatcaacaagcaaaaaataaataacaccattaaaaatgggcaaaggacgtgaacagacacttctcaaaataacacatgtaagtggccaacaaacatattaacaaatgcttaccattgttaatcatcagaaaagtgccaaacaaaacatcagtgagatactatttcacaccagtcagaataacttttgttgaaaagtaaaaagaaaaaaaaaaagatgttggggaagcagtggagaaaagggaacacacaccgtttgtggcaatgtaaattaattcagctactatggagagcagtttggaaattaagaactaaggatgaccgttggatgcagcaatcccattactatactaggggtatacctaaaggacaataaatcattgtaataaaaagatgcttgcacatgtgtgttcattgcagcactattcaaagcagcaaagacatggagtcaatccaggtgcatccaaggcagattgaaaatccaaggtagattggaatgttccatacataccatggaatactatgcagccaagaaaagaacaaaatcatgtcctttgcagcaacatggatacagctggaatccactatcctaagcaaactaacacagaaacagaaaccaaatatctcatgttttcacttatgtgggagctacacattgggtgcacattgtcataaacctgggaacaatagacactgggaaataagaacagggagggacagagtgggccagggttggaaaactacttattgggtcctatgcttactacctgtgtgatgggttccactgtactctaaaccttggcatccctcaatattctcttggaagaagcctacacaggtaccaccttaatttagaatacaaactagaaaaaaacaaacaaaaaaaaaaacaagaaaaatttactattaaaaaagtttactataagtagagaatagaaatttctttttaagataaaatttattgatgtaaaaaaattggattaaacttgtataaagggcagagttttgctaagaatttcaaagcaatgcattcattgaaaagatgactttaattatttaatttttttttttttttgagacaaggtctcactgtatcaccaggctggagtgcagtggtgcaatcttggctcactgcaacctccacctcctggcttcaagcaattctcctgccttagcctcctgagtagctgggactacaagtgtgcaccaccatgcccagctaatttttgtatttttaatagagacagagtttccccatgttggccaggatggtctcgatctcctgacctcatgatctgcctgccttggcctccccaagtgctgggattacaggcatgagtcaccacacctggccattgtttaacctttgtactaataaaacactacctttctaaaatcatgtatatgcagtagaccaatattaactgtatttttgtctgattactctaaacagcattacacaggtgcatcctctgttatctaaacttaaaataagtagaaattttactttatttatgtgattatttttctatttaagcaaacttcaagttatgtctagtcactaaaaatactaaaggtcacattttgtaagtgatacattatttgcatgataatgtttcttgtttaacttaaacattattattatttttacttattttagatggagctggactgtgtagaacaaataactagagaaacaaagagaagtatgttgccaaaatttattaattacatttaggtttattttagaaattaagtgtaaataacaaatggcattccttttcattgtttggttagtagatactatgtcaagtattttttttcttacacacatctaatgcaagatgtgaaaacaaaaactttcacagagaagactgtacttatgcaccataaattcatcatgttccatagcttaaaaaattcccaagaagtctgtgcatctgttttttactggctctacactttcttaagttttgccatcatcatggaactgtcagccagcacactgaaacgattctcagaaaacaaaggcatcaccaagttctcagggttttggtacagattgaaggccaacagacctcagactcattttgaaattcttagctgggcaataacccttcataagcagtcacttgacaggtgacattttaaatctcctatcatatactgtgtcattggcttacatctgttctcaggaaaagttccaaatttttcaccatgaaataaaaacacccacgtcaatgtgattcttgtcaagttactcagccttgttttttgccacttaccgcactctaccctttgctctagcaccaaagtggaggagagtagaactccgcagggctcttcctcacctcaggctctttgccttcgcctcttccctctatctggcaagcttttccttgtccttcaggtatcaacctatgttatctcctccaccagaaagcccatgatattgacataaaagtgggatagatgtcccttttgtgtgttccagtagtgccctgctgtatacctgtcatggtatctatgacactatgtggacattgcctacctgtctgtgtttttaggttatagcatatgactattgggaggtggaccatgccatcttcatcttggaattccagtgctggttctagtaccttagcacgtggctgttgattacatgaatgaagaatgaaaaacctctaatatttaaacacaatagaattaatgccatgtgtaaattatttaatagtaattttgtattgtaaatgtacatagatatttctcattcttactaactctgataaagttctcaactctttagtatttaaactcacatttagttaactgaagtgttttaggtaaagaacataattctttctctttccagttgttgctgtgttgaacacttgctcccgtctacttacttctctataatccactggtaagccacatctaatgaagagaatgtttaaccataaagtcttaaggaaaaattttattatttaaaagattataaaactttattactgggctgtttacacaacattttaattgtttctcataaaatatataacattacaatctttactgaagtaggatgtttttgtatcacatgtgtgatgataatttatagggtaatttaaatgatgttttttagcctccttaagttttaagtggatcttgcaaatgaacaccagtattattgagtttgacgtactcaaattgcccaaatgccagctgtttaaacagccaaagaacgaagtcatcattgatactttagtaaaggtcatcgaaggcttctttgcattttacagcttttactacttaggggagttaaggagtacctgccaggcttgtgcatgctaatgtgacaattttctttttgtagttgaaccgtattttgtggggagatactttgaggctctgtaaatatccagttactcccagaacccactagatttagcatttcatggatgacttgtgtttgaacaattattactatgatggttgccagatgattattttcttctcttctttgctgtacctggagaagtaaaaccaataaataactgagaagggaaagctcatgattctggtgctccaattccccaagattaggccagtggtagacatttcaagctgacttcttgtcttttttatttgtcttcgttactctgtcagcacttttttagtttcaggaacaagatgttctaagctaatgttgtattttctctgctccagccatggaatgagtgatttttcttagaagcagaggtggagccactgaggaagcacaggcgagccctccccagcacgtgctcactggtccccaacagaacaaccgctgccgcatccatgaggtaccaagaaactagcaaagggccttctggctgtctgggcacagtcctcatgtggtccctggctcagcctcaagggtcctgcattagtcttcctgtagcctctgtgctgtgtctgtagatcgggactctgtgggaagggccctgggatgcccaacagcacaagatgtctcatctgccaaatgtccctgccttcctcccactctgacactcaggaataggctacatggcatgtccaggcagtgccaggccacctcactatctcctttgagattggcccagagggcttttggggtgagtgtggagctgggcacctggagcctgaggccagctgtctctccctctgtcttggaggaaaagccatgtcccaaaaaaaaccccagggcctgacctctggacacacatacagggagggagggtctgtgggctgaggggggcattgtaatgagactttgagcacgctgctcaggggcctggtcagtggaccatgctcagagatgacctggtcattaggacctagtcagttgggacctggttagtggtggcctcctcagtaaaggcctcctcagtggggacctggtgacctagtcattggaagcccggttcatggggacctggtcactgatggtcttcttagtgaggcctgatgggctggaacataaacaatgaaaaactggtggggcctatgcagtatactaggggcctggtcagtgtggggccttagtggcttggagcctcgtcagtgagggtctggtcagagggggctcggtcagctggggactgatccatggaaaattgtttagtgggggtcaggtgagcagcgacctggtcaactgtggtcttgtcagtgggaacctggtcagtggggaccaggtcagtgggaaattggtcagtgaggtctggcctatgaggcctattaagtgtgagcctggttaggaagacatggtcagtggggacttggtcagtgggaactggtaaatggaggagtggtcattagaggcctcatcagtgggaaactggtcctgggcggctggtcagtaggaacctggccagctggccactgtgtgacctcaggcagggggtttgtctgtggagtctccttgcctccatctgcagggaaggtgagtcagggcaccttggagggtggctggaaagagaaggtgagaagatgtgttgaatccagcaccacttggcagacctacaactttacacatgacctgtgtgccacctagagggggtcccagccctctctgctgtgcctggtgcccctcctctctctgcatccccaggaccaccatgggtggggaaggcagagattggggagcacctgtagaagctctaatgctggccatgagccctcggtgatgacctgggtgcacctgtgagtggagaagctaggcctggccagagaagcaagagaaacacacacacacatatgtgcacacacacacacaggcacacacgcatgcacaaacacactgcatccacacatgtcagttcaggggatagaggacactgactctgggcgctgttgacccatgcaggctcccattgtggtgggttgtgtcaccccacaatgtcactgttgctgagcccccatcgcctctgtgttgtggagcagttagagacacactgtggtgtctgagtggctctgcgtgaaggaccgttttctaggtgagaggcacatctcaacacagctgactgatcagactcaggtgagtgggacctgctctcttctcttgctcctagcttggggacagtcgctatcagttgggtggttttggcctctgagcagctactgagggtaatccctgaacactcaccggatgcctattctgtgctgacagtcatctcgttcatcctcgcagcaattccattctgcatcttttctgatcacccccgtgattacccaggacaaccccatcaggccctctcacccaggcccagtccagctccatgataacaaagacgcaggtccagagacaactgccctgcatggtgcctgcatctgaccccccttggtgggtagtgaccagcacgacatggaagaagccagggcagcatgcagccagctgccctgcagccccagatggctcctaggccttgggaagtcattctcaaaggggaagctggtcattttgaggtccctggagggaagggtgaatgtgtcatcccaacagccctggaagccagcagcatgccatacatcttacccaacctgtgtgacagaggccccctcctggggcacaagtcccatacctaaagggtcctgtcctagttgaacctcatcctgagccctgggaggggaggagcaccatgggcctccctgcagcagccaggattaccacccaggggactcagccttctgtggccctggccagagttagaatttggcccaagacaagacaagctcactcggagcagcttgtcagtacccggggcctgtgcatgccaagtaagtccaagctggctcaaagagcaaccagccacctctgcaagggtgtgccaggagcaggtggaccagccaccaacctcacccactcaaggaaacagggatggccaggttcccacaccctgagtgaccaccacctgacagctgatgaagtggaggcctgaggaaaagcagatggcactggggccctacctccagggcagaataactgatttaccccgattggcagcaagtgaggttggtggctggtccacctgctcctggtacacccttgcagaggtggctggttgctctttgagccaacttggccttgcctggcatgcacaagcctcagttcaacaactgtgctgcaaatggagccacatagaggaaatgagcagcagcctcaggagcagggtttgcgctgcctttggggctccaatccatgcatcagggctcctacagcactgtgggcttcttgggtgccaagaggcagaccacaggccctcttgaggaggattctatgttcaagtgcagaaagggcccaatctggtggatgaaccacatggccagcttctgggtgcaggcacagtgccacatcttccatcacttcctgatgtgccacaccagcactgaagagacagcctggagacagggcaagaggaaggctgagaaggatgagatggtgagtgccagattctccctggctctgagcccacctccagggtgacactcaaactttaggagtgggagagcaagattgacagcttcaaatgcttcaccaagaagatgaacaacagggcactcggctcaacttcacagccaatgagttgacatgcaagcaggtgatggtgacaggctttaagaaggagcatcagaaggctgccagttcttcagcctcagccaggccttggagctggaccagcccatccacttcaccacagatgccttcaacactgtcagtgagctctttgccaatcatcccaggcagaacctggacccagtcatggacctgttagtgctgtctcagggacaccagaccaacatcctgaacatcatccacatacacaagcaagttcttaccaaagtcgcggaggacaggcaacatgtggcagaagggaagatagagatgcagaggctgatgacaccagaatcacaggaacaggaattctttcaccacttcagtggaaattcaccacttccatccaatttgaatgagagacatgaaatcacagatgcagcatttcttgcaacaagagatactattttttcaaaaatcatccaggaattgataatgttgaatgactagatatttgattgtggactgtttccagttcaaggatactttctacacagaataataacactagcaaggagctagtgccagctatccgtggtagcacaaggatggttttgtgctcaactgaaatccagctgaatacagaattgtgtaggaaacagttaatatgttgacagaatagaaacagtagcaaacatgaactaaatcatgccatgaatgcctaaactaccattgggacttttggaagaatgataataccactttactgctctttgaagtatgaatattttagtgtatatgctgtagaccacaaaccctataaagagtcccaaataagttggctggataaagcctgctgtgcatgtctttatactcaaagactgatgatgcaattcgaatatgtgtccccaccaaatctcatatttaattatatttcctaatgtggaaggtggatcctggtataaggcaattgatttatgaaggcaaatttctcatgaatggttcagcaccatccccttgtaccatcctcacaatcatgagtgacttctcgtgagatctggccactgaaaactatgtcacctccctactctgcgtgttttcctcttgccatgtgagacaactcactctttctttgccttgtacaaagattgaaagatttctgaggcctcccagaatcagaagccctgtgcttcctgtccaccctgcagaaccatgagccaattaaacctctttttcaaaatgaatcaaacagaaaatggcaaatgacgattgcagcattgctataaagatacctgaaaatgtggaagcagctttggaactaggtaatgggcagaggttggaagagtttggaagtctcaaaagaagacagatgagaaaatttttggactatcttagagactggttaaatggttgtgataaaaatcctggcacaaacatggatagtgaaggccaggctgaggaggtctcagatagaaataagaagctttctggaaaaggtcttccttttgaatatggaaagcttacacaatgcctgtaccatcattatacgttagaagctgtgagcttgctttttaattcagaggctcataggaaaaagagaccgtagccttgactcagatgagattttggactttgtaagtttgagttaatgctgaaatgagttaagactcattctggcaaggcatgattgtattttgcaatgtgagaaggacatgatattcatgggatcagggacagaataatatggtttgtctctgtgtccgtatcaaaacccatgtggaattatactccctaatgttagaggtggggcctaggtggaaaaagatttagttataaaagggtgcgggtaggttctccacgaatgataaaggaccatcaccttgatgctgtcctcctgatagcgagtgagttctcatgagatctggttgtttaaaaggctgtggaacctctttcctcactctgtcttcctcctactcctgccttaggaggtatctcattgtcttggcttttggtataattaggaggcttcttgattcctcccagaaacggaagacactatgcttccttcacagcttgcaaaaccatgattcaattaaacctctttcatttacaataatagagaaaattagaactgccgagagagctgtgcatgtcttcaaggccttttttccctttgtcttggctattagcacagggcttctttatatgcaaatttctgaagtcttcttgaatttttccccttaaatggggttttgtgttattgctacatagccaacctgctatagagatacctgaaaaagtagaagcaggctcagtagtgggtagcaaacaaagattgggagggtttggagggattagagcatgacagaaagatgagggagagggaggaagtgatttaatcatggatgggcaggggtgggtgtggatggaaaaaggggtgggtagggtgggaatgagtaggctggctgtagggtggtgggagggtcgtgggtagtaggaagggggagtagcgtgctgcagaggcagagcctcatgtaaaaccattactagggcagtgcacctgtggctttgcaggtttgagcccccatggatgctctcatggactggactagtgttcagtgcctgtagcttttccacactgagggtgtaagctgttggtgggtctctaaatctggggtctgtagggtggtagccctgtgtgggggctccaagtccgtattttccttctgcactgccctagtagaggtttcccaagaactctgcgtctgcagcaggctgctgcctggaaacagtgggaggtgggggtgggaggcagatccttcaccaatggttaagcaacatcttcttgatgctgacctagtaacagtgagttcttatgagatctggttatataacaaggtgtggcacctctttcctctctcagtcttgcttctattccagccatatgaaacatctccttgccccttggccttctggtatggttgtgaggctccctgagacgtcccagaagcagaagccactctgcctcctttacagcctgctgaaccatgagccaattaaacctcttttctttatgatcatacagaaaattagtgctatgaagtggagctatgaagtgccttcaaggccctttccccttttcttggcaaccagcactcagcttcttttcatgcaaatatctggagccttcatgaattttgcccctgaaagtggacatttcttcttttaccacacggccaggttgtgataaagatagctgacaatgtagaaccaggttcagaagtgggtaaaagacagaggtcaggagagttgggaaagcttggaagacagcaagatgaggaaaatttgaccactgtagagaattgttaaatacttgcgatcagaaggctgacagaaggataaacactgaagtccagacttaaaaggtctcagatgaagattaggaatttcctgtgaacaggagccatggttacatttgattggccttagcaaagaacgtggctgcacggtgaccctgccctggacatctatgaaactatgaatttgggggtgatgatttaggatgtatctggtggaatgaacatctaggcagcctagcgaggtgtcctgtctgcattgaatagcctgtgttcttatgcgtgacctaagaaatgacttcaagttggaacttctattgaaatgagaagtggagacctaaagtttggaaaatctgcagcctggccaagtggtcaaaaagaaaagctgattttccgggggaaaattcaaggaggcttagagtatctgcataaaaagaagcccagtgcaaatagccaagacaatgggaaagaggcctcgaaggcatttcacagtcctctgcagcagcccttgctgtcacaggcccccatacagggaggcatcattctccaaaccccagattcatagacccacaaacagcttgcaccctcagtatggaaaagctacaggcactcaacaccagccctgtccatgacggcagctacaggggctgaacactgcaaagccataggtgcagatctgcccaaggcctaggaagaccagccctcatacccctgtgccatggatgtgggacagggattcaaaaaggatgattctggagctgtaggattgagtgactggcctgctgggttttggacatttatgtatcctatgaatcccatctgtgttttgtgcttctttccagcaatttttttttctattggttgagaatgcttacccattgcctgtacaatcattgtagcttggaagtagttaagttgttttataattcacagactcatggcagaagggactgtagacttgtctcagataagactttgggctttggatatttgagtaaatgctgtaatgagttaagatttgggggactgtagggaaggcatcattgtattttgcaatgtgagaaagacatgagatttgggggacccgggacagagtaatatgatttggctctgtacctctcccaaaactcatgtggaattttaatggggaatgttaaaggtgggggctgctggaaggtgatttaatcatggtggagagtggaggttggatgggagggatggggagagttggagggtattgagggggtggggagagttgggggggattgtgtttgggtttatgggtaaaaggcaggagtgggggtggatccttcacaaatgggtaaacaccatctccttaatgctgcccttctgagagtgagttctattcatgattttggagctgtgagattgaatgaacagtgtcctgctgggttttggatgtgcattgggcctgtggtcccacttgtgttatttttcttggaaatttcttccctttggattgagaaaacttacccaatacctgtaccatcattgtacctagaaagaaatgaatgcccttttaacttcagggcctcataggcagaagagactgtagcctgatctcagatgagacttttaacttttcacatttgagttagtgtggaaatgagttaaggcttttggaaacttttgaaaagatgtgattgtattttactgtgtgagaaggacatgggatttgggggggtcaaggtcagcataatatgatttggctgtgtgcctctagaaaaactcacatggaattgtaatcccaaatgttggaggtggggcctggtgggagattatttaatcatggatgggaggtgtgggggtggaagaaaaaaggggtgggtagggtggggaacagtatgctggctgtagggtggtcggagggtggtgggtagtaggaagggggagtagcctgctgcagaggtagaggctcatggaaaacctctaccagggcagtgcacctgtggctttgcaggctttagcccccatggctgcccttatgggctgggctggtattgagtgtctatcacttttccaaactgagggtgtgaactgttggtaggtctacgaatctggggtctagaggatggcggcttcctgcagagcgactcaaagcccttgttttccttctgcactgccacagaacaggatttccaagaggctctgcctctgcagcaggcttctgtctggaaacagtagggggtggaggtgtgttggggggtggatccttcaccaatggttaagcaccatcttcttgatgctgacttagtgatagtgagttctcatgagatctggttgtataacaggctgtggcacctctttcctctgtgagtcttgctcctactcctgccgtatgaaacatttcattgctgctttccttctggtatgattgggaggcttcctgagtcttcccagaagcagaagccaccatgctttctttacagcctgaagacccatgagccaatgaatccccttttcattatgaccacacagaaaataagtactgcaaagtggagctatgaaatatcttcaaggacttttccccattgtcttggctgttagcactgggcttctttttaatgcaaatatctgaagccttcttgaagtttcccctggtggagagtggaggttggatgtgtgggaaggggacagttggagggtattgggagggtggggagagttaggggggattgtgtttggggttacaggtgaaaggcaggagtgccaggctgcaacaaagatagctgaaaatgtaaagcggttcagaagtcggtaacaccagaagttggagagtttggagagcttgaaaaaagacaggaagatgagggaaagttgggaccattgtagagacttgttaaatagttttgattagaatgctgacagaaggaaggccagggaaggccaggcttacaaggtctcagatgaaaatgaggaacttactgggaacaggagccatggttacttttgttttgctgtagcaaagaacgtggctgcagggcgaccttgcccttgagatctgtgaaactttgaacttgagggtgatgatttagtgcatatctggtgaaatgaacttctaggcaccatagcacaagagggatcctgtctgcatcaaacagtctgtgctgttatgtgtgaccaaggaaatgacctcaagttggaacttatatttaaatgataagcagaactcaaaagtttgaaacatttgcagcctggccagatggtcaaagagaaaagctgattttcagggggaaaattcatgaagtctccagaaatttgcataaagtggaggccagtgctaatagccaagacaattgtggggaaaaggcttggaggcatttcagagatgtttgcagcagcccttgctgtcacgggccttgggacctaggagagaagaatggtttcctgggccagccccatggccctgctgctgtgtgtagcctcaggacactgctgcctgcatcccagcagccccagctcctgctccgaccttggctgaaagatgtacaggtacagcttgggtcactgcctcagagggtgcaagctataggccttggttgcttctacatagtgttaagccagtgggtgcacggagcactagtctagagacttgggagcctccatatatatttcagaagatgtatgaaaatgcctggtgtccagacagaaggctgccaaaaaagcagagtctcatgggaaacctctacttgggcagtgcagaaggaaaatatgaggttggagcccccacactggaggccaccatcgtgcagaccccagattcatagacccatcaaaagcttcgtaccctccatgggttaaaaactccaggcactcaacaccagcacagcccatgagggcagctgcgggggctgaacactgcaaagccacaggtgcagagctgcccaaggccttgggagcccaccctcatgcccttgtgccctggatgtgggacaaggatttaaaaaggatgactttggagctgtaggtttgaataagtggcctgctgagtttcagaattttgtgggacttgtaagtcctgtttgtgttttgttcttctctctggcaaaaatcttccttttgggtggagattcttactaaatgcctggacaatcgtaccttggaagtggttaacctgctttgtatttcagaggctcaggggcagaagagactgcagctttgtctcagttgagactttgggcttcagacatttgagtaaatgctggaatgagttaagaccttgggggtcttatccaagacgatggggaaaagtcactgaaggcatttcatagcttaacttcacagtactaattttttgtgtgttcataacaaaaaggggtttaattggcttatagttctgcaggctgtaaaaaaagcatagtggcttggggaaatggcaggtaatgcatcatttcattttgcaaagtgagaaggacatgaaatctgggtaggcagggacagaatgataagatttggctgtgtgttacagaaacttatctggaattttaattggaaatcttaaaagtggggccaagttgaaggtgatttaatcatggagggcagtgggtgttggaaggtggggattggggagaatgggtggattttggtggaggtgaggggtgaaaggtagggttggaggcaggatccctcacaaatggttaaacactgtctccttaatgttttcctcacgatggtgagttctcgtgatggttttggagctgtgagattgaatggatactggccttctgggttttggacttgtgttggccctgtcatctcatttgtgttattttcctggcaatctcaaaccctttggattgagaaaacttgcccaatgcctctaccatcatcataccttgaaagaaaagaactcccttttaaattcagggactcataggcaaaagggactgtagccttttctcaggtgagacgttgaactttttacatttgagttaatgttgaaatgacttaagactttcagcaacttttgaaaaggcgtgattgtattttactctgtgagaaggatatgatattcaggggatcagggtcagaataatatggtttagctgtgtatccctacctaaactcatgtggaattgtaatcctgaatgttgcaggtggggcctggtgggaggtgatttattcatggatgggagaggggtggggttggaagtacaaagaggtgggttaggtggggaggagtaggttggctgtagggtggtgtgagggtggcatgttgtgggaggggagtagcctgctgcagaggcagaggctcatgggaaacctctactagggcagtgcacctgtggctttagcccccatggctgctctcatgggctaggctggtgtttagtgtgtgtagcttttccatactgagcgtgcgggctgttggtgcatctatgaatctggggtctggaggatggtggcctcctgcataggggctccaaacccatattttccttctgcgctgccctagtagaggttttccaagaggctctgcctctgtctcaggcttctgcatggagacagtgaggggtggatatggggtggggggcagatccttcaccaatagttaagcatcgtctttgtgatgctgatctcctcatagtgagctctcatgagatcaagttgcataacaggatatggcacctctttcctctcgctgtcgtgcttctgctcctgctatatgaaacacttcattgccgcttggccttctggtatggttgtgaggcttcctgagtcctcctagaagcagaaacaactatgctttctttacagcccgaagaactgtgagtcaattaaacctcttttctttatgtatatacagaaaatcaatgctgcaaggtgaagatatgaaatgccttctaggcctttcccgcaatctcttggctgttagcactgttttttttaatgcaaatattggaggccttcttgatttttcccttgataatggacccttcttcttttaccacattgccaggctgtgacacagatagctgacaatgtagaagccagttctgaattgggtaatggccagaggttagagagtctggaggatggtaacctcttgtgtggggccaccaagcctttttttttgttttttgttttttttctgctttgtcctagtagaggttttcctagtagctctgcctctgcctcaggcttctgcttggaaacagtgggggttgtgggtggtagggggcagatctttcaccaatggctccaccaatggttaagcattcttgatgctgaccttgtgttagagagttctcaggaaatctggttgtataacagggtgtggcacctttttcctctctctgtcttgtttctacttctgccatataaaacatactattggtgcttggtcttctggaatgattgggaggcttcctgagtcctcccagatgcagtagcctctatgatttatttaaagcgtgcagaaccatgagccagttcaacctcttttctttctgattatacagaaaattagtgctgtgaaatggagctatgaaatgccttcaaggccttttccttattttcttggcaatgagcactcagcttcttttccggcaaatatctgaagcctgcctgaatttttctcctgaaacagactttgcttcttttaccacattgccaggctgcaacaaacatagctgaaaatgtagaagcaggttgagaagtgtgtaacggccagaggttggagagtttggaggtgttggaagaagacaggaagatgtggaaaagtttggaccagtgtagagacttgttaaatagttataattaaaaagatgacagaatgatggacagtgatggccaggcttagaaggtctcacatgaaaatgaggagcttgctgggatgaggagccaaggtcacttttgttttcccttagcaaagaacgttactgcacgatgccgttaacctggagatctgtgaaactttgaacttgagagtgatgatttagagtgtatctggtggaatgaacttttaggcagcaaagctcaagaggtgtctggtctgtgccaaacaccctgaggtgtcttatatgtgaccaaagaaatgacctcaaggtgaaacttatatttaaatgagacggagagcttaaaagtttggaaaatttgcaggctggccaagtggtcaaaaagaaaagctgattttccgtgggaaagttcaagaagatttcagaaatgtgcataaaatggaattgagtgctaatagccaagacaaggataaaaaggccttgaaggcacttcagagacttttgcagcaacccttgctgtcacaggcccccaggcctgggagaaaagaatgatttccttatccagtcccatggccctgctgctgtgtccatcctcaggacactgctggctgcatacctgaagctccagctccaaccatggctgacagatacaaaggtacatcttgggtcgctgcttcagagggtgcaagctgcaagccttggtggcttccacatagtgttgagccagcaggtgcaaaaaggccaagactagaggctcagaatccttcatgtagactacagaggatttacagaaaaacctgggtgtccaggtcgaaactattcaaagaggcagagcctcatgggaatcctttactagggcagtatggaaggaacatatagggttggaaccaccacacagggagcaccattctgaaacgtcagattcatagactcactaacatcttgcatcttcattgtggaaaagctacaggtgctcaacactagcccagcccatgagggcagctgcgggggctgaacactgcaaagccacaggtacagagctgcccaaggccttgggagcccagccctcacgcccttgtgtcctagatgtgggacaaggacttaaaaaggatgattttggagctgtaggtttgaataactggcctgctgggttttggaatgtcatgggaacctgtaagtcccgtttgtgttttgttcttctctctggcaaaaaatcttcctttcgggtggaggttcttactcaatgcctggacagtcataccttggaggtaattaacttgctttgtatttcagaggctcaggggcagaagggatggcagtcttgtctcagaagagactttgggctttggacatttcagtaaatgctggaatgagctaagacattgggaaactgtagagtaggcatcattgtattttgcagtgtgagaacaacatgagatatggggggtcagggtcagaataatacgatttgggtctgcatccctaccaaactcatttggaattgtaatggtgaatgttaaacgtggggcctggtgtgaggtgatttattcatggagaagagtgggcgttggaggtaggggtgtggggagaatgggggagattattttgtgggtgggggtaaaaggtaagggtaggggggcagatccttcacaaatgtttaaacactatctccttaatgccgcctgcgtgatagtgagttctcttgatgatatttgcagctgtgggattgagtgaatactgtcccgctgagttttggacttgtgttgggcctgtgggcccatttgtgctatttttatgggaaatttcttccctttggactgagaaagcttacccaatgcccataccatcattgtacctggaaagaaaagaactccattttaaattcagggactcataggcagaagagactgtagccttgtctcaggagagactttgaacttttttacatttggaatgagttaagacttttggagatttttgaaaagtcatgattgcattttgctctgtgataaggacatgagattctgggatatcagggtcagaataatatggtttggctgtgtgtccctatgaatctcatgcggaatcgtaatccctaatgttgaagcgggtgacttaattatggacgggaggttggtggtggtggaaggtaaaagggatgggtaggattgggaggagtgggtcggtagtagagtggtgggagggtgggtggtagtaggaaggaggagcagcctgctgcagagtgagggactcacggaaaaccctctactagggcagtgcacctgtggtttgcagggtttagctcctcagctgttctcatgcgcgggactggtattgagggcctgtagcttttcctcactgagggtgccagctgttggtgggtctgtgaatctggggtctggacggtggtagccccctatgtgggggctccaagtccatattttccttctgcactgccctagtagaggtttcccaagaactctgcatctgcagcaggctgctgcctggaaacagtgggaggtgggtgtgggaggcagtcccttcaccaatggttaggcagcatgtgcttgatgctgtcttcatgatagtgcgttctcatgagatctggttatataacagggtgtggcaccgctttcctctctcagtcttgcttctactcctgccatttgaaatgtctccttgccccttggcattctggtagctatgaagtgccttcaaggccctttccccttttcttggcaaccagcactcagcttcttttcatgcaactatctggagccttcatgaattttccccctgaaagtggacttttcttcttttaccacactaccaggttgtgataaagatagctgacaatgtagaaccaggttcagaagtgggtaaaagacagaggtcaggagagttgggaaagcttggaagacagcaagatgaggaaaatttgaccgctgtggagaactgttaaattcttgcgatcagaaggctgacagaaggataaacactgaagtccagacttaaagggtctcagatgaaaattaggaatttcctgtgaacaggagccatggttacatttgattggccttagcagagaacgtggctgcacggggaccctgccctggacatctatgaaactatgaatttgggggtgatgatttcggatgtacctggtggaatgaacatctaggcagcctagcgaggtgtcctgtctgcattgaatagcctgtgttcttatgcgtgacctaagaaatgacttcaagttggaacttctattgaaatgagaagtggagacctaaagtttggaaaatctgcagcctggccaagtggtcaaaaagaaaagctggttttccgggggaaaattgaagaaggcttagagtatctgcataaaaagaagcccagtgcaaatagccaagacaatgggaaagaggcctcgaaggcatttcatggtcctctgcagcagcccttgctgtcacaggccctagggcctgacagagaagaatggtttcctgggcaagctccatggccccattgctgtgtgcatcctcaggacactgctggctgcatccctgtagttccagctccagccatggctcaaagatgcacaggtacagcttgggttactgcttcagaggtggctccaagccttgattgtttccatatagtgttaagccagcaggtgtacagagtaagagactagaggcttgggagcctctgtgtagactccagaagatgcacagaaaagcctggatgtctaggaaagaagcttttccaagaggcagggcctcctgggaaacctctactaggggagcaaacaagggacatatagggttgaagcccccacacagggaggcatcattctccaaaccccagattcatagacccacaagcagcttgcaccctcagtatggaaaagctacgaggcacacaacaccagctgtgtccatgagggccgctgcaggggctgaaccctgcaaagccacaggtgcagattggcccaagaccttgggagcccagccctcacacccctgtaccatggatgtgggacagggattcaaaaaggatgattctggagctgtaggattgactgactggcctgctgggttttggacattcatgtatcctatgaatcccgtctgtgttttgtgcttctttctagcagtttttttttttttttcttttggctgagaaggcttacccattgcctgtacaatcattataccttggaagtagtgaagttgccttataatccaaagactcatgggcagaagggactgtagacttgtctcagataagacttcgggctttggacacctgagtaaatgctggaatgagttaagatttgggggactgcagggaaggcatcattgtattttgcaatgtgagaaagacatgagatttgggggaccagggacagaataatatgatttggctctgtgcctcccccaaaacttgtggaattttaatggggaatgttaaaggtgggggctggtggaaggtgatttaatcatggtggagagtggatgttggatgggggggatggggagagttggagggtattggagggtggggagagttggggggtttttcgggggatggggagagttgggattgtggtggggttatgggtgaaaggcaggtgtggaggtggatccttcagaaatggttaaacacagtctccttaatgctgtccttctgatagtgagttctcttcataattttggagccgtgagactgaatgaacactgacctgctgggttttggatgtccattgtgcctgtggtcccacttgtgttatttttcttggaaatttcttccgtttggattgagaaaacttacccaatacctgtaccatcattgttccttgaaagaaaggagtgtgcttttaatttcagggactcataggcagaagggccttgtctcagatgagacttttaacttttcacacttgagttaatgcgggaatgagttaaggcttttggaaacttttgaacaggtgtgattgtattttactgtgtgagaaggacatgggatttgggggggtcaaggtcagcataatatgatttggttgtgtgcctctagaaaaactcacttggaattgtaatcccaaatgttggaggtggggcctggtgggagattatttaatcatggatgggaggtgtgggggtggaagaaaaaaggggtgggtagggtggggaacagtatgctggctgtagggtggtcggagggtggtgggtagtaggaagggggagtagcctgctgcagaggcagaggctcatggaaaacctctaccagggcagtgcacctgtggctttgcaggctttagcccccatggctgcccttatgggctgggctggtattgagtgcctatggcttttccatactgagggtgtgaactgttggtaggtctatgaatctggggtctagaggagggcggcctcctgcagagcaactcaaagcccttgttttccttctgcactgccacagaacaggatttccaagaggctctgcctctgcagcaggcttctgtctggaaacagtagggggtggaggtgtgttggggggtggatccttcaccaatggttaagcaccatcttcttgatgctgacttagtgatagtgagttctcatgagatctggttgtataacaggctgtggcacctctttcctctgtgagtcttgctcctgctcctgccgtatgaaacatttcattgctgctttccttctggtatgattgggaggcttcctgagtcttcccagaagcagaagccaccatgctttctttacagcctgaagacccatgagccaatgaatccccttttcattatgaccacacagaaaataagtactgcaaagtggagctatgaaatatcttcaatgacttttccccactgttttggctgttagcactgggcttctttttaacgcaaatatctgaagccttcttgaagtttcccctggtggagactggaggttggatgggggggaggatggggagagttggagggtattgggggggtggggagagttgtgggggattgggattgtgtttggggttacgggtgaaaggcaggagcgccaggctgcaacaaagatagctgaaaatgtaaagcaggttcagaagtgggtaacagccagaagttggagagtttggagagcttgaaaaaagacaggaagatgagggaaagttgggaccattgtagagacttgttaaatagttttgattaaaatgctgacagaaggaaggccagggaaggccaggcttacaaggtctcagatgaaaatgaggaacttaactgggaacaggagccatggttacttttgttttgctgtagcaaagaacgtggctgcagggcgaccttgcccttgagatctgtgaaactttgaacttgagggtgatgatttagtgcatatctggtggaataaacttctaggcaccatagcacaagagggatcctgtctgcatcaaacagcctgcgctctcatgtgtgaccaaggaaatgacctcaagttggaacttatatttaaatgacaagcagagctcaaaagtttggaacatttgcagcctggccaagttgtcaaagagaaaagctgattttcagggggaaaattcatgaagtctccagaaatttgcataaagtggaggccagtgctaatagccaagacaattgtggggaaaagccttggaggcatttcagagatgtttgcagcagcccttgctgtcacaggccctgggacctaggagagaagaatggtttgctgggccagccccgtggccctgctgctgtgtgcagcctcaggacactgctgcctgcatcccagcagccccagctcctgctccgaccttggctgaaagatgcacaggtacagcttgggtcactgcttcagagggtgcaagctataggccttggtggcttctacatagtgttaagccagtgggtgcacggagcactagtctagagacttgggagcctccatataaatatatttcggaagatgtatggaaatgcctggtgtccagacagaaggctgccaaaaaagcagagtctcatgggaaacctctacttgggcagtgcagaaggaaaatatgaggttggagcccccacactggaggccaccatcgtgccaaccccaggttcatagacccatcaaaagcttcgtaccctccatgggttaaaaactccaggcactcaacagcagcacagcccatgagggcagctgcgggggctgaacactgcaaagccacaggtgcagagctgcccaaggccttgggagcccagccctcatgcccttgtgtcctagatgtgggacaaggatttaaaaagaatgattttggagctgtaggtttgaataactggcctgctgggttttggaatgtcatgggaacctgtaagtcccgtttgtgttttgttcttctctctggcaaaaaatcttcctttcgggtggaggttcttactcaatgcctggacagtcataccttggaggtaattaacttgctttgtatttcagaggctcaggggcagaagggatggcagtcttgtctcagaagagactttgggctttggacatttcagtaaatgctggaatgagctaagacattgggaaactgtagagtaggcatcattgtattttgcagtgtgagaacaacatgagatatggggggtcagggtcagaataatacgatttgggtctgcatccctaccaaactcatttggaattgtaatggtgaatgttaaacgtggggcctggtgtgaggtgatttattcatggagaagagtgggcgttggaggtaggggtgtggggagaatgggggagattattttgtgggtgggggtaaaaggtaagggtagggggcagatccttcacaaatgtttaaacactatctccttaatgccgcctgtgtgatagtgagttctcctgatgatatttgcagctgtgggattgagtgaatactgtcccgctgagttttggacttgtgttgggcctgtgggcccatttgtgctatttttatgggaaatttcttccctttggactgagaaagcttacccaatgcccataccatcattgtacctggaaagaaaagaactccattttaaattcagggactcataggcagaagagactgtagccttgtctcaggagagactttgaatttttttacatttggaatgcgttaagacttttggagatttttgaaaagtcatggttgcattttgctctgtgataaggacatgagattctgggatatcagggtcagaataatatggtttggctgtgtgtccctatgaatctcatgcggaatcgtaatccctaatgttgaagcgggtgacttaattatggacgggaggttggtggtggtggaaggtaaaagggatgggtaggattgggaggagtgggtcggtagtagagtggtgggagggtgggtggtagtaggaaggaggagtagcctgctgcagagtgagggactcatggaaaaccctctactagggcagtgcacctgtggtttgcagggtttagctcctcagctgttctcatgcgcgggactggtattgagggcctgtagcttttcctcactgagggtgccagctgttggtgggtctgtgaatctggggtctggacggtggtagccccctatgtgggggctccaagtccatattttccttctgcactgccctagtagaggtttcccaagaactctgcatctgcagcaggctgctgcctggaaacagtgggaggtgggtgtgggaggcatttccttcaccaatggttaggcagcatgtgcttgatgctgtcttcatgatagtgagttttcatgagatctggttgtataatagggcatgacacctttttcctctctcatgcttgctcctgctcctggcatatgagacatctcattgccccttgacattctggtgtgattgggaggcttcctgagtcctctgagatgcagaaactagtatgcctccttacatcctgcagaatcattaacaattaaacttcttttctttttgatcattgagagcatttttaatgcaaagaagatctattaggtgtcttcaaggccttttcccccatgtcttggctatcagtactcagcttcttttcattcaagtctctgaatcctccttgaattttccccctgaaaatggacttgtcttccataccacattgccaggctttgacaaagataggtgataatgcaggaacaggttcagaagagggtagcagactgagttcaggagagtttggagggcttccaagacaagaaattgaggggaaatttggatctttgtaaagaattgttaaatacttgtgatcagaaggctcacaggaaaatagacagtaaagatcagacttagaaggtctcagatgaagatgaggaacttactgggaataggagccaaggttagttttgttttgctgtagcaaagaatgtggctgcacattgaccctgccctggagatatgtgaaactttgaacttgagggtgatgacttagtgagtatctggtggaatgaacttctgggcagcaaagctcaagaggtgtcctgtctgcatgaaacagcccttgcccttttgtgtgactgaggaaatgacctctggatgggtcttacattaaatgagtcacaactcttatattaaatgagaaacagaactcaaaagtctggaaaacttgcagccttgccaagtggtcagaaagaaaagccgattttcagtgggaaaattcaagaaggcttcaggaatttgcacgaaaaggagcccggtgctaatagccaagacaataaggaaaagaccttgaaggcatttcagagacctttgcagcagcccttgctgtcacaggccctggggcctaggagagaagcatcgtttcctgggccagttccatgagccccctctatgtgcagcctcaggacactgctgccggcatccctgcagctccatttccaactccagtcatggctgaaagatgcacaggtagagtttgcatccctgcttcaggggtgcaagttccaagccttggtgtcttccacatagtgttaagccagcggctgcacagagcacaaaactagaggcttgggggcctgtgtctagactccagagtatgtacggaaaaacctgggtgttcaggcagaagcttttccaagaggcagagcctcatggcacacctttaccagggcagtacagaaggagaaaatggggttggagtccctaaatatggagacaccattctccagaccttagattcatagatgcaccaacagctggcacccttagtgtggaaaagccacaggcactcaacacagcccagcccatgagggcagctgtgggggatatatcatgcaaatccacaggtgcagagttgcccaaggccttgggagcccagccatcacatgcctgtgctctagatgtgagatgtagattcagaaaagatgatttggagctgcaggattcaatgactggcctgctgggtttttgacttcatggggtctgtaagtccttggacttttcagtaaatgctggaatgagttaagtcattgggggacagtagagaagtcatcattgtattttgcagtgtgacaaggatacaagatttggggaccaaaggccagaataatatgatttggttctgtgtccctaccaatactcatgtggaatcgtaatggggaatgttaaagttggagcctggtggaaggtgacttaatcatggagaagagtgggggttggaagtaggggtttggggagaatgggggagattattttgtgggtgggggtgaaagatgaggataggggggtggattcttcacaaatggttaatcactatctccttaatgctgtctgcatgatagtgagttctcttgatgattatggagcttaaagattgagtgaatactgtcctgctgggttttggacttgcattaggcctgtggtcccatttgtgttatttttatgggaaatttcttccctttggattgagaaagcttacacaatgcctgtaccatcattgtaccttgaaagaaaagaaatcccttttaaattcagggactcatatgcagaagggacagtagccttgtctcaggtgagactttgaactttttacatttggaatgagttaaggctgttggaacttttgaaaaggcatgattgtattttactctgtgataaggacatgagattctgggatagcagggtcagaataatatggtttggctgtgtgtccctatgaaaattcatgtggaattttaattccaaatgttgaagttggggcctgggggagatgatttaatcatggactggaaggggttggggtggaaggaaaagggttggttagggtggggaggagtaggctggcagtagggtggtgggagggtggtgggtgggaggaagggggagcagcctgctgcagaggcagaggctcatgggaaaccctctactagggcaatgcacctgtggctttgcagggtttagcccctgccgcagctctcatgggctgggctggtgttgagtgcctgtagcttttccacacaaggtgtgagctgttggtgggtctatgaatctggggtctggaggttggtggccatctgtgtgggtgctccaagctcatatttcccttccgcacttccctagtagagttttccaagaggctctgcctctgcctcaggcttctgcctggaaatagtgggagttgggggtagggggcgaatccttcaccagtggttaagcaccatctttgtgatgctgaccttgtgatagtgagttctcatgagatctggttgtataatagggtgtgggacctctctcctctccctgtcttgctcctcctcctgccacatgaatcatctcattgccccttgacattctggtatgactgggaggcttcctgattcctcttagatgtagaagccactatacttccttatagcctgcagaatcatgagccaagtaaacctcttctttatgatcatagagaaaattagtactgcaaagtgggtctattaaatgtcttcaaggccttttccctattgtcttggtagtgagcactcagcttcttttcattcaagtctctgaacccttcttgaattttccccctgaaaatggacttgtcttcccttactacattgtcaggctgcagcaaagatagctgataatgtagaagcaggttcagaagggggtagcagacagagttcagagagtttggagggctttgcagacaagaagttgagggaaagtttggatctttgtaaagaattgttacatacttgtgaccagaaggctcacaggaaaatggtgagtgaaagccagacttagaaggtctcaaatgaaaatgaggaacttactgggaacagaagccaaagtgacttttgttttgccttaacaaagaatgtggctgcacggtgaccctgccctggagatctgtgaaactgaacttgagggtgatgacttactgagtatctggtggaatgaactgggcagcaaatctcaagaggtgtcctgtccccatggaacagcctgtgctcttatgtgtgatggaggaaataacctctggatgggacttacattaaatgagtcccgtctctcagaactcaaatttaggaaaatttggagcctggccaagtggtcaaaaagaaaagctgattttcagggggaaaattgaggaaggcttcagaaacttgcatgaaaaggagcccggtgctaatagacaagataatagggaaaaaggccttgaaggcatttcagagacctttgcagcagcccttgctattgtgggccctggggcctaggagagaagcatggtttccttggccagttccatgagcctcttctatgtgcagcctcagaacactgctgcctgcatccctgcagctcaagctccagccatggctgaaagatgcacaggtacagctcaggtcactgcttcagaggatgcaggctagaaaccttggtaacatcctcatagtgttaagccactggtggacggagtgtgagactagaggcttgggagcatctctatagattttggaagatgtatggaaattcctgggtgtccaggcaaaacatcccaaaaaggcagagccttatatcaaacttctactagggcagtgcagaaggaaaatatggggttggaactcccacactggagaccaccatcatgcagaccccagattcatagaccccccccccaaaacttgtttcctcaatgtggaaaagtcacaggcactcatcaccagcccagcccatgagggcacccttggggcatataccctgcaaagccacaggtgccaagctgcccgaggccttgggagcccagccctcacacccctgtgtcctggatgtgggacagggtttcaaaaagggtgattttggagctgtaggattgaatgactggccttctgggtttggagtttcatggggccagtaagtcctatctgtgttttgtttttttttctggcaaaattcttccttttggctgggaatgcttacccaatgcctgtacaagcattgtaccttggaagtagttaacttgctttatatttcagaggctcatgggcctaagggactgtagccttgtgtcagatgagactttaggctttggacatttgtataaatgctggaatgatataagattttatgggactttagggaaggcatcattgtattttgcaatgtgagaaggacatgagatttggggagtgagggaaagaataataaaattcagctctgtgtccctaccaaaactcatgtggaattgtaattggaatgttaaaggtggggcctggtggaagatgatttaatcacggtgcagagtgggggttggaagatgggggtgtagggaaaatgggggaattatggtgggggtgaggggtgaaaattggggtggggggtcagatccttcacaaatcattaaacactatctccttattgctgtccttgtgacggtgagttcttttcatgattttagaactgtaagattaaatggatactggcctcctgggttttggacttgcattgggcctgtggtcccatttgtgttattttcctgggaaatttctgccctttggattgaaaaagcttacccaatgcctgtaccattattgtaccttgaaagaaagaacattcttttaaattcagggactcataggcaaaaggtactgtagacttgtctcagatgagatgttgaattttttacatttgagttattgttggaatgagttaagacttttggaaaattttgaaaagacatgaatatattttgctctgtgagaaggacaagagactgcagggtatcaggtcagaataatatgatttggctgtgtttctttaccaaaactcatgtgaattgtaatccttaatgttggaggtgggacctggctggaggtgatttaatcatggatgggagggggaccggggatggaaggaaaggggtgggtagggtgaggagtaggttgttagtagggtggtgggtactaggaggggggagtaacctgcttcagaagcagaggctcatggaaagtctctactagggcagggcacctgtggctttgcagggtgtagcccccatggctgctgtcatgggctgggctcgtgtggagtgcctgtagcttttctgttctgagagtgcaagctgttggtgggtctatgaatctgcagtctggaggatggtggcctcctgtatgtgggctccaagcctacattttccttctgcactgccctggtagaggttctccaagaggctctgcctctgcaggaggcttctacgtggaaacagtggggggtggtgtgggtggatccttcaccaatggttaatcttcttgatgctgatctcctgatactgagttctcatgagatctggttgtataacaagtgtggcacctctttcctctctctgtcttcctcctacacctgccatatggaacatctcattgtcgcttggccttctggtatggtaggagacttcctgagtcctcccagaagcagaagccactatgttccctttacagcctgcagaactgtgagccaattaaacctctttttaaaataatactacagaaaatttgtactgtagagtggagctatgaaatgccctcaaggtttttttcctgattttttactattaacatttggcttcttttatatgcaaatatctgaagccttcttgaattttccccctgaaaatggactttttttcttttaccacactgccaggctgtcacaacgatagctgaaagtgtagaagcaagttcagaagcaggttcagaagctgggtaacgaccgcaggctgcacagtttggagggcttggaagaagacagaaagatgaatgaaagttttgactattgtagagacgtgttaaatagttataattaaaagggtgactgaaggatggatagtgaaggccaggcttagaaggtctcagatgaaaatgaacaacttactgggagcagaagccaaggtaacttttcttttgccttagcaaagaacttggctggatggtgcccctgccctggtgacctgtgaaactttgaacttgagggtgatgatttagggtatatctggtgaaatgaacttctaggcagcaaagctcaagaggtatcttgtctgtattgaacagcctgtggtgttctgtgtgaccaaataaatgacctcaagttgaaacttatatttaaatgagaagcagagctttgaagtttgatttacagcctgcccaagaggtcaaaaagaaaagctgatttttagtgggaaaattcaagaaggcttcagaaatgtgcataaaatggagcccagtgctaatagctaagacaatgttaaaaaggccttgaaggcatttcagagacctttgcagcagagcttgctgtcaaaggccctgagttctaggaccaaagaatggtttcctgggtcagtcccatggtcgcgctgctgtgtccatcctcaggacagtgccgcctgcatccctgcagctccagctccagctccagccatggctgaaagatgcacaggtacagcttgggtcactgcttcagagggtgcaagctgcaagccttggtggcttccacatagtgttaagccagcaggtgcacaggcttgggagcctttgtctagactcaagagtatgtaaggaaaaacctcagtgtccagctgggcagaagcttttccaagaggcagagcctcatgggaaacctttactagggcagtgcagaaggaacatacagggttgatgcccccatacagggaggaaccattttccagaccccagattcatagacccaccaactgcttgcaccctcagtgtgggaaagccacaggcactgaccaccagcccagcccacgagggcagctgtggggaaagaccctgcacagccacagaagctgagctgcccaaggccttgggagccccgccatccactcttgtgctctagatgtgggatgtagatcctttcaggaaagatgatttggagctgtaggatggaatgactttcctgctgggtttttgacttgcatggggtctgcaagtcccatctgtgttttgtgcttccctctgacaaatttcttccttttggctgggaatgcttacccaatgtctctacaatcattgtaccttggaagtagttaacttgctttgtatttcagaggctcgagtagaagggatggcagcgttgtctcagatgagactgggctttggacatttcagtaaatgctggaatgagttaagactttgggggactgtagagaaggcatcattgtattttgcagtgtgacaacgatatgagatgtggggggacctgggtgagaataatatgatttggccctgtgtcactaccaatactctcgtgaaattgtaatggggaatgttaaaggtggggcctggtgggagatgatttaatcatggagaagagtgggggttggaggtgggggagtggggagaataggagagattattttgtgggtgggggtgaaaaatgaggggggacggattcttcacaactggtgaaacactatctccttaatactgtctgcgtgatagtgagttctcttgatgattatggagcttaaagattgagtgaatattgtcctgctggggtttggactgacatttttgtcatttttctggggaatttcttccctttggattgagaaaccttacttaatgcttgtactatcattgtatcttgaaagaaaagaaatgccttttgaactcagggactgataggccgaagggactgtagccttgtctcagatgagactttgaattttttatatttggaatgagttaagaattttggaaacttttgaacatgcatgactgtgttttgctgtgtgagaaggacatgaggttctggggtatctgggtcaaataatatggattgactgtgtgtccatataaaactcatatggaattgtaatccttaattttggggcctggtggtaggcgatttaatcttgaatgggagggggttcggggtggtaggaaaaggaggggtagggtggggaggagtaggttgtcagtagggtggtaggaggatggggggtagtaggaagggggagtagccttctgcagaggcagaggctcatggaaaacctctactagggcagtgcacctgtggctttgcaggctttagccccatggctgctctcatgggctgggctggtgttgagtgcctgtagcttttccatactgagggtgtgagctgttggtgggcctatgaatccgggatctggaggatggtggcctcctttttgggggctccaagcccatattttccttctgcactgccatagtggaagtttctcaagaggcttggcctctgcaggaggcttctgcctggaaacagtgggcggtggtgtgggtgcaggatcttcttgatgctgatctcctgatagtgagacctcatgtgatctggttgtctaacagggtgtggtacctctttcctctctctgtcttgctcctacccctgccatatgaaacatctcattgccacttggccttctggtatgattaggaagggcctggtcagtgtgggcctggtcagtgaactagtcagttgggacttggtcagtgaggcctatttactgggggaatggtcagccagggtctgcttagagagggtctcattagagggatcgagtagtgcaggtcttggtgagtggggacctagtggcagacaaatgtttggtgtctggtcagtgcaaacctgggctgcagggcttggtgagtggagacctggtcagctgtggcttagtggtagccttgtcagaatgggctgggtcactggtgacccggtcaaggggtgctattcagtggaggcctggtcacatggcacctagtcagcagggcatgtcctcatcagtgagacccttgtcagtgggaccctggtcatggcagcctggtcaggtcagtggaacctaatcagtgggggcctggtcagagaggacttgatcagtggtggcttttgtagcactggtctatggggtgacctggtcaacgggggtctgagcggtacatgcctgttcagtggtgcctagtcactaggttcctggtcggggcatctggtcaccgcaggcctggttagtagggacctggtcactggcagcctgttccctggagacctggtcagtggggcttcatctgtggggccaggcaatggggtcatgattggtggaatgtggtcagggaggccttgtcagtgaggccctggtcagtgaggccttgtcagtgaggtccttgtcagtggggtcctggacactgtgggcctggcagcgggaatctagttagtggggcctggtgatgggggcctaatcagtgagagtgtggtcagggaggacctgatgtgcgggatctggtcagcagggacctggtcagtggggctgctgagcactgctgggaggtgtcaggggaaatgcatgttatcaggggccctatggacagctgggatggcccagtggtgtccaatggcccagtcaaaagtggacaaagcaggtgtttggatggacctgggagatcttgctcagagattctgaaagaacaaaggtaaaggaagggccagagtggctagagagatggtaacagtctatgggctgcacaggatggaggaagccagggaacaggcagggtgggcagtaggggtgcagggagaggcaggtgcatgctgggaggtcggaccctgtgagggctgtgggggcgtcaggtggggtgggctccaggtgcactctcagtgtgcactgggcaggtctcggtccaggctctctggaccctggtcgggtgatgtggtcactccctgggggactgctgtcaggcctagccacccacccttggcagcactgtcccatctcaggactggactttctcagatcctgcagagggcacagcctccagcccaggaggggcagccccttggtgcagcctaagctctccatgggcctggagcatccctgccagccctgcgctccctctactcccaggtcccgcttttcaagtgtcagccagcagagaggctccgtcctcccttccctatgtgtctcctgggctaaaacttggggcgcattgggacagggatggtgctttcctcaggcccatttagggaggggactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcagaaaatccggtcttgggatgggacggtgctgcccagggtgggtggccagggcttgacagcagtcccccagggagtgaccacatcagccaaccagggtccagggagcctggcctgagacccacccagtgcattgagggtgcacctggagcccaccccacctgatgcccccacagccctcgcagggcctgacctcccagcatgcacctgcctctccctgcaccccagatgtccaccctgccttttccctgatttcctccatcctgtccagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttctgtcatctgtacattgagaggaatttcttttactccacgaggctgcttggagaattagtgacagtgtgtgtagagcatgtgccacccagcaggcatttggtgtcgagaccacacctcctcccccttcattttcagcctaaatttgcattttgttcttaagactttcactcgccttaattttactctttcctctgattcccaccttatcgtctatcccatggagtcactaggatctaagtgggtaacagtcatgtatgcatgtatgtgtatgtacgtatatactttgttggtgttggagtgtggtgtgtgaatgtgtgtgtgtgtgtgtgttggagttactgggtgactgaaactgtacacatcaggctgtggttctgcccattgctggaagcgctgtcaggggtcctgccctcaaccccaggtctgacccttgcagcgcaggcaggacattctggaggaatcatgcccttgggaggatccctgaggagtgactggtgggtattggtggataaatacccctggtcccttgctctgggtatgatgactctgaagcacatgttctgtgctgtctctcagaggtacctggcagggctgagtcctggctgccacagtggaaactttcttgatgaaggtccctttaactgctgcattcctttcctgtctcagttccccactcctccactgatgtttcctgggattagcaccctaaggaagaactggcagtcgaattaatatcctagcgttatctccaaacaaaatttttgtatttgaatctttgcctcaggatctacttccaggaaattcagactaagacacacatttttcttttggctccttgaatccccataggcctgacattttgctgtttttatcaaaaaggaacatgaggatcagagagggaaagtcacttgcccaaagtcacccagctgaacagtggtagagttcaactttgatcatgagatgtctggcccccaggtggaggcttgctcctctcccatgagactccttccttatcagggtcaaatgaatgaatggaggatgttaaaagtggggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatgattggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaactgtctttctctgtctttctttaacccttg

SEQ ID NO: 188 - DNA, 879 bp, Homo sapiens
ggatctgaagaaatcttgcaagctgaagcctgacagtttggtgcaaacctccgagggctcaccacttcagtagaacatgcgtaaggaagagttctctctagacaaattgtatctggacaaataagaaggtccagtgatctgcttaggccatatatatgcttttataagagggaaccaagacaaggatgatgtcaccaacagcatcgacatccaagctttggagcttgaagaaactcaaagagtgatgctcgataactgagagagtttcctccacaaacgtcttggactcattggactcattaaccttcagattcaactcccagctctttccttcaataccagttttcatattaatgcttccctttttcattttaggcattcccctttcaagaagccgatctccagaccctaaaacaactgatctttcccattgactctccacagatggttcaggtggttttacaggaacaacactaacaaagtcctctggagaccctttcttggatcccgctccaccttctcaggaggtttatgatcacctcggagttgttcagcaatgagacacttgccttgaacaaaaaggtgactgacaatgttgaacttttcctgagtcttgtgctccctgaaagttgcaacaattatgaaatcccccaccccactcctttgtgtcccaggaggctaactacagaggaccaccctgcccttgcatattccaagacagactcatctccatccttgcgcgtgactcccgtaggactcgcagatggctccgttagtgacctgcttgcataaaaccctcggtccccttccttttctttgaggaagttctcattaacgatcattctccttataatagcctgaataaaatcatatatttaa

SEQ ID NO: 189 - DNA, 37110 bp, Homo sapiens
attcttcttcctcacgagaataaacacacattttactctcacctgccacttcccctactatccattgttagagtccttcactcccaaatttcgccgcagactcccgcccagtctcactcaccattggttgggaaagctacgaagctccgcctttgaatagtgatgggctataaaagacggcacctttgagggaaaaggcagtaggtcaggcgctcacctttgcctgctctctggcaacagtgctcacagtttctgagccagtggaggtggcctggagcagcagcccatgctactctctgccggttattttgccatttctctgtgcccttttgacagctccagggatcggtgccagcatttgtactgccagttcaggcacctgcagatctggtggaaaagtgagggaggtgattgcagttgcttggagatgctccaggtgcaaaggagttgtgttgagtccacaggtgagaaagggacatgagaatatcaggtgggcttggagcgaggttgataaccaactattcccacgttttctctccacccctccttaggaggtaccaagaattttcctgattggaaaggggtggaagagccacttttcaatcatgtaaaaagtagtagtagtactagtagtagtagtacttgtctttggtactaaagtaaagcattgtacaaagttgagtacagcattactctggctacaatatctaaaatggccaaaagagatatgttagctatatatttttaaatgggctactcatccttagaccgttggcatagtttgccttgtaaagtgcagtgaaggtattttgagggggatggaaggggagtgggcacaggaagaatgtcaggaggtactggtatgtgtggtctcttttcctccctctcctgctctaaaagtgagaagagggtctcacagccagtgctggttgggagaggtcttcttgtttctcactgctgaccctctatgccatccataactaaaccttcattttctgaacaggttttctggacctctgacctgcttgccctggaaggcatcataaaaccggttcctttttagcctatcagtctctcccccattctgaaactccctcttatttcctgttgctgatgctccctaatcatcctcttccccaaaacctcaaaggggactttcaattctgttcccccatccccgtaggtgtattttgctgctttgttttcctctaccttaactactcacagtgatgcaggtgaaccccaaaaccggggctcagctcgggagggttcttggctttgctcaggaaagaattcaagagccagccaacagtgaaagcaagcaagtttttaaagagtaacattgtacagcgaaagtggtggctccatagagcagggctccctcaggcagagcagcacttgtggactgccggcttagctatatttatacctacttacaattacaggctaagtaaggggtagtttgttcacaaactttctggaaaaggggcagggagtttgtggaaccagataaagtaactttctgccattgccatggcgtttgtaaactgtcttggcacgggtgggagtgtcattattttatgcaaatggagagcccagagcaggagctacagcatgggttgctgctatatttatactcactcttaattgcatgctaatcaaggggcgggttattttaaattttctagaaaaggggcagggagttcctggaaccataaaagggaacttccaagcattgccatggcatttgtaaactgccacggctctggtgggagtgtctttaataatgatcattgagagcagaggttgctttccttgccgtcttctggtttctggcagctttctctgctacatcctgtttttgatcagcaggagccttactggtgctggaaaagcaagtcctcctgatctacctccctactgccaaaggaacctaggatcagttcctacggactggctgtgacgggaaagaagcaccagcactcgccttagaactagcagccaagtccatctaaagtgaccaggagtaagtcttcccagcatcacacacccaggagcagcagccttaagttctagcccctattccctctttcttcctccctcctgccacaagagcgtcctaaacatgccgaacagtgagggtgctacaggggtcctgattgacggtgttttttgcaggccttttgggtggtccctcagttcctgaaacactgggttgtagagggaagctgtcccagagatgtttggaaaggtggttggcttgggcaggcgtcaagagcatctcttccatccctcaggaggagcgggcaccagctccccagtaaccgaaagaactgctgggcctgcggggctccacggtgccccaggtgggtggaccagcgcgctgctcagatgggggcagggccaaagtcaccaggtcaggaagtcgtgggcgaggggcttgcgtgggcgcgtgagctctttgcgaggaccagtaaatggcatttcttgggaacgcaggatcctaggaaggtacctaggatgccgtgcataagatttgctgcttgttaagaaacaggtgcaaggtatcctctctccgtcactcatccccaaggtggaattactataaggagcttcctgtgctcttgtgaaaggtggaaaagacaggaagaaaactggctgttaggcctctgttaattctggtgaaggcaaggaataattaccaatcaaaggagctgttgccaatcagctctagcctgagaaaagattctaagcatgccttcaaacttcaaaattaacgctccaaatctagcttctggtgaagttaaaaaacagaaacagaaaaacttaacactgttcgtgacatggaaggaaagtataatcatgtcttttcagtagtgcccccaaagcactatgtaacagcccttactaaatcattgcaaccaaataaaacccagcttaagcaaaaggcacttccacctgcttatctggagtttactgcccttaaatttaaagagaaattagatccaggcctttatctttggatcctaagataattctcattcttgtgcgtgcgcctctccttccccatctatcaaaatgtcacatttccactacattgttttggatttcaatcatgttaatttcttaataggaaatgaatggtaagttgaaagactgttgagccaggaaaaagcttattatgtgaaaaggaagcatgtgtgtgttaacaacacatgtaggttatctaaaataaattcagagttataaaaaacaatataattgggaccacgtctcagatctgaaatctcttgtttgggagaaggtataagttatcctgtaattgatacaggaaagtgtatcttggaaagagagaagaggtcgtatttatcctggtaaaaattagggaaggagctgccagggtgttgtggacagctgttacttcaagcctatgtcttgtcactctcctgggtttcctcagtagtgtagatctagctagagttttgtctgtcaattcttagattgtcatggttgttaagggctgggggttattttgtgcttgaagcattctatagatatcagggaccttagaatgttgagactcactaaaggaaggaaagactaatgctttaaatacatttttcttgtggacagaggagatgtgccagtggagaagactatatacagttctgtgtaagtggtattcagttattttaagtttccaaattgtcattgcttggtaataaggtgaatattttctatccaaagtatgtcatgtttgacacaaacaattaagcacaaacaaggcctgtcctactgatgtatagtcaccttagtaataaggtgtaaatgtattttaatcagtcatgggaatgagctagacatttggaaaacttaaacagtgatagccattggcttctcactctccatctagaactgatcacttagcaaactacctcctgtatttaaaactgggtttggaagggttaatgtccttctgataggaagctacttctccagggtattctagaatctgcatttcatcatgattgtaatgataaaacaaaacttattttctactgacagtcctagacataactatggaaaaattagaacagaaaaaatgagttagtcaaggctgaggttgaagaagagcagaagaggatctccaaatgaactttagcacttgaagaactgactcaaagccctgtggcctccttgaatgacacaaatgtgaggcaagattttcctgaaaatagcctgctcccagaggaaaagtgaattgcaccatcaaagaacaaagacagactggaaagtatgtgatggacctcagatgtccagagactgatcttgaatatgatcctttcctcaattattctgcggaggtacttggggcatctaaagcaaagcaggatgaggctgatcaacagcacttctgccacttgaaaacacctgtgagtgaaggtcgccacacatccctggagagccaaaggccttctgtttcaccaataagaagtaaaacagatctttaagaatctgaagatgatcttataatagatgtacctccagtcatgcctacttctaagaaatctaaactatgtagaggcttcaaacatcattataaggataaatggacacatatcacgcccccggaggagaaaaatcttaaaattagtggcacagaagaagaaaaaaacagataaaacccaactaaccacacaaatagatgatgacagtaacaaattacaactacctacattgctcatgaaaacatccccaggtattaaaactaatgtaaatttatatcattttaaaacagtacctaagaaggaaaaatttggggatgaaaaaagccatgactgtattttagaaggaggttcatcttctgcacctctcaatggcaatgaaataatgaaagaaagttgtaataagaaagttacctaaagaacaaaaaacaggtaaaaacaaaattatgatacacaaaaagaagaaattaaatgttggtattcaccaagccagttccacatttcttattcagatgaccttgcaaaagacaatgtgccaagaatgcaaggtaataatcaagacctcattacttttgaagaagcaaattagccaaatttggttctgatccaatcaaatctgataatggttgtactgaagatgacacctcctctcattctgatgacactatgaaagaatgtctttaagtttctaatgagctcgttgaaagtgaatctcataaggaaaagactgctaaacaggttagcattttttttcttttattgttttcttaaatctaatggagttttgcttaaatacatattttatatttgttctaaattctatacaatatacacctacataatacacatattctaatagttttgatcaataacatattggagtgacaaggcaaaagccttgataagtggccagccatagtgtctggcagagttgacagtttccagaggccatagtactatatacagtaacttatagttgacttctcaaattagaggattttttgttgttgtttgttttgagatggagtctctgtcgctcatgctggatcgcagtgaggcgatctcggctcactgcaacctctgcctcccaggttcaagcaattctcctccctcggcctcccaagtagctgggactataggcgcgtgccaccacacccagctaatttttgtatttttagtaggacgaggtttcaccctgttggccaggctggtctcgaactcctgacctgaagtgatgcacctgccttggcttcccaaggtgctggaattacaggcgtgagccaccgcgcccggcctagaggattcttttataggaatctacacaggtaaaactattcaaattcagttttttgtgaatttttattaaaaaatttgtccacactttgttgcttagattcctatggctttttgagaaacatgctaaatttgcctttactgtgctgaaattggataattcttttttccactaggcttcagaaaaggatgatatgttatattacaaaaacacatctggaccaaaaaagagaattgcacactctggcaaatttgatgtgaattatttagttcctcatctccccgctgctcaaagctttatataaagtgcataccttgttatttccagttttattattctaggactatttatccttttgtccactagggggcacaatttactggcagtcggtacattgattcctgcttgttagcattttcctgtccgtttccccaccccacccacagatctaacattttcattgaaagcaggtatattatcattgggtagcctcttaaccataaattttaaaagtcgatcctcattattcacagattccaaatttgcgaattcacctactcagtaaaattgacgtgtaaccttaaaatcaagacttgctgtgcttatgagatcattcacagacaacgcagagtggcaaaaaatttgaattgcctgacatgcacattcccagttaaggctgaagaaggtgatagccttcttgtttaagctcacataatgtaaaatgtccttttgcagtccgtttagtgccaggtttttttgtatctgtgtgctttttgttggtgattttgtgctgaaaattgccgctcattgtagtgctgtctagtgctcctaagcataaaaagaatgtgatgtgccttacagagaaaatatgtgctagataaactttgttcaggcatgagttttagtgctgttggccacgagggtattaaatgagatgtctgtaaacatgacacatatgtaaagcaaggtgatactttgattgaccaaaaaaaaaaatgtgaccagagacttacctgaacctaaccccatgtttgtttgttttaggagcagtggattcagtgttcactaaatctgagtttgtggtgacttacagagtataactacctgaaataacaagaatcgactttagttttcaaaataattataaacttttgtaatttataagtgctgaagttcttttatgacataaaaaagaaattgaagaagcagttcagtgagtagtattcctttaacatttttgtgtttaaaaaagtgatatttaggccaggcgtcatatatcatgcctgtaatcccagcactttgggaggccgaggcaggtggatcacgaggtcaggagatggagaccctcccggccaacatggtgaaaccctgtctctactaaaaatacaaaaattagctgggtgtggtggcgcatgcctgtaatcccagctactctggaggctgaggcaggagaatcgcttgaaccagggagtcggaggttgcagtgagccgacatcgcaccactgtactccagcctggcaacagagtgagactccgtctcaaaaaaaaaaaaaaaaaaaaaaaaaaaagatatttaataaactttctgcatggcagagtctatacttccaaatcacaaatgaaaacctgaatttcagttcttcatagaatagttgggtgtccttgggcaagttatttaatttttctgagcttcagtttccttatctatgaaaggaaaattgagtgcctaccccagggtcaaatatataagtacttaataaatgctagttaccttcctcttatttcttacaaagtttttttggtggctaacattatttccctttaactgcaaatgttgtggtgtttatagttttaattttattgtgctatgtaaaaaaaaaaaaaaaaaagccaggtgtgatggcgcgtgcctgtagtcccacctactccctgttaccccctccccaattcttgtatataaatagtttttggctttgtaaataactgtccttaaaattctcacaagttgaaataattggactaaagataaagaattttaagatttttaaagcattctttaaaaatcttattgtcactgtattgccttccagaagggttttcacaatttatagtccttctcaatgtttcagagttctcttcccacaaacccttacctacgatgcacattataattttttaaagcctgcaaatctggttaaaattttattgccttatcttatattacatttctttaattattagtgaagctaaacattctttcccatgttccattctcttataacaaatgttgctgtggagaagtctgcttgcctgctatttcaccctttgagtcgtgtgatacttttgtctgcctatccaaaggattcttcctttaattctgaagtccaataactttagtagatatgtcttattagctattctattttttctgtctacatacaaagtatcacttttgtatgaaatttaattttttagttaaaactttcttaaattatgtttcagtagttgttcagttttattatttccttatttctggggatactccaactatgcatgcattggatcacaatcagcgttacaaatgtggtcaatttactgtgtggctggctgtaaggcccccaacgagcttctatgatagaagaaaggcaaaattatcaattttatcaatttttcatcattttcatttgttttatgttgctgccctataggcctcaaccaataaagaggtcattagaccattcagggtaccagtcccactgctaacaagccccactggaatcattcgggcccagcaaagcagtacagataaaggctgccataaagaatgggaaggcttttattgatgccacttcagaacagaagaaaaatgcatctacatgtccagcctctcagagccaaaggaaaggtttggaaaaaagctttttttaaaaaaaagtcacttatttaagaaatggaattttacttcattttaaaaaatatttcttaaaaatccacatgctaccaagtatagttgaatcaatggcacagttttacatgaaataatatgattgatatttaaatattttgtctacatcttttttttttttttttttttttttttttgagacacagttttactctgtggcccaggctggagtgcagtggcacaatctaggttcactgcaacctctgcctcccaggttcaggtgattctcatgcctcagcctcctgagtagctgggcaggcatgtgccatccatcacacctggctaattttttttttctttttttgtattattagtagagacggggttttgccgtgttagccaggctggtctcaactcctgaccttaaagcgatccacccacctcggccccccaagtgctgagattacaggcatgagccaccactcccagtcaatactttgtttatctctaaatgatacacaatagtagtactattttgcaagtattttacaattgttttatcaattatctcaattcattcttctgaattatactggagtgggttattgggatttttttgcatttgaatgttgttttcttccaggttgcatgtttcaaacctataaaggaagtgttgtgaaattttgaattaatgattaaactctaatcatctgaggttaatgtcattaaaatttatcttttcttttccttgttcatgaaaacttcttagaatattcactcacaatggaccttcatctgaatgtagttctttcaagagaaaacccaactgcaaaaccaaccaaatcgttcattcctgtcaaaagtattgcttctctttctgtttaggtattataaactaagtctgaacaccagaattatatttcatcatatcctgcttacatatagagtccctggaagagtggctatatttttttctgaagctttcaaattcagataaatgccagacccaatagagaaaaatgtcaacattttttagcttaccgatgaatatagttattttcattatgatgtaatttgtgtcactcttagatgttttgttgattctatccttggaaatagtaggcattgttttagacttaaaacatctatggctatggttaattgaaacctactcaacattttttaaaaggaaagtttcaagctgtgtccagtgagggtgtatatttgtttatgtatatgagacagagacagctctttactaaataatgccatcagtgatatgatgttgtagccttctttaagtaattcttattctacttgtggcagtgattttcctcccctgttttccaattattttgtagcagaaaaccacctggcagttttaaggttttctccatccctaaaatgtctttgtattacatgcaaacaattactgagaagtatgatgttggcttggttttatttttcctcaaaggtgaagcagattaactgattttaaagttctctgggtctttttataagtccttcagaagaaatgctaagagtttatagctgggatcactttaatattaagtatactcaagtcactcagaaattttaagtccaagcatttttcttaatgatgtgctatcagaaagacattgggatacatagttgaaggatggcaacctacaaactttgctatatttgaatcagaggagcaaatcccagctttaggaatctggttgtggaacagtagtacaattagatgagtgatcagctatcattgcgtacgtgcaggtagcagcacagatgtggcagtctcacttctccattttgtgagtttaagtaattttatactttgtgtttattctacctcttcaacttgacacttgaaattacttttcaatttaattttgatataactgacctaaggtagttttacttcttccatatactcagtaggaatattaaacagaaacatgtcttcttttctctaataacacttttatttttaacaagaggccaaaagatacatttaacaagatggctcatcggaaaagacattcagtaacatcagaattcttatccaaagtacctgatgaagtaagacaacgctacatcaacctctttgttgagaagtatttgaaagtttgtaaaacagaggatgaggctgtttacaaggttggtattatataatgtaatttatctgaagacacacacaaaattattacattgaataaaaaactcatggagcacaactagcaaataactttattcattttctcttcattacattttcaaaaccaggccatgggactggttcagttccttcttccctcttggatgacttttatggtctttttcagttaccaaaagtcccctggttacttctagggggtctgggcagggtgaggactgtctgctagctccatcctctgcacaggggagccccatggctcagaaaacctaacaaaggaaacatgggtacagcagtggtaataaggggcatgcttgtcttattcctgatcctagggggaaagctttaagtctttcttcattaagtacaatgataactatggggtttttacatataacctttattaagttgagacaattcctttccattcctagtttgttgagtgcctcattgtgttagattttgttaaatgcttttttcttcatctattgagctgtcacacaggttttatcctttattctattaatatgatacattgcattgactttctgtgttaaaccttacatttatttgataggtgttcttggtcatggcatataatctttttttatacgttgctaggttacatttcctagtattccattgaggatttttgtgtctatatttatcacagatattgttctgtagcgttttttgttagtgtcaatgactttttaaaattgctataaaatacacgtaacataaaattaccattctaaccatttaagtgtacaattcagtggtatgatgtgtattcacaatgttatgaaactatcactactatccatttccagagcttttttatcatttcaaacagaaattctgtactcattaaataactccccattcctctctcctttcagtctctggtaatctctattctactttatgtttccatgaattttcttttcttttcttttttttttttctttttttgacagagtctcactttgtcaccaggctggagtgcagtggcgcaatctccactcactgcaacctctgccttccagcttcaagcgattctcctgcctcagcctcccaagtagctgggattacaggtgcatgccaccatgcccagccatgtttctatgaattttcttattctatttatctcatgtaattgaaatgatatactgtttgtccttgtatgtctgacttctttcatttagcataatgttttaaaggtttattcatgttgtagcatgtattcaaattttatttatttttacaactgaataacactttacggtatgtataaccatacttttgttatccattttgttcactcaataatggatggagattgtagttttctttgcagtaatgattctgtctcttttttggtctcagggttatattgacctcatagaataaattggaaagtgttccctcctcttttattttttggtttataagacagccttagctttcacttcctgcttgtgcagggcctcaaggttggccactggtgaatgaataggattttctcttttcccaggtcttaaatggaacacttgttaaacccaggattatgtcagagcctttacaaatctctagggtcatctagttctccaagagtttcttttaaattcctagccaaactattgtttgccagactaaaaccatagccctagctagctgtgatattgccaggatattgctattgtttcagttgcaccctggagatagggttttttccctccatactctgaactctgagtcaaatcaaatacccacaacaccctaggaatagagatttttcagggaactggttttttgtttgaatattgatagtgctctagcaataatgcttttagtatggttctaaaaaagatatgtctactctgttggctctcagggccaacctttcacaaccgtggcgccactaagctgggaagggaagggaggtaggaatttcacagaacccactgtgttaccaaggttcagtagtttctcttagacaattttcagtttgttctgtggctttagttattagaattttgaaatggttgatttttagttgttttgccaatatttttattgcttttgtgggacagtaagttcatgaaggttctcgctctactattccagaagtctgtgtcctctaggattctatgtaggttaaagaataatggcaaaaataaaaagggacaatatgagcctcttatgtgttgttcattttcttccagctttgtcttttttcatcatgtgtcttttcttccttactccctctaacctcccatggctttatctctgatgatttagtgtaatgagaagagtcttggtggcatttgggtacacctaggttcaattaccagctctgtaacaataagcaagatgtttcctttgttcaagcctagtttcatcatataaatcagtgatgacacccattctcatacagtcataatgaagattaaatgagaaaacatttaatatgcttaaaacaaacctgcatatactaggtatataaattaataatatatttaatatttattatcataacactccatttgcttgtttctttcatatttcattccttttccttttactgacttaatgacccttggtataaaaataattatgtaatggtttcaggaaggtaaattttatagaagaaaaaatgaagatcatgtcctccatttgctgtgtaatcctaagcaaattaaccactttgagccttagtttcttttaaatggaaatagtaatatatgcctctggtatatttggggctggctgtgagaatcaaatgaattgatgtatattctcagctttgtataggtattgcactatataccgtataccaatatacagtagccttttgtctatgaagcaagagtatctggttcttgggttggagtcatagaactgttttttttcttctttttttgagacagaatctctctctatcctccaggctggagtgcagtggtgtgatctcgactcaatgcaacctccacgtcccaggttcaggcgattctcctgcctcagcctgcggagtagctgggattacaggcacctgccaccacgccgggctaatttttgtatttttagtagagatgtgttttcaccatgttggccaggctagtctcaaactcctggcctcaagtggtccacccacctcggcctcccaaagtgctaggattacagacgtgagccaccatgcccggactattttttttttttcttcttaaaaaacaaacacaaaatggaaaataagttgcttttcattggtggcacagttttcccccattcattaagttacataaatattttgccatattcattatattgcaaatgacatttcctgttcataggcttttggcttaatatttaattattcaatttttgacctaggctaaaatagaaaaaaaggcaatatatgaaaggtgtagcaggagaaatatgtatgtgaacatagcagtaaattatcttaagaagctaagagatcaaggtaatttatttttttcaattaatcaagtgataaaacctgtaattagtacctgaccctgaatactttttctcattagtagggccatctttagcttataccaaggaatttattttttaaatagtctctttagtggaatgtgtaggtggtacttgtggttgaaaatcagctgcatttgaaattggatgtataactataaccttattgtcagaggttatcactgaaatatttaaacttgttttctggttatgaaagtaactcacttctatgcggaatagcatttctcaaccttgttttcgttatcgtccccctaagaaatctttgcagacattattttttctatcacctccctcttcccccttcataaaattaagtgccgctttaggagatacacctaatgctaaatgacgagttaatgggtgcagcacaccagcatggcacgtgtatacatatgtaactaacctgcacattgtgcacatgtaccctaaaacttaaagtatactaataataaaaaaaaataagtgccaagggataagattttattaggtaaggttgaattttgaagaaccatataccatcatagtatttaagattttcttcatccctcaagagtcaattttgctcccttgtgggcagtatcagttccatcaagaatgtatggcatgaattcaaataatatagaaaaacataaagagtaaaaagcagccaagacaactctttcatatttcttatttagacctttctatgtattactacagagatgtatatagttttaaaatttttagtgaatatgataattttatatatacagtatgtctagctattttcactgaataaggtatcagaggccttgtcagttaatctagaatctgttaacatctggatctatatcatgctttttataatggctacgatattctattatgtagaatctatacgatagatattcttttctatagaacttatactaaagatacaaaagttagccgggcgtagtggtggcccaaacacatttggatatttggagtgcttacattttttcctatatgactttttcatatatgatttttttctctgacttttgtagatgattatttcacatagaaaaaaatatttttctatatattctgtgataaatttaagtgtaacctctaacattttctcctacatgatgatatgtatcctagcacaaattcctgtgcgcagaagcaagggtctgcgtgtttgaaactggtaaatattgctaactgcatccaaagagtttgcccatttatattccccttcgataaagtagaagtatatgtgtttttctcacaccttgccaaagcttatcatttagcctctgtcagactgcaatggtgtagagcaaaaatgaagttagttttttttcttttcttttcgagacacggtgaggctctgttgcccaggctggagtgcaggggttcaatccttcgcctcccatggtcaagggatcctcccacttcagcctgttgagtagctgggactacaagcatactccatcacactcagctaatttttgtattttttgtagagatggggttataccacattgcccaggcttggtctcgtgtgcctgagctcaagcagtcctcccacgtagacctcccaaagtgttgggattacgggcataagccaccactactggcctgaagttagtcttttttaaaaaaatttattactggcagagttaaagcggttctttttttttctttctctctcttctgcatccctcctcccactcccccgtttcttattggtctgttcatctggaacaacctttgcctatcaccgttttaatgtgctgcaaatccattcctcagtttatcgtttgttcttcagccttatttatgaagtattattagatagatgtgattgcaaagtgtaatcagtctctttgatttctgggttttgtctcagactattccaatctcaagaacataaactatcaatctatgatttttgtggcatttcttatgtatgacactttaggggtttttgggttttgtttgtttgcttgcttgcttgtttgttttgagacagagcctcactctgtcacccagactggagtgcagaggtgtgatctcggctcactgcagcctccgcctcctaagttcctgcctcaggctgtcaagtagctgggattacaggtgcccaccactacgcctgactaatttttgtatctttagtggagacggggtttcaccatgttggccaggctgatctcgaactcctgacctcaggtgatccgcctgcctcggcctcccaaagggctgggattataggcataagccaccacgcccgacctctttaaatagatttaaatacatgtgttaatatatgcagggtctgttaggttagtcttttcaggttaagctaactcttcccccttctattcatattaaatatagcacatagaaatggaacgtagaggtcttagtatctgttttaaatatttcccatgaaaatagaaatggtttgcaagttgttacagttgtggtaaattataatataaaacatattgactcaaatttagacataatccattatacaaaatgtattaatttgagcaaatatcaagtcttgacatttttaatagttcagtagatttaacttttttcccagcttggaatttgttatgaagacatttggactcacatgttggatacttgttttaagataaaaataaatattttaccatgcttatatcttttttaatgtgctatgtgtttttatggaacagacaagaataatcattaatttcagagaatttcttgtatcttttagtcgtgcctagaagcagtaatgacaagaaaacaatttagagagtaggaacagaaaaataggccacacgcggtggctcacgcctgtaatcccagcactttgggaggccgaggcaggtggatcacgaagtcaagagatcgagaccatcctggccgacatggtgaaactccgtctctactaaaaatacaaaaattagctgggcgtggtgttgtatacctgtagtcccagccactcgggaggctgaggcaggagaattgcttgaacctgggacacaggttgcagtgagctgagatcgcgccactgcactccagcctggtgacagagcaagattctgtctcaaaaaaaaaaaggggggggggggagtgggggaaggaacacaaaaatggtaagcttactgtaataatagtaataagccctgtaattgataccttaaggggaaagtaaccctggtatagtacaaatattaaattattatgtttatgaagggtcaactgcatactatgcatttttgatatccttttaaaaaatcagtacaaatacaccatggaatactgtgcagccatagaaaagagtgagttcatgtcctttacagggacatggatgaagctggaaaccatcattgtcagcaaactaacacaggaacagaaaagcaagcactgcgtgttctcactcataagtgggagttgaacaatgagaacacatggacacgagcagaacatcacacactggggcctgtcggggtgggaggcaaggggagggagagcattaggacaaatacctaacgcatgtggggcttaaaacctagatgatgggttgataggtgcagcaaatcaccctgagatatgtatacttatgtgacaaacctgcacgttcagcacatgtatcccagaatttcaagtaaaataaaaaaaaagtataaataaggggaaagaacttacatttaagctatatttggattgaattctcaactattttgcttttttgattagcatgtgttaatttttcttttttggttaacgtatgtccagtcagcaagaccaatgcttctcaaatgtcaaactttccatgggtttgaattacccgggactcttgttaaaatgcagaatctggttcagtaggtctgggaaggatctcaaaccctgaatttataacaaactccaaggagcaagaagctacagaaaaggagttattagactttggctacattttgaataaaagcaaatggtagtgcttctcctctaataaagccttacatatgagaatgaaaacaaaatagatccttttgaatctcctaatacttctcacaaaataatttttccttttgccaaagcgtttaccaaagagtatctagcaaattctgttagagttttaaataagaaaatagatacaattctaaaagaatccgtaaaaatgaggggctcttggtctgggttagtgatgttggaaatggaacctgaacttgaactcttttgccatgagagacttgtcgtgtttccctctgtggtccttgattataagcatttgttgtatccttgtctgaatattaaggataaccgcatagtttggaaccagaaggcctgggtttgtgtgtcagttgtgctgtgtaaccttgggcatgtgtctttatttttctgagcctcattttcctcatctgtaaaaatgaaatcaatgcagttgcctttctaagttaatgtaaagtttaaaccaaagtgctatgcttactatatgctattactgatatgattcttcccttctctcacccaaagcgtatgatgtcacatggtatacggaacaatgtcggttttgttggtgttgctggatgatggatatgaagacctagaatttttaggccactaccttacttaatcagaaccctagcatttcagatctgaaagggttggtaaactctaaccttaccacaatgtaaagaaagataatgctacataaattttatggaatagcttttctttttttcttagtgctcataggagttattctctatagacatcttaaaaactacttgctaactgaggaacagctacacaaaaataactaccctagaccataccccaacaaaccaggaagtattcttttaaacctaggcatgaaaaaaacttggaaatgatggtaagtagatggggcccacaattaccctttctacatgctaagactgaaacctagggggcccagtgttctgataaatatatatatatgtttatgtttttatatatgtttatatatatgtttatgtataattattttagtggaaatgagattttttggtcagcatagttataccactgataaaaacatttttgcactgtgtttcatttcccttttcatttcaattatctaggtgcttaattttatctaagtgatctactttattaagtcctcaaaacaaccatttcaggtaagcattgttattcccctgattacacaaatgaggaaactgatgttcagagaattcaaataacttgtcaaaggtcacagaaaataagtgggacagccaggatttgaagccaaggtgtccaactcctgagctcctactcttcatcactattcatttacatatacaatgccatgttttgaaaactataaattctcactgtgaattattatacaaagatttataattagtcttattttgcatgttctccaaatactaggcataattagttaatatgttcatccccactgagagagaatgctaaacatcacagctgtcaaactttaggttgatgatcagagtatgaaatgcagttatacaaatattctacagtgactagaaaatatttgtcatcttctgcatctttaggacttctcccttgggattatcttcactattagcttttctcgttttgttttattttttcacatcccctcaatggaaggcaatacacttagcaggtaagaatatggactctgaagggggaagtcaggcttcctaaaggctgttttctcagtgaagtgttattcaaggtctggatgctagataagtcatttaacccctcctaccctctgttttctcattctgaatatgaggataatgataactaccccatcaggttgttgtgagaatccattaaaataatgtatatagagtgcttgacacagagcctgcctcataatctaatctcatcatggatattcaaataagagttgctgttatcaccattattatcactatcagaaccagtctgaggtttattaataaaacaaatattcatgaatgggtctagtgaaaaacgcagatatactcttaataacttaataataaatgtacagtttattgtgggagactcttgaagggataaaatcataaggaagacatggctcctatttcagggagctattatgtactagagtagttgactggtcaagttggttacagtcaagttgtaacactaaaactacaattggctggcactgggctgactttggagctaggtaggggggagggggcgcctgtttaagcagcagcagccctggtgcaataagcaagccacttgcaaattctcccttgagtgatcctgtagcttctcctgttactctgtaatcacactgggtatgtgcttcccacaggatcaagcatgcaaaggcaagtctccacattggctcatttaccttttctctcccatctcatctggaataatcctacttcatgttttgtttcggcacctaagaagctctgttgtcgatgtggaaaaatatatggtgtgactccctcaggttgacacagcagggtagaagaatgtaactaccaatttggcggagtgttgagtcataaaggtaagtatttggtagttctgtttggtttgacaagccagctgttcagagaagtggaatgaagtattaagttcaatgttcagtacagtccaataaagaaaaaactacatcaactctaaaacctttattgtagatacctgcatctgaccaccacttgacttacccttgcagctcattggctcaagaaccctcaggctatgacaattcttctttttttaagaccttaagtcagtcagctgcctcctgaccttgccctttccacatgccaacattgcagtagtttttgtttgtttgctaattgcttcaattccttgcaggtgaccttgcctaatactttactgaaaaaacaaagcctttgcgaaataatgccctgctcttccctcccagtagattcaccaacatctgctcctttctggagtcatgatggaggaagcatccctgttcccgtcacagttcctctccatgtgctctgtatcctgtcctcgtgcacctactcagggactcaccagactccccttctctataagatcagcatgttctcgacataccattctggtatctcccatttgttttagcaaactaaacctccatggtcccggtctcttgctgcatagctactctcatttctctgcctgtcctccagcacctactcagggactcaccagactctcctctataagatcagcatgttctcgacataccattctggtatctctcatttgttgtagcaaactaaacctccatggtcccaggtctcttgctgcataactactctcatttctccgcctgttgcatatgcttcatgcacaacaaagagttgtctatgctagctggctttactctccactcaccactgaagctcacatcagtgacctcgaggctgctggatctaatagacttgtttctgagtcacttgacttatcttttcagtactgtcttaccttatagtattctcctctctgcttttgtaacaacacccacttctgcctttcttcctccctttccagctacttcctttcaacctcctctgctgaatattcttccttaccagcctctagtggcagaaattctcagagctttgggagccttgtctctccatatcccccttctccctagatgaactgattctttcccatggctttcaacagcctctaactgctgttagcccctaaatgtgtatctctaaagaaacatttcccctggactcccagctttgctgaatatccatctgcctgcctatgtgggtttccctcgggtaccacagcatcacctgcatgaagatgagcttgtgatcctctccccaccctgggatcatctccagcaccctcaattccctatagtccacttaggtgtatttgttcccctgcttaaccaagaaacctggtgtcatcctcactgcctcctttttgtacaccctttcatctggacagtgtgcgagtcccactgttctgtgtcaaaagcatatcccaaacctcctgcttctctgatctggcccctgccccctcttccaccctttcccttgctgtctttacaccacactttctcccacctttctggagccttcttgcctgctgcatcctcgacttttcacatggctaattccttcttaacctggaggtctctgcttaattgtcacatcctcaaggtcttttcctgaccgtactttctaaatagggcctccctcttctgcagcaccctgtctctttcttctatagcagttaattatattttgtaatgagttagtaatctgtccaccatcttcaaaaaataagcttctggagggactgtccaacatttttttctccccatgttcccccagcacttagcacagtttctgacacacgcaagccatcagtaaacatttggatgggtgaacaggtaaattatttatgtagatgtggacataactatggataatattgtaataaatcctataaaaaggaaatagaggggaaccatgggaggaaaaatatatgaataaataatgtcatcaagtaaatcagacaagctcaatccatctttaaagcatggagggcttagtttgggaaagtgggagactgtgaattccaagaagacgaacaaggagggaagatgctgaggaagaataagtgtagcaaacaaaccagttgggctgatgggaccatacaggataatgggcagaacagggacttcggagccagcagagctgagagttggggctgttctgctgcttgctttcccgggcacgttacttttacaccctgagcttttcttaccattttgtagaaagggctttgtatggcagtttttactagaaaaactagtgcaaaaactagtgcaaaaactccctggaggcagagggacttgttagggagcaattgggagaatatttcctagggccagacagaagggctcagggtaggtaagggtatggatgaggtggatgataggagtagggtaagaaaagagatatgaagtattgagattattgctgcgaagaacgtgcaaggtgtctggcgaaggatgcaaaagccgaaggcatcaggactttgaaggtccagccaaggttggagccaacatctgtattgtggtctcagtctgcataactgggtgatttttcttgggttggataaaaatctggatacaggaatggagaaggtggtagttggaactagtcatacagaaggttctagcagaaagaaaaggtcagggagtaagagtagatgttgagaggatgattgaagtggtttgactgtcaaaccagtcaatgcaggataaagtaaggaagccagaggagagctgatgggccagggcaaatgataaaaagaggggaagaaaggtgttcacaacattagcaattataattcaccttcaagcatggcccgtgagaactctgcttatcggaatagatttttgtctattatgcaatatctaaaaaagtaactgaagagaggtgacttaaaaatatttgcacagtagagtccttaaagctctttaagggtcaaagaaaatgcatgttcatgagagttagtcactctgccttgtaaagcttgttttgatttttattttttcggttggtttacagtcctcagtggctttgaatctcaatacggctgttgtggaggtttccttggatcgccccggtgtcaggtcgccaaggtaggacttgtcacccaaagtgctgcctgtttcagaaaccaagttgtagcctccaacacaggccttggtgatggataagcttttgaaaaaattaactaattttcagttgatgacattttatgagcctaattgtacttagaaaaaacagtaatttatttgacaatgtttgtttcagcttcatgttcatgaccacaaagaaaacctaaagggctttgtgaagacttttgtcaagttcccacctgctgatggtaatcaccgtgtgtttgcagtaagttgtgagatggtatgttggttttatattttactttactgtggttattatgactgaatgattgtgtagcagtctacctggtagaagggtttccagggccttattccttgacgacacagtgctgcattggttgttcacaaattttcagatgaagccattaaagctgagaagagttagtgaattggttaagttcacgcacctagagcgatggagccaggaactgtcctgagtgtctttttatcggtcaaatttctaaaatatacaaatagtggtaattctactcatcaaattgctgaaattatgtgagtgaaaaataatcagcataaaagctttaatgcttttggcaaaatcatttctagagacaataaaatctttatagggacttatgttcctttacataagaatcagtgctaaaaagtggggaaaacagaatttggaattacaagacctggaaagttctactagctgtgaccttctgagcaagtctcttagatgctctaagctgtaaattatggagtcagtaacaaccccatagtgactatgaaaatcagatatgctaaaatataggaaagtgctttgtacatgtcaaacatatgaatagtcatctttaataaaacataagataagtttttattccccattgtatatttggaaagaagatttgtggcatttccttatactaaagatagaagacagtattccattttccagcttaagatctttttattattgttattatactttaaattctggggtacatgtgcagaacgtgcagttttgttacaaaggtatacacgtgccatggtggtttgctgcacccgtcaacctgtcacttacatgaggtatttctcctaatgttatccctcccctagctccccacccaccaacaggccctgatgtgtgtttttcccctccctgtgtccatgtgttctcattgttcatatcccacttatgagtgagaacatgcggcgtttggttttctgttcttgtgatagtttcctgagaatgatggtttccagctttatccatgtccctgcaaaggacatgaactcatcattttttattccatggtgtatatgtgccacattttctttatccagtcgatcattggtggatatttgggttggttccaagtcttcgctattgtgaacagtgccacaacaaacataagtgtgcaagtgtttttatagtagaatgatttataatcctttgggtatatacccagtaatgggattggtgggtcaaatggtatttctggttctagatccttgaggaattgcaatactgtcttccacaatggttgaactagtttacactcccaccaacagtgtaaaagcattcctatttctccacatcttctccagcatctattgtttcctgactttttaatgatcaccattctaagtggcgtgagatggtatctcattgtggttttgatttgcatttctctaatgaccagtgatgatgagcattttttcatatgtctgttggctgcataaatgtcctcttttgagaagtgtctgttcatatcctttgcccattttttggtggttttttttttcttgtaaatttgttgaagtccttgtagattctggatattagccctttgtcagatggatagattgcaaaaattttctcccattctgcaggttgcctcttcatactgatgatagtttattttgctgtgcagaagctctttagtttaattagatcccagttgtctattttcgcttttgttgccattgcttctggtgttttagacatgaagtctttgcccatgcctatgtcctcaatggtattgcccaggttttcttccaggatttttatagtcctaggtcttacgtttaagtctttgatccatctcgagttgatttttgtataaggtgtaaggaaaggggtccaatttcagttttctgcatatggctagccagttttcccaacaccatttattaaatagggaatcttttccccattgtttgtgtcaggtttgtcaaagaacagatggttgtagatgtgtggtgttattcctgagacctctgtcctgttccattggtctatatatctgttttggtaccagtaccatgctgttttgttactgtagccttgtagtatagtttgaagtcaggtagcgtgatgcctccacctttgttttccttgcccaggattgtcttggctatgcaggctctttttttggttccatatgaacgttaaagtagttttttccaattctgtgaagaaagtcagtggtagcttgatggggatagcattgaatctataaattactttggacaatatggccattttcacgacattgattcttcctattcatgagcatggaatgtttttccatttgtttgtgtcctctcttatttccttaagcagtggtttgtagttttccttgaagaggtccttcacatcccttgtaagttggattcccaggtattttattctctttgtagctattgtgaatgggatgtcactcatgatttggctctctgtttgtctgttattggtgtataagaatggcagtgagccgagatcgcgccactgcactccagcctgggcgacagagcgagactccgtctcaaaaaaaaaaaaaaaaaaaaaagaatgcttgtgatttttgcacgttgattttgtatcctgagactttgctgaagttgcttatcagcttaaggagattttgggctgagacaatggggttttctaaatacatgaccatatcatctgcaaacagagacaatttgacttcctctcctcctatttgaatacactttatatctttctcttgcctgattgccctgtccagaacttccaatactatgttgaataggaggggtgagagagggtgtccttgtcttgtgccggtttttaaagggaatgcttccagtttttgcgcattcagtatgttggctgtgggtttgtcataaatagctcttattattttgagataagttccatcgatacctagtttattgagagctttttgcatgaaggggtcttgaattttgtcgaaggccttttctgcatctattgagataatcatgtggtttttttcattggttctgttcatgtgatggattacgattattgatttgcatatattgaaccagccttccatcccagggatgaagcccacttgatgatggtggataagctttttggtgtgctgttggatttggtttgccagtattttatggaggatttttgcattgatgttcatcagggatattggcctgaaattttctttttttgttgtgtctctgccaggtttgggtatcagaggatgttggccttgtaaaatgagttagggaggattccctctttttctattgtttggaatagtttcagaaggaatggtaccagctcctctttgtacctctggtagaatctggttgtgaatccatctggtcctggactttttttggttggtaggctgtaaattactgcctcaatttcaaaacttgttattggtctattcagggatttgacttcttcctggtttagacttgggagggggtatgtgtccaggaatatatccatttcttctagttttttcagtttatttgcgtagaggtgtttatagtattctctgatggtagtctgtatttctctgggatcggtggtgataacccctttatcaactttttttgtctatttcattcttctctcttctttattagtctggctagtggtctattttttttatcttttcaaaacacctactggattcattgaattttttgaagggtttttcgtgtctctagctccttcagttctgctctgatcttagttatttcttgtctgctgctagcttctgaatttgtttgctgttgcttctctagttcttttaattgtgatgttaggttgttgatttttagatctttcctgctttctcttgtgggcatttactgctataaatttccctctacacactgctttaaatatgtcaaatgtgtcctagagattctggtacattgtatctttgttctcattggtttcaaagaaaatctttatttctgttttcattttgttatttacccagtagtcattcaggagcaggttgttcagtttccatgtagttgtagggttttgagtgagtttcttaatcctgaattctaacttgattgcactgtggtctgagagactgttatgatttgcattcttttactttcaattatgtggtagattttagaataagtgcgatgaggtgctgagaataatgtatattctgttgatatggtgtggagagttctatagatgtctattaggtgcacttggtccagagccgagatgaagtcctgaatatccttgttaattttgtctcgttgatctgtctaatattgacaacggagtgttaaagtctcccactattattatgtgggagtctaagtctctctatagatctctagaaacttgctttatgaatctgggtgctcctgtattgggtgcgtatatatttaggatagatagcagttcttggtgcattgatccctttaccatcatgcagtgcccttctttgtttcttttgatctttgttggtttaaagtctgttttatcagagactaggattgcaatccctgcttttttttttttttttttttttttttttttttttttgccttccatttgtttggtaaatattcctccatccctttattttgagcctatgtgtgtctttgcatgcgagatgggtctcctgaatacagcacactgatgggtcttgactccttatctgatttgccagtctgtgtcttttaattggggcatttggcccatttacatttaaggttaatattgttatgtgttaatttgatcctgtcattgtgatgctagctggttatttttcccagtagttgatgcggttttttaatagcatcagtggtctttagaatttggtatgttttttcagtggccggtaccagttgttcctttccatgtttagcgcttcctttggaagctcttgtaaggcaggcctggtggtggcaaaatctctcagcatttgcttgtctgtaaaggaatttatttctcctttgcttatgaagcttagtttggctgaacaggaaattctgccacttgtttcttttcactcttttttctctaatcttctcaagttgaaaattcttccctttaagaatgttgaattttgtcccccactctcttctggcttgtagggtttctacagagagatccgctgttagtctgatcggcttccctttgtgggtaacccaacctttccctctggctgcccttaacattttttctttcatttcaaccttggtgaatctaacagttacgtgtattggggttgctcttatcgaggagtatctttgtggtgttctctgtatttcctcaatttaaatgttgagttgccttgctaggttgaggaagttctcctggataatatcctgaagagttttccaacttgtttctattcctctcatctctttcaggtacaccaatcaaacatacatttggtcttttcacatagtcccatatttcttggaggctttgtttgtttcttttcactcttttttctctaatcttctcactttcattgagttgatcttcgatctttgatatcctttcttccgcttggtcgattcagctattgatacttgtgtatgcatcacaaagttctcgtactgtgcatttctcagctccatcaggtcatttatgttcttctctaaactggttattctagttagcaattcgtctaaccttttttcaaggttcttagctttcttgcgttgggttagaacatgctcctttagctcagaggagttttttattaaccacagttttgttcccttgctggtgaggagttgtgatcctttggaggagaagaggcattctggtttttggaattttcagcctttttgcgctggtttctccccatctttgtggatttatctacctttgtttggcctttgatgttggtgaccttcaaatggtgtctttggatgtcctttttgttgatgttgatactattcctttctgtttgttagttttccatctaaaagtccggaccctctgctgcaggtctgctggagtttgctggaggtccgctccagaccctttttgcctgggtatcactagcggaggctgcagaacagcaaagatttctgcctgttccttcctctggaagcttcaccccagaggggcacctgccagatgccagctggagctcttttttatgaagtgtctgtcgaaccctgctgtgaggtgtctcccagtcaggatacatgggggccagggacccacttgaggaggcagtctgtccctcaaatgctgtgctgagagatccgctgctctcttcagggctgtcaggcagggacatttaaatcggctgaagctgcgcccacagccactccttacactaggtgctctgtcccagggagatgggggttttatctataagtcctaactggggctgctgcctttttttcagagatgatctgctgagagaggaggaatctagagaggcagtctggccgcagcggccttgttgaactgcggttggctccgcccagtttgaacttcccagtgggtttgtttaccccgtgagggggaaaccccatactcaagcctcagtaatggtggacgcccctccccgcaccaagcttgagcatcccaggtcgaccttagactgctgtgttgtcagtgagaatttcaagccagtggatcttagcttgctggactccatgggggtgggacccgccaagccagaccacttggctccctggcttcagccccctttccaggggagtgaatggttctgtctcgctggcattccaggtgccactggggtatggaaaaaaaaaaaaaaaaaaaaaaactcctgcatctagcttggtgtccgcccagccacccagttttgtgcttgaaacccagggccctggtagggtaggcaccagagggaatctccgggtctgccggttgcaaagactatgggaaaagcacagtatctcggctggagtgcaccgttcctccaggtgcagtctctcatggcttcccttggctaggggagggaaatcccccaacccctttcacttcccaggtgaggcgatgccccaccctgcttcagctcatcctccgtgggctacacccactctccaaccagtcccagtgaggtgaaccggatacctcagttggaaatgcagaaatcacccgccttctgcgtcgatctcactgggagctgcagactggagctgttcctgttcagccatcttgccagccctcccatctattatacccttatttgttcttattcttccatgagtttaatagaatcttccctaattcctttttttggaacgaatcaggaaataggtaactattgatattcataatgacaaaatgagaactgaagggctgacattagttaaaaaacaaaacaaaacaaaacaaaaacctttgaatcttgaaaacattcaaatgcatttgatgcattacattctttagaaaatatttttaaacaaacccatgcactccatctatgctaacttcttcttgatctaaatgtcttattaactatgtgtcatattccctaactaagccaagtaatggagccaggtatcttttgctccttacaaaagacaatatcaccatatagtttcagttaaaaatacttgtgcagtatttttctcccttagcagtagctgagttctaaatatttattttagtgtgtgctttatgaaagccactagagtagtcactttcctgcatgcattttcattgggtcctcataaactagtaggttggtaattatccctactttacagaagagcagactgagaccagaagattaaataactacctgaaaataacatatagtaagtaaatggcagatcaaagcatagttcaaacccaggttttctagaatctgcccagggctccatctgttcgaccatgctacccatattttgtctttaggcttatgttactgggagacaggatacttaacaaatggtattgaataaaattcagattatgcaaagatcagaattcaacaggaactctgaacttgtaataatgtattctcccctcagccttgcattatggaaccaaatgataaattttcctagtttaccaatgtaaactagcagagaggtagttgacagtcatgcagataagatctttgtttcattcagctgtttgtcacattgggtcaataatgtgttctaactataactgataaaattcatggagttaaatttttatatgctattatatgtcatcttggggtaggttttctggtgtggcagaagatgacttgaagaacattaaaacatcaacccgtgatgtccaagctatcttgttgaacctgtttagtgctgacactgtactaatgtgtcactaaagtgatgtattaatcggacatcactttgaacatagtctatacccttaggtaaagaattagaagccaacatatttttttacaaaaaaaatgtataaaaccacatgtgttaagatagcagtcattatcattatgttataattgatacttgatttgccctgttaaccaagaagacaataatcgctgtctttgctgatgatacagtctaactaccacaaactagaagccgtgtcagacagttcacatcatctggctaatcaagatcataaagaatagtccctcatcaattatgataaaacccaaaccattgttttcacagactttccttaataatcaaatagacaagactaaatttattaactgattattttattcacatacttaggggtctttttccacattaagtcaggtaggctcaaaattaaatgttaggttcattttcttggcataatagacatgaaaacctttccttaatatactccaggttaaaatgtgtgtgttttgctctacgttctagacctgggccagtgaactacggcccatgggctggccacctgtttttctaaatatttttcttggaatgaagccatcatacccactcatttacagattgtgtatggctgctttcacactttaatgatattgttgagtagttgtgacagatcatgtgacttgcaagctgaaaatattaaatctggcacttttagaaaaaagtttacccatcccatcgtagaacggtgttatccaaaagaactttctattctacatctgcactacccaatatggtagacactaggcacacttggctgttgagcacttgaaagatgtctaatgtgactgaggaaatgcatttctaattttgtttaattttaatttgaatttcaacagtcccataaagcttgtggctaccacattgcacaacacagctctagaactttcgggacctttagctgagtgtttgtctcagccacccctaggactagccttcatgcagagaagggctagctcttcttcagtgcaaaaatatgagtaaggccatttaattttcatagatgaatatcagcctttttcttgatgaagctggtatccaaagtataggatatttgtttcaaagagtaatgttgtctctgcatgtgacaaatgagactggaatgtacttgcctctggaccttgccaaactgtaagaaaagagagttggggacatgagtttttcataagaaaaaaggggtatcctcttgtcccctcaaaaacatcatctcccaaactgcacctctcactatgactttcctgcccctgatttctcaggaaccattctatcctgcatgtcctccagaccagaaaatttcaaaacattgcatttcctcattccttggaatcgttctgtttcttccacccagaagactcatggattttcatacttttctctatttccaccatcaacttcttttagagtcatcttatggaaacttcccttgtcccccaagctgagttttgtctgttccaacccctgtttcacctttccccactactctgaaaatccctgagagtagggacactgtgctaggatgccccaaagtggtacctgctgcgggagttccccactccctccttctcccgtgcagcttcttgatcatttctcctcttcttgtgctctgtgctccctacagactaccctgcaggtaggaaccagtgccgagcatggtggctggcacactgaataatcatttaaagtgttatgtcaggcaaggcatagttgatactaaattttaaatttatgactcctcatttcttagtcttcaaattactcttgttctcaggctaatctttaaatgcttctttcaaagtacagttctcctaataaggaatccaaactggtacctgacttcctgagcccttagattatctgacccctctccctccatatctattctatcaataatattttccacatcaccaaacttcagtaaaaacatattcagcttcttccatgtgtaatcatgggggatttggaactagataggcctgagctgttgtgtgtgccttctccccagaggcagataagcaaaccactgaaatgcgatatggcatgtactgaactggggtgtgcccctctcagccaagtcacaatgtgggcagagcctggttctctgcctccccgagtgcttgtgagaacctctctgccctgatgttgccctctggtggttcctcatggtagaaaagtgtggactctgaagttagactgtttagattttatttccttcagctctactaagtaagtttaggcaagttttttaacctctcaaaatttcaatttccttgtctatgaagagggacaataaaaatacctatctcattaggttactctgcaaagtacagcaggataaactatgcaatatacttagtccagtaactgacacatcacgactgttgcctgttcttgtatcatagtccttgttcctaagtagttattgctgctatcagcatccttattttggagtttttacttttatttgaaagttaaaggtgtttttttttttttacttttatttgatagttaattcacacttcagttgtggacatatcggttatgtttcctcatcagcttggcttgcctcccaaaagaccccttaggagtctaatggctgattgcctgcagagaatcgttcaggatgatggtaagagcccatttgctcatgactgatgtcaagaccctcagtctgacttgactgaacaacagtgaggttcatcataaaggtctactgtctaagatgcttaaggtaggagaccaggttcttttctgggggttctctcctctggtggagaatcctaaagcatctgcctgtgcttgtgtaaaaaaccattatatgccattgcctggtatagtcctgggtgttcctcatgaatcagaacagcaatctcactgagaacagtggtcagatcattgggtctggcctttgaattcatgcacagaacttttgttgttccattctaaatcttgctgtatacctcttttcatatgtgcttctcattagaacaaaagaggttctttctacatttgattgggtccaggttatctcaccaagagaaaatttgtgtgtgtgtggggtgggggggggggtatggctcaaattcagtcattatgtgtgaacttgatttataccagatttgtatatcttgctgccaatttttctatttctgctttttctgatgaaatatacccaatgttaaacaagttaatcaagtacaacaaatctagccaccaattacctgttcgtggcattgctatatgcacagtttcaccagtgtctggcgtggaatggaggatacctgtatattcatgtatgcctatataggcccttcctgtgtacaaacagtagagcaagttaactttaaatatgttaaaattatattacgctgctttgtttctaaagattctcgagatatggatgttcctctgatcatatcattcattatacaaaatgatttcattttatgatgaacttacactcctctccagagaatcttttacatcctctgctttgttaagaatactcatttcagaaagaattcccataacattctattatagaatttgtagggccttctgttgaaaataatcttgaaccatggtcataatctttcagttaacaaatctgtttaaaacaaaatcttctaaaagttaaaaaaatatcagagctttcttggggtaagacacaagtaaagaaatgaaaactattacaccattttagaagcattgaccatacgactttctcacccaatctcagatatcatttattattctcaccagaactatacagctttatgttttgggtaaattttatctactttttaaaaccatataaacttgtgcctaaagttgttcttttatttagagagattacttttttttttctttttttaaccattcgacatttctggcttctaggcagatgtcttgctttggtgatccctccactttcttctcatacctccctgggaaggagatacacagctgagggtaccgatgtgctagccaatcattgcaaggtagtgataatgtgacagaggaaagactacctagaaaaagaacaatgtttgttaatctagtacattcatgtaaaacatttataaagcaatcattggaggttgtattaggtattaatgatatttcgataggtgagcagtgttaactttgttagaaacataaattgaaggcttaattttgagaaatatgtaagtaacatcagagattatggttgtcttatgtctaacactttaaaaaatattctgtactatttggaggtcacaatgctagtgaaaatgcaaaagcctgcatggatctggtcatttggaaggtaaaagaagacgtgaaaggaaagaa

SEQ ID NO: 190 - DNA, 32537 bp, Homo sapiens
gatctaatgttttaatttgtaaagtgtacaagtcatttttaatgttaaaaattagtgaatctaacaaaaggaataaattagcaatatttgatgtggttatgaaaagttgtttttgtttctaggttcctagtttcttaaggattcagggcatgggaagtaaaacattgactatgtgccaataatggaggtaagtattttacctgactctctgtctgcttatttagtaagtcaaccccctttcaaatgaagtctggacctcctctgaatgatagtgtgaagtgatagtctaaagactatcgtagtctaaatggtagtctatgttcaatgtttttcataattttaaacgaaaaagtaaagttagtattttctttactttgtagatttagaaaatgagattattctacaatttggataacttatcatgtatttgaaacatatcagttattagaaaatgcttggtgagaaagaaaaaaccagctctggcagctgggaagtggcctgacctgacccttatagctgggccttggtgttctcctgttgaacgtaagcagtttcacctatccccaacatcagacaaggcagccgtacctatcatagatccagacaaaaaaagaccacaatcaagtctgaattcagacaaaaagcagatcatccttcgaattgcaaaaatcaagcatcccactgtagtggccaaaataagtgactgcttttcaatttaattttactttttaaagacaaggtcttgctctgccacccaggctggagtgcagtggcatgatttcatagctcactacaacctcaaactcctgggctaaagcaatcttcctgcctcagtctcccatgtagctaggacaacacagttgtgtgcaaccatgcttggctaatttttttttttttttttttttaaagagatgggatcttgctttgttacccaagctggtcttgaactcctggcctgaagcagtcccgctgccttggccttctaaagcactgggattacatatgttagccattgcacccagccagcttttaaaaaaaacattacagccttaggattttgccttcctattggctttttagatcaatcagaatacttacttcccagccatagttttaaggctgtctcatggtgttaaatccatcatactgttttgttaactttcattcaaatcacccaaaagttattaggccttgggcttaagaaatggacaattggttaatagtttgatttccgcccgcccccccgccccgccctccacaggttttctttaggaatttctcataactatttattgtatccataaggattgcaaggtctcttggatcaggtaagacctttagattgcctcttctttaaaggaggctttcttgaatacctttccctgaggttggataggcactgctccccttctctgtgcccctggctcccacatctaatgttctcctggcacttacgacactctcattcaaattttctagccatgcaccttaagccccagccccacacctgggaaacatcctccaggcagagaccctgtcctgccgtttctctgtcacagcttcagagcaaacagtcaatagatgattattgtttgagagaaaaattatttcaagcaaacatgtgtctctcttacatccctcattctgccttatatccagtagctgtcatttgactaaagagaaacacttttcctgtgggacttatctttttagggctcagcatacctctttaaactttaaatgtcttttaagaaactctacaaaaatcattttctgtaatgcttgctgcacatccttatttgctaagctgggatgaaaatggcagagaatcagcctagcaacaaacttttactggtgtaaatgtttgattaataccaacaaatatcaaaatacaaccaatgccagtaaatagaagaaaagtatttacatattggaaacaggacaaagaatactattcagaatttttccttgaacagagctaattttcagtgggtttcttcctttcaaaaacttaagcaaactggaaaatcacataaacttatgggacatagcagtataagaaaaaaatgcaataaggtgaaaaaatcagggaaatgtgagggaaaattaatatatattttaacatttaatattaacatttctatgaaacagaagaagtacttaagttcaacagtgagtacatttactttaaaaccctgtgtcatgttttaaataatgaagcaaagtacaaatagttaaaagtacagcgcagcagaaattaaactcttgatccagaactcataactgacccagattattctgctagagctcacgttgaataaaatattttatctacgtggaggtatctttttttttaatcagacataataggaagattactaaaggaacataaagtatttagcattgccccaagaaagatgccctgcagctgggaagtgttgaatatttaatatagtctcaactacatgaatcatttctaacatggcaattaatactactactaataaacagtgcagaagccagctctttatttgttttatatgaattactttaaaccaggtttgttagacagttcagtgtagctgacagtgaatgtttaacaggaatgcatagcagaccatgttaaaaatgtggcattgtcccaaagtacaacatgactaagacatcctacatttagcagcacctttttgtaacagtaacttaaatgagcagtagagaaagagcataggaaagactgaaatggatatgaccaaaaaaaaaaaaaaaaaaaactattaaatacatttccagcattttctaggttgactacaaaaatggctctacaactgagtaggttaaggttaagcctttgttgtgtgaaaagactgtaactttacattccgcaggtcagtaaatatcccattgcccttgagattatttcctcatttacagatttactacacagtttacacatatgtccactatacagtttttcacatatagcggctcttatgtcaaatccttcaagctagttctttgaggaatattctgatttgcactaatatgttctacagtaaagtgcaagctaagaatctagatacaaaataaaaaagatggaaactctcaccactactttttgaaagggattaatgatagcagcaagtaagataaatactagctatgtttcaagaatttaaatattctaaaatcattaattgggatgaaataataaaggattgaactaataattgtgaatctcttaccatgacaaaagttttatcagaaatattttataaattcaattttaattagaatatggtttcctaccaatgtaagaattgtcaagtttattatgactactgattttatactcagtaaataaatttatgtaaacagtgtagggctaattaacgaactgagggaaattttttcatatataagctgataaaacattatatatgtaactaatttttattttctttttttaaacaccaggttgtcaccaggctggagtgcattggtacagtcacggttcactgcagcctccacctcctgggctcaagggatcctcctatctcagcctcccaagtagctgggtctacaggtatactctaccaccccagcttaatcatttttaatattgcgttttcttgggggtaagggaaataaggagttaaatgtaaaacagttttacttataaaaggctaagaatatttggtaagaacttggaataatcaaggaagcaaaacaaagtagattttataattttgctggatagttttttttgttttttgtttttttttcttttttggagatggagtctcactctgtcacccaggctggagtacagtggtgtgatcttggcttactgcaggctccacctcctgggttcaagcaattctcctgcctcagcctcccaagtagctgggattacaggtgtgcaccaccacacctggctaattttttatctttttagtagagacggggtttcgccacgttggccaggctggtcttgaactcctgacctcaggtgatccaccctcctcagcctcccaaattgctgggattacaggcatgagccactgcgcccggctgatttattttgttaaataagttaatgtgcagatctgaagttaggtaattatacacaggcattttcctgggacaaacttcaagtgccaggtacttgcactcttaatactgtcttaccatccagttataactggacaaaatatacacttgagacacggaaaaggtcttagccttaaacatgatgacattgtaagcttcttacagcagtgtaattgaggcatggagataatgtcttcaaggttccccttctgtgtacatgtcttatgtaggataatattcttaacattttattcacttcaagtcaccccattttgccctgatttcttctgaagaacagaaactttggttataagaagcacttctgggttctgacagacagtgaacctgctggagtcggtggtggggaggaatggtaggtaactgggaggtaaacaaacaacaggaacaataggcaaggttagaaattgaagtgggagaagttataaaaatttattttcccacgaaataattccacaagctgtgtaaacatttcttactaaaacaaatactctaacacacaaagattgtacatttccagtgaaacactcacagtaaaattgcctgtattttcactctctaggagcaaaaacaaggaggcagcagatgaatgctttcctagttacctttggcagcaagcttactcacattccctgactgctcaatgggttgttaaagcaacatatagcacaattaattaaatacagagcgaggtgggcagaatgctcgatatcagtctctagtttcttcgttagtcttcagcattccaattcatctcaaccattcagtcactcggtgcacactttcttacatacggacacacacacgtgcatatagcgagttccggctcgtagactccagtgcagtgactagaacagacactagctactaagaatgtgtcacaatcagtgtgaactgtatggagtagaacaacctctggagttttatatttaccataatttatggtggaaattacaaacttacttacaaggatggtataacattcagaattcaaaccttttcaagtcaagcaatcacacatatttacagtatgtacacactttctactagaatgaggataggtgtctagacaatgttattacaaatttcctgaatgtgggcatttctagtccctgtaattcataaagcaaatctgctgacttggcattaagactctaaaatagtgtgatcaaactgatatatatatatattatatatataataagaaggtgtttgtttgcagaaataacatttacaaactgtctatacagtacacagtactagtacatagaaaatagattctaactttatgatcccctttgtgtaaggcaagactgaatctgtccccaaatttagtcagccagaggtacaagcaagaaacagtggtccatgaatgaatatgcaaatcagatgcctgcgtattaacgtattaaaaatctggagaaacaagaaattccactttttatctgtgctgattctggcttgttggatacatcaactacatttcttaaaacactaacatcacctgggtggcaacagattttgttcaagtggcagctacccaaaacagtttttgaagagtccagtatgcaaccggaggactgcagccataccaggccaatttatgtagcacttacaaaagaaaaagtatctcaatactctatccatgctattgctattcaagcaacagcaataatacaaaatattacaagacagatcacatatgattgcagtgtagaccccaaagactttgttttggggatgctgttagttatacaagacttcaaaaaaaaaaaaaaaaaaacacaaacgggcaaaactcattggcggatgtaaacatccctgttccactccccagcctcattccgtttttttgatatcacttctccatccttttcacagtagcgatccttggatttatgacggctgcgctgcttgttgcactcgttgtggtcctgctctcgatccacgtcccgggaacggtgccgggactccctgtgtctgtggtcactgctcccgtgggtctcgtctctgtggttgtggtcacggtgtgaggcatagtggtccacgtggtcatgggaataatcttcctttggctctacgtaggcagagtctcgactctcctgggtttccgagtcaaatgtctcttgcctggagaggccgcgacttgtcccactgcgatggttgtggtgtggggctgaggaggaagagcggtgctgggatttcttgactggttccacactaggttcttcttcagcttgggaagcagaacggataggagcggagcgatcagtcctctgatcaccttgagaaccctggcagcgaaaggagcacaccaggcgttaaccaaggtcagtgtgtaaagaacatgtcccagagcaagtgcattcaagcagagtcctttttaagcatccgaaaagctgaaatgaagtctaacctagcttcatccctttggtaacatccagtggcatttataaggctttatactatactatattaaattggacttttgtaagtgcctagaacagtgcccatggtaactttttcctttaaaaaaaaaaaagcagcagcagggaaaatgttcttttatttattctcctgtggctcaaatacagatgcaggtccctgagatttttctatacagcggtgtaaacttaactacctctgcttgactgtatgtgagaatattaaaaatagcaaatgcttacctgatacagtgatacagtatgggacaggcactgttctgtagaccctttgtatataataactcattaatacaacagccctataagatcatctcttgagattattaattccagcagcctcttggacaggttgccattattattcctgaggtaagaacagttaagaaatttgccccaggttatccaccccacaagtggtaagaggtgcagccaggatttgaatctaggtgatccacttccacagtctatgctactgtttagaaagtttcggtagtctgtgtatgttcccaatatattctgttgatggtgcttttcttacaggtacatacacagctcatgctggacttgctttgagttaatatactagaacaagccccaagcaggctactgggcttggatcctagaggtgtcaccataggcaaccttttttctatgaagattgtatatatagatatatataaaaactccccttacctgtgaattagaggctagggtggggctaagaggcagacttgaagtggctaatgtacggctaaggagagggttggggaggctactgctgggaggatgggtggccttccagtaggcctccagatagtcggcaaggtgctcacaggcatcctcaagctggttctcatccaagatcacatcgaacagctcctgcagaggcagacattccagaccacattgatgccagcccagttttcacccccttcccacctccataagaggaggaaggggctcatgagctgcacccctttgtacttgctcctgcttctataagtgctgctactatctccctttttatttagttaggaagtgtctgactacctcaaatcattgttgagggcactgaatgcttaactaataaataatggccagaaaggtaacagttgttaaggacatggcaacccagaaaagttgtctatcaatcagcaatgaaaaaggcatagatactatggtagaaaagagatgtatatatatttgaacagaatagaatagaataggaagaagcctgttcttgacataaagattgtgatatcttttttctttttctttttttgagacagagtcttactctgttacccaggctggagtgcagtggcctgatcttggttcagtgcaaccttggcctcccaggttcaagtgattttcctgcctcagcttctcaagtagctggggttacaggtgcctaccaccaagccctgctaatttttgtatttttagtagagatggggttttgccatgttggccaggctggtgttgaactcctggcctcaagtgattcacccgcctcggcctcccaaagtgctgggattacaggtatgagccaccatgcccggcccaagattatgaaatctgaatttagaaattaataaggtaagattaggatgtgaaattttgacattgtccaaacttcacagtagttcagtagagaagaaaataatgccacttttcaaaagattttttagtgtttattataaattttaacatatattaagcaatcaaatatttatagaccctgaaatggctatgcttaaaaagaaaaaaaagcctggtgcagtggctcatgcctgtaatcccagcactttgggaggccaaggtggatggatcacttgaggtcgggagtttgagaccagcctgggcaacatggcaaagccccgtctctactaagaatacaaaaattagcagggcatggtggcgtttgcctgtagtcctagctacttggagggccgaggtgggaggattacttgagcccgggaggcagaggttgcaatagtgagctgagacaccaccactgcactcctgcctgggcaacaaagcaagaccctgcctccaaaactaaacctaggaaagctctaatacctcaaggcattgcatgtaaagcatagacgacaagtgagaatctaggtaacttattacttagaaattgatttgagaccatgtgaaaataaatgtctcagacagttattaagagcagacaacttgatccctatgatcagaaatgaataatataccaactccaaatagactcatcatacaagccaaattttcggaaccaggatcttgtgttggatattaacaaagtgaagttactgcaggatgtacggaagcttttggtaagctatgatcatcgtttggattacttgtgctcaaaacacatgatcatggaaggagggaggacagtttactttggaatgaataccactgtaagtgatgaggattctcttccctgacaggtgtttgactgtttttttcaaaatataatgccagttctggccaggcatggcagctcatgcttgtaatcctagcactttggaagaccaaggcaggaggatcacttcaggccaggagttctagaccagcctgggcaacatagcaagaccccgtctctacagggggaaaaaaaaaagttagccgatcatggtggcatgcacctatagtctcagctgcttggaaggctgaagcaataggatcacttgagcccgggagttcagggctgcagtgagctaagaccataccactgcactcccaacatgggcaacagagcaagaccttgtcccccaaaaaaaaaaaaaaaaaaaaaaaaaaaaaaggtctgatctctgtaactggattatgctgtatatagagataacttactggaggacactgagccagtttatcagctgctaccatctggacgttgaggtgtttagcttgagatttccctcgagattttattaacctttgtaaaacctgtaaaagataatgagtttttaacagagtaataactacatccaggtaaagtacaaggtacattattgactcctttctctggggcctttttatatacagcacaaggggcttataatagatggagctataagattatctgcaaaattaacatgttaacataaatcacagttgcaagctttaagcactcacattttttctatgctagcagctctcaaacattttatctcacaacctctttaaagaagctaaaatggaaaactattaaaacatttatttaaaaattcacaataaatctgatacatgttaaaatatatatatatatatttttgagatgtagtctcgctctgttgcccaggctggagtgcagtggtgcgatctcggctcactgcaagctccacctcccaggttcacaccattctcctgcctcagcctcccaagtagctaggactacaggcacccgccaccacgcccggctaatttttttgtatttttagtagagacggggtttcactgtgttagccaggatggtctcgatctcctgacctcatgatcctcccacctcagcctagtagagtgctgggattacaggtatgagccactgcgcccggccgaattttttttaataaaaatagctacatttttacacatctctctaatggctggctggctggcttcatagaagacaattgcagtctcctgtttgcttctacagtcaacctgctgcaatgtcatgttttggttgaaatacgtgaagaaaatccaacctcctacagatttgtaattgagaaaaggagaaacaatttagtatagtcttctttgatactacactaaaactcaacaaatggtggttccttaaagactatttgttatgtggaatctgaacctgcagtgcaattttcttactccatgacattccattggtctgtcttgaaaattaatgttattcattgatcatacaaacaataatggttcactgacttcagatcttccaaatgttgacatatttcattatacattattaaaacatcatattcattaatattaccattgatctcagagaaaactttattgggaagcttgcaagttctcagagatgcatacaagttttctaaaattctgattgttgtctgaaagcttgagttttatcattggcaacacatgctgttctcctttaagtgacaggcttattttgtccaagaaaatatctgctacaccaagtcggaataagcatagcctgtcagttgttgtttgagataaaaatggtattctatgaaaaacatggctagtttagttcacaactcaatcaaaccagtgcttgtccttactttttggtatacagcaggagctttgtgtgtactttgttttagtacactgaatattaaaagtcaagatttaataaaagtaataaactttactactttataaggacattaagtgaaattggctttttttcccctcaaactgcgaaagcatggtggcggtgaatacagtaactgctggtactttgataccacagtcttgatttatgtttagacgccagcagttttacccaccattgcttttgcatcagccatgcaaatatcaaaacagtgaaaatggcaaataatgtcttagtattatcatggaagtagttttgactaaatggaccctctaaaagtgtctcaacactctccagggatccatggaccacactttgagaacagctgttctaagccatgaaactatatcaatttaaaaattcttgactatcatgtctcctcaaattctctatacatcataaaggctattacaatagcctaattatagaaagcagaacataaaatacattttaggaaagtttgattatagagcaaacagtagcagtcctacttaccttaggagaagaaatctttacatatactataataggggccaaggaggttttactgagttgagctggatgattaattgtatccgcgtcaaggaccaccaactgcaatgttcttgcaagttcaaaaatcctttcgatttcactctgaacttccgctgtaaagggcgaaacaattcagttaaagtgcagtatttttaagataaagtaaaatggtatactgtttcttcaacagaaaggtgagtaggtcagccattatgttaatgcttacaggcaatagaattgataaaaatttacaacagtaatttatccttttggaaagggctgtttctccacacatcattaggatttaaggaatttttctgtcaaccggctacagaatttacttttagtataatacttggattgtggaaatttttagctctctgctgacattctttgtgcttgcagtctatgaaatcatttcataaaactgctgtaaaataagaaccttgacatatcttccgtgtgttcattgcagaccactttgcattagcaaccatgacaggttttcctttcagtgcacgggctgatctatgtttacatgtcacctgtatgccgtctagatgtttattaacaagatgaaatacaaaataaaacagcaaagacgtgaatggcaccagaaagaaacttatccaaaaacacacctcatattttccaaccaaagtagtcatgttttaaaagggcagttttcagaggcagcactacagaaatctaaagtataaaatttatagaaacttatcacaaaacattagaatatctagttgaactccgagaaaatggcattcagttcatctgttctgtgatctccaaagactcaaaaaccggactgtctgaccgaattttctgcaatgagggaaatattctctgtatgtggtccagcgtggcagcagctaatgggctactgagcacttgaacaggcgtgtaaatttttaaaatttaataaataggcagaagctactattactaggcagcataggtctataaagcatagtacatagctttcacttcccactgcagtcgtggaggttgaattccatgagacttttatgctagcaaatgtggatttacaattaccttttaattcctcttaggccgttggattcttgccagaagcttcctggagataattttaactagtaccttattgaagaaaaggtaactctctggtcactaatccatctgcctcacaatatgttatgacttgagtccttttttttttacctagatatctttaaaaaatcagggcccaaactacatgagatactagctttaaaataacattgggccactgaatcccagtcaagttacaacctaaattaatatttactgtaagcattaagaaatctgatcacaaagattttcatctttgtttcatctgttaagtgttcagacagtcacagcatcccgtgtaactccttgcttttaaaggtttgagtagtacaagtttaatatgtgggtttttttgttttttttgtttgtttgtttttttgttttgttttttttttttttttttttgagacagagtctctctctgtctcccaggctggagtgcagtggtgcagtctcggctcaccacaatctcctccacctcctcagttcaagtgattctctcgcctcagcctcccacatagctggaattaccggcatgtgccaccaggcccagctaatgttttgtacttttagtagagatggcgtttcaccatgttggcaaggctggtctcaaactcctgacctcaagtgatctcccgccttagcctcccaaagtgctggcattacaggcgtgagccactgcgcccagccctaatatgtgctgattgtataaaacctggatagccttaaaatatattacatatatggatattatttatattatgtcaatatattaacatgttttaatatatacacatatataaagatatttgtggtagccttacatacatactttacactccgttaattaaagggaaagagttttaaaatattttaaagtggactttcagaatcctggtgcaacactgtattagtagatacaaccttaagaatcgatgacaaattctgataatacttttgacttcaaagtaaaaatgatgcttttaaaaatggatgtatccatgctaggaattttcctttgacagagtatatcatgctcagaatttactctaataaagaaatgtcagaaacttccccaatgttcgtttctgaaactgaaagtcaatttgattctttccagttgtcctagctaatgaaagaatgcagctcagcatcttgaagacggggcaagccttcctcatctccccacatcccacagtttcttatacccactgaattaaactgaaaaatgaacacctttctatgctttatatctctaatatctataaacaacaacaggaacaatgtttcctcttagataaagaagagaagctacaacactgatcattagagaaatgcaaatcaaaccacaatgggataccatctcccaccagttagaatggctgttattaaaaagtcaaaaaataacagatgctgttgaggttatggagaaaaaggaacgcttatacactgttgatgggagtgtaaattagttaaaccattgtggaagacagtatggtaattcctcaaagacataaagataggaataccatttgacccagcaatcccactactggctatatacccaaagaaatataaatcattctattataaagatacacgcatgtatatgttcactgcagcactattcacaatagcaaagatgtggaatcaacctaaaggcccatcagtgatggagtggataaagaaaacaaggtacatagagggttaatgacacacacactggggcctatcagggtgggaggaagaagagaatcaggaaaaaataactggtgagtactagtcttaatacctgggtgataggaacttaaaagttaaaaaacaaaaaacagaagttaacttatttagaaggaggtttctgtaatcaaacaaaaaatactgtaataacagagtagagatggttactttcattgcggctagtgttgagggacacctaagtggtcagttaggaattaataagacctggaggtagctctagtatgagttatttaatgccatatgtgtaattccaatgccattttcataattactacacacaaaactcttaattttgaccagtgcctgccttatcttgcaaaaagaatctgtataagccttctctaactacctttctccccaggctcagtaaattctgcctctctgttcccactgccacatatcaaagtggcttggggggcagaagtgaagcgtcatcgcttcatagagctttatggccagtgggtaacatattgaacctcttagaacctaagtattctaatctgtattacggaaatgaggactaaattaatccacatgcaaagcttccgttatagttactgcagtacttggcctacactaagtgcagacagtccatgacttacgatggtttgacttaaagatttttcaactttataagagtgtgaaagcaatatatgtacagtgggaaccgaactttgagtccccatacaaccattctgtttttcacttttagtattcaatacattacatgatatactctacactttattataaaatgggtttggtgttagatgcagttggtttgcccaactgcattttttttttttttttgcatttttgtacttcttgcattttattataataatattacagcctcctccttggctcactctttattccttggtctgctgctgcttttagaattctcaaccactgaccagccatctctgtctgtctatatatacaagattttgtccatgtcttcctgtaaaacaaacactatgagaaagaggactttgtgtccttcacttttgtgtccctgggcaccaaaataatggctggcacatggttggtattcaagtatttgctaaatgaatgaatgcctccagtctgtacatggtctcctaccaccttaagaataatgacatggtttggctgtgcccaccgaaatctcatcttgaattgtagctcccataattcccatgtgtcacaggagggacctggtggggggtaattgaatcatgggacttggtctttcccatgtagttctcctgatagtgaatgagtctcatgagatctaatggtttcataaaggggagttcccctgcacatgctctctcttgcctgctgccatgtaagatgtgactttgctcctccttcactgtctaccatgattgtgaggcctcactagccatgtggaactgtgattccattaaacctctttactttacccagtcttgggtatgtctttattagcagtaattcttgtgagcgtcaaatgatgtgtggaaagagttttaagtgtgatagataaggacataaaaaagaaattgctataagcgaaacacatgatcacattttttcctgagaacagactaatagaaataagctccaaccttttcatgtcttatgcctgcctctctctgtcatgtcatctcccatgtccttctttttaaaacaatatattttagcttaaatgaagcacctatgtttttcagaagcctgttgtggctttcactgtctcgaatcactgtcaccctctccactcctttcccttttttcttggctaaatcctgtcatcttcaagtctcagctcaggatcagctccctggaaaagcctttccctgtgcctcctgcagcaacagctctttggcagccagttcatggctcgaccactttgctcatcaccctctatctcaaagggctcttcactgattcgccttatggctacacccagctccttgagggaaggggcttcatcagtttctttttttattcatgggcttccacatgatatttggtatctagtgtatgctcaatgaaatacatagactggaaaattcatttaaaaacaatgtataatcagtagttgtaaaaaaaatcttggcaatctaaggaaatctgttatgtaattgattccactgatgagtctaaaaaattacttgactttgttaattcagtttaatttatgaaataagcattttataataattcttggccaggcacagtggctcatacctatagtcctggcacttcaggaggccaaggcaggattgcccaagcctgggaattggagaccagcgtgggcaacatagtgagactccctctctacaaaaaattagcccaatgtagtggcatgtgcctgtagtcccagatactcaggaggctgaggtgggaggtttgattgagcccatgaggtcaaggtgcagtgagccatgatccacaccactgtactccagcctgggtaacagagtgcgaccctctctcaaaaaagtcaaaataaaaagtaattcttgtgagcatcaaatgatgtgtggaaagagttttaactgtgacagatgataaggacataaaaaggaattgctataagcaaaacacatgattacattttttcctcaaatatatttctaaacctgttactgaagttttgccaacgaagggttgttaggtgagaaacaaaactgagttctataatgtatcatgctcattgctaacatataaagcttattatttataatagtttttctgttatttatataatcatacttcagagtaaacgaagaacttctatgttagaaaccagcctctcagaggatttgtatatctaacctataaacagagaaaaattaagctcaaagatctgacacaactctcagaaagtttactttataaaaacagaaacctaaccatccagtaagcaacatgtgtaacagtgattaacctaaaactccaagcacataccaaaaagattaaatagcagctgaagggtctcagtgtgatcaattcagtatacgttaataagcagtatccacataccatctctgtaaacacaataactccctacactgtttttacaaataaaacaaacatattgatatctatcaataaatatagccaggaattgacttcatcttttactaatttccacacccacaaattacactctcctgagaatgatttcattattgatatataactggaattaaggaatatttaggataataatggatatcatttattgagcacatatcatgtttaatccttgcaatgattctatgaggtagttattttatttcttttttaggatgaggaaatggaggcttcaaaaggttaataaacttgctcatggtaacactgatgcaaagccaggagatcttagagtctgcagacaccaaagctcatgttagtgaaaacaaaccacaaccaaaacattaatgctgacagcctgtggaattcttaacttgaaactatcataacaaatccttccacaccatgaaatcagtaagaccatagcaacagcgactggcagcacacacctgttttttctatactctgtgacacatggaattatcatcttgttaggtcttctcatcatcaacatcgggagaggagagtttaaaaagcttaagctcattgcacagacttacctaagcttgaccttgtgttggatctttctattattgcgtgcttactgggattgtttaataccgagcgtttggcaagcgagatgtcagcggtgacccttgtgatggatatcctgttggaggaaaaagtcacagaagaccttaaggttattggtctaatcaaaggggatagaagtgtatgccccaaattcatctaagtatgaaatatatatagcaaccatattttcaaaccatatgtgttaggatacttacttattcattttttttctttttacttattcatttttatcttgcacctgccttactttgttttttgtttgttttgagacagagtctcgcccaggctgcccaggctgcaatgcagtggtgcgttctcggctcactgcaatctccacctttcaggttcaagtgattctcctgcctcagcctctggagtagctgggactacaggtgtgtgccaccacacccggctaatttttgtattttcagtacagagggggtttcactatggaagctggtcttgaattcctggcctcaagtgatccgcctccctcggccttccaaagtgctgggattataggtgtgagccaccgcgcccggccctatcctgcacctgccttacgttgcacttacttgttgcttacaagtgtcagataagtactgagcactttatttgaattactaaatgatccaaaaagctctaggagaaacgtttactattatcccactgttgctgatgaaaaatgagactcacagagagattttttatccaagggtatgtatgtaactaagtgggagagctgggatttgaacccagactcctgaccctatattcctagtctctgtgccatagttcattgctgtgataggcatgaaaaataaataagaaccagtcttccctcagatagctaatggtctagtggcagagataaataataaaggaaaataattaaagatgatgattgttgtggaaagaacatacagggtattatgagagacaatattgaattgggagtatcattttagataaggtagaaatgagagcaacaaaatttgggaactggaaatagcaaatgacttagactgcagaaagctgaatattcaagtcagcagtaggaaaaagctgtgaagcaaaattgaaggctcacaatatttctaaagaaggtagagaatgaagttagggcgaaaaggaaaagtttggttcaaaagtctgtttcagttacagccctccactgccccctcacaatatcaaatagccaggtgacagttcttttcctgtgtggtacaagaccctacatttgttatcttgcaggcaatacaagagggcctctgaccaggggaccctagacagaacaggagcagggaatactggatggaaaagaaaggattctgaatgttgagtcttcagcctttcttctcattgtacagttttggtagccaggcttatatttatatccccaggggtcagaatggaagattcttctctggggaatctgactgccaaattgtaaggacccaaagataatgatattggaggtttcctgtgtaaattatctagcaagattgccatacacagaaacacaaagttgacaagctccgcctatgagcacagaacctctgattaattattttatgccttattttaaaatttgagcacaggacagtttgtcaggcatcttcagaaaacctcatgagagagcaaaacaaacagaaaaatcaattatgacaattattcacagttaaaagctaaaagatggttttatctatgagactagaacaaatttctatttaaagacttagaataagagcttttggaagtaacatgataatagaaatagaaaaaaagcaaaagaaaggttaaaagaaatgtaacatttccaaagggtaaaacaaaaaagagttggaagataggagaagaaaagtaagaaaagtagacataacccaagaggttcaaattccaaattacaggagttcagaaaaagataataaagaagacagaggaaagaaaataaagaattaattccagaattaaggatctgattttctgaattgaaagggtccggcacacgggttgaaatacccacaccaagacatatttttatgaatttcataacactggggacaaagagaaacccataagctttcagaggaaaaagacaggtcccaaagggtctagaatcaaagcactagaatgctttgtacttctcaaagcaacaatggaagccacaaggtaatgaagcaaaaagccttcaaaatttggagggaaaactatttcaatcagaattccataagcatttaaactagcaattaaacagaaaggtttgtaaacattcaggctattgaaaaaaacatgtatatacccttcctagggaaatgagaaggtttttgactaaaatgacagtaaagcttgaaagaaatcaagggatctgggaaacaggagcttcaacccaaaacaaaggtgaaaggaatccccaagcatataacacggaatgttccagaatgacacccagcacagaaagaaagatctacactgcaacaggctagaatgtcccagagggattcaaatagacaaattaattttggctggctccatatttaatatttattgaaactatgtaaataatagtcaatgaactatgtcatataatgtgttttttttttttttttttttagacagcatctcactgtcacccaggctggagtgcaagggtgtagtaatcatagctcactgcagcctcaacctcccaggctcaagtgatccccctggctcagcctcccaagtagctgggactacaggtgcatgccaccacacctagctaattttttttttttttttttagtagaaacagggcctcattatgttgcccaggctggtctgaaacttctgagctcaagcagtcctcctcccttagcctcctaaagtgctgggattacaggtgtgaactgctgcacccagcctactatactttttcttgtgtattttcctcgtggtttccatgagataaacaactttttatttgctcaatttttttttttttttttttttaagatagagtcttgctctgtcacccaggctagaatgcaatggtgtgatcttggcttactgcaatctccgcctcctgggttcaggcgcttctcctgcctcagcctcctgagtagctgggattacaggtgcccaccattgtgcccagctaatttttgtacttttagtagaaacaggtatcaccatgttggccaggctggtctcaaactcctggcctcaagtgatctgcctgcctcagcctcccaaagtgctgggattacaggtgacagccactgtgctcagcctcaggattactgatttctagtaagactgtcctacagaagattctggcaatggtatatttatccctgtagcaattcagtatgcattccaaacacttcagggctgattgctgacgttttgaaagtcactgaaggaaacaaaacaaaacaaaaaaacaaaaaaaaaaaaccgtgaatttatcccaggtagctttccttcttgttctcaacttccttgttaatttacctgtcaccatcctacaaggtgaatctgaagattgctttgtttacatgacacagttggttactgtgaatccagttttgaatgggctactttattgcacacaacaggaggaggaggaggatgatttatttcttctttgatctgacacactgacactacttaaccagaatgtgattctgacaaccccctagggctgctgcaaatgaatttaagtgggtttcagaaaagaaaaaggaattcttgactacctagaacctttcgcataactaacatttcctttcatattttctcctcttgggcttaaacgtttttaaaaaataaacttagcttatttaatagatgattaaggaataattcatttttcccttttagaatgtcatatgtatatacacacctgatacttttgttgaatttccatcctctattgctgtcttgccttgccaaaagcaaagacagtcaataattcagttactctagatgtcttgccatgggtaaaaatgttaaatttgtacacagcttttaaattctgccttatggactcgtttcttcctctgaggactgttaactggggagaacagggctagaatatagaaccccagctctgtaagtcaagatgagccaaggcaggtctattaattaaaccatatgaaagttacttctggctagaaataacagatactttaagatattttgtttatctgtttcttaaataaaaccaatctgggtggctgatacactcgaacatgggtccaaaatccaccctctctggctggaatgtgtcttccaaattcaaaacttactcaggtttaagtacaagtagtaatccaggaaattccatcccatttccccatctttggcatttaggaaagggcagtgggttgactcaggcatggaaaacacagtgcctttgttagcagaattttttttagtgttcaggctcatgttgacaattccaaattgtgataaatgacagagccaaggataaagaaacaagctaaatggagcagagtagagctatgccttttatacttggccagtgcctagtagccttggtccaagctaaagggtctatttcctgtcacaaactgaaaaatatttcttaaagatatggaaaattaaaaaaatctaattaggaatatttggttagaagaccttgattataaagtcttttcataccttgaaacttataatagtttttgttttcctcattctctctcctttcagttctttgcctgatcacttttttttttttttttttttttttttttttttttttgagacagagtctcactctgtttcccaggctggagggcagtggcacgatctcggctcactgcaacgtctgcctcccgggttcaagcaattctcctgcctcagcttttcgagtagctgggactgcaggcacccgccaacatgcccagctaattttcttatctttagtagagacgaggtttcaccatgttggcgaagccggtctcgaacacttgacctcattatccacccgcctcggcctcccaaagtgctgggattacaggcaggagccaccaagcccagcctgcttgatcacttactaaaaagacttgtcctcctataaaactttccttcctacccttgcctcccctgccaaaagtcaatataaattagaaatggttgtagtagtaggtgtggtctagaaagaaagtactatagtaagaaatctaaaagaatcctgaaaccaacaaatactatctattgcagcagtccccaacctttttggcaccagggaccagtttcattaaagacaacttttccgtggaccggtttggtaggagtggggagatggttttgagatgattcaggcacattacatttattgtgtactttctttctattattattacactggaatatataatgaagtgattatacaactcaccataatgtagaatcagtgggatccctgagcttgttttcctgcaactagatggtcctttatggggttgatgggagacagtgaaagaacaccaggcattagactgtcctaaggagcatgtaacctagatccctcgcatgcagagttcacagtagagtttgtgctcctatgagaatctaatgccgctgctgatctgacaagaggctgagctcaggcaataatgtgtgagtgatgaggagtgactgtaaatacagatgaagctttgcacactcccctgccactcaccgtctgctgtgtggcccctagcaggccatggaccagtactgatctgtgacccggggatttgggactcctgatctattgtagttgcattgttaggatgggaggaggaaaggaatgtggagaagagaagcactgcatttatctggttaaaaatacagaaatatacactagccctgtatcttccaggtcccctgtaataacctactcttaaactctgaggtttccattttggactctagtcatgtctttgatgcttcaggagctggcttaacattcaatgatggcacccattaattatttgattcaagactgcctttcaatagactttaagccccacaaagccaaggcccttgtctatttttgctcctcacaatgcctggcacatagaatatactcaataaatacttactgaggcaagttgaatagtgaccgggggaagaggaggagaaagaaaggattaagtccaagcccattggcgtgacacactagatatgacccttggatttgttaccagtcactccttgcccatgtcctttaagatgtgggtgtgagttgccttacacataatgctgtgtcatacctcaaagccttcacacactatataccatctgctgaacatacccttctcttccctgtaatccatttggtcaaacgttaggcaccatttaaaaattcttccaggtgtggatgtcctgaagttggtgttaattacgcctccctttatgctacctgcaccttgtgcatgcatataaccaagttgcccttttacttatatgcagtgttactgctacaggtttcaatttatggtttccatgagagctgttcataggcagagactggcttcaccatctccgcatttctctagcagagagtatgcagcagacgttcattcaaaattcatctggccactgctcatgttgagtactgctccaggcactgagaatacaacagttcacaaaacattctcaaaccctgccctcatggagtttatcgtctaattatgggagaatgacaataaacaaaaatagtactggaaatacataaaagagcactagaaaacagagggaaaggagagacacagaacaaatgtgtgcatgtgtatgtgtgcatacatgtacacacgtataccaaggagaatatctgagggaaaagtgttcctagcagaaggaactgcaaagtgccaaagccctgaggtgattgtgtaatctgtctggaacactcaaagaacagcaagggagtaagtacggcagggtgagaatgagcgagggaagagcagcaagagaaaatctaggtaaggacgtgtggaagaatagaccataggaggtcatgtaggccactgtaggactttggtttccattcagaggaaaaaaagaagtcactggatggttttgagtaaaggagtggtgggcactagctcacatcttaacagggtcatgcagcagctaacctgagcacaggctttaagggaacaaccacagaagcaaggagacaaggtgggaggctgttgcaccaatccagggaagagatgaagatgtctcagaccaaaatggtggcagaggatgtgtgagaagggcttcgattctgaatatattttgaagataaagacaacagcatttgcatgtgaaatataagagagaaagaacagtcaaggaaaatgatctgggctgaagggtctcgggactgaaagacgaagaagctattaattgagatagggaagaccatgggaggagtaagttttgggggaggttacatttgaaaagtccattagacatcttagtagtgataatgaataggcaattgtatacatgggtctagaatttagaggaaagactggcaaaggaatggaatttaaaaatctgatgctgaatgaaatcactaaagaaatgtaggtaaaagacatcatagagcttagccctgggctgtccaagatttccagttgatgaggaagtatcagcaaaggagacaaaggagcagtcagtgtgatagaaggaaaaccagaaaagtgtggttccagaaaccaagcaaagtatttcaaagaggatggaataatccaccatgtcaactactgctcatggtcaagtaagattagggctgaaaatttatccctggatttagcaatgtgaaggtcatgggtgatcttgacatgactagtttagctgagtggtgtgggtgaaaacataactggggtaggctgaagaaagtggaaggaaagccagtacactcaattctttcaaggaatcttcctgtaaagaaaagaaaaaaaaatgagacacctagagcaatatgaggtcaatgtgataggaattaacatttttacatggtgatggagtttccattagaacaggaaatactcatgaggagagagcaaaggatgattacggctctgtatggatacttctagcagagaggggatggggaatgagatctagtgcccacatggtgggttggcccttgctgggaacatagtcattggagataaagcagagcatgcaggcaaacatgcaactccacaggcggggttgtagaaatgcctggatgttctctgtttgcctctattttctcaatgacacggaagcaagttcactgggggagcgtgagatgagaaggggttatcagaggattaaggagggggagatggcacagaagtcttttagaagagtggaaaagtgaatggaagagggatatttagtgcgatgcctgggcagcaatagagggccagttgaccatgaattgagggtgagactggccagtggtgtcctgcccaaggtcagcttatggatgtaggtacaggaactagacatcaggggttaaagatgtaccaagcaaatatgataaatattgattgaatcagattaaattgagtgaaacttgtttcctgtcatcatatagacatcagagggccattttctcttggaatcacacgcatgtcccaccagcgttttgccatctttaagacaaaatccacaaaacccagtatgctgaaatactcaccgcccttcaaatctgtgttttaaaaaatcaaacagcgctttttgcatcatatctgtgacctgcaattgagcaagcaataaattaagatatgaccaaaaaaaattactaacgatgataaaacaattttacttctcttaggaatgcttgaaaacctgagctttgcatctggaaagagtggcaatatgaggttgccgcatttttctgcttctgagttctgatgcaatgacaattaaactgaacttatcatgatgttttagtgacaaataacattgcaagtggtttcagtcggtctccatttgacactatttcctggactgagtacactgcagctagcagaaatcttcaaagcaacagccaggtaaacaaaacagaaaaaggacgaagcagtgtataccagtttgcagaacaacaggctttgctgctgtgagctctctaagctctaaagttggctccttaagctgtaaaattcagagagagggtcgggagtaggaggcagcatcacaaagaagttcagcatgcaagttaagcttcctgtggaaggctgctacccacctcgtagcccttcagagaagggcccactaggaccactggtcgcatggaaggtaccacatcatacggaggagtgtgctctgtctgcagagagaggagaggcttttagacgtttcacaggcaggtagaacataaatattttgtgtataaggtactctttctgaactccataatatgaggcactggctttccagacattttattttccccacttgcctcttttctacataaacccagtcaaagattggtgggttcattttcctgaagtttcaagttactgttgtctacagtcttcttgctcatctcaagaaatgctacagacctattcgttcctaaagcaagagatgctgcttttgaacaaaaactagttgacagaacaaagagaaacatgcctcatgcaagataggtgctttaggcttgactagaagttaatattgcttttcggctgcatttgaattttctaaagagttgtagtgattagacctaacatggttaattacagaggaaagaaagattgcattacctttgcatcttaggtttttgtcttacctgtgtaaaacctcatttcaaaatattataactctcactaccaatactttttacctaatctcaaaatattgtaactctcactactgtcaaaattctatattattgtgagagtttaaatgaacatgcatgcttattttagtaaacagtaatcatgatccctgctcacagcttagtgattaatgctattgaattttttggtttctataccttggtacttcaaaggtaaggtttatgtgtcttcgagggaaggtgattaatgtataataatatattcaaccatgctattgtggtctcaaaaggttcattatcaatgtgcatatctaatatgattctcaaaagtagttttctgtcagataactaatgacatctttctgcagtaaattatttctttttaataagaggggaggagctaaattttgtagcaatttctaaaactgtcaacacttttcaggttaattgcttcaaataaaatggtaaaataacatctttccaaaaattaggtaacagcaaattggtttatattaaaattggctcttttgatagcataaaatgctaaattgacccaaaaatgactttttaaaaaaatgcataagagtgatatggccttagacactgcgataagcaaatcattgctatatgaatctttctggctaaggagtgtcaaaaaatataacttgagaatcacacacaccaacagaaaaatgttctgtaaatgattttaagaattcagtacactgatgtgcagatatgaatgtcatttttgcatctgcccgtcactcaagaacattttattgttgcttaaaattgcccattacaaacttttctggcttcatttgaattcacattgcctcaggggagaattaaaaagcatttcaaattcaaaagcttccatctgagattttacccgtagtcacagacgatataatcagagggaagaaaaatattaccatgactgtgctgtcaaatttcactgcctaaaatttcacctagcattcagaattaattttaattgacacaatcaaggtagaatacagttttgaacagaaaaaaaaaaaacaagacaaacataatacagtgacagcacacgtaccacacaagcaccactctaaaagcaacctaaaacatagaaaacgatcttctcattgaatctcaggctgttgttttgtttttgaattctacattgatgttaaccacattatcaataacataagaagaatgaataccagtgccgaaggcatcataagcatatttcttaaactatttcatttataccacctgggatcatactgaaaacgtttagaagccaagtcctgataactatgcggtgtaagaacaccttttccaccgttgaaattatgaatgtaaatttcctgcattttagtaacagctaccaagaaattttatctcaagactttaattctgaagtggcccagtgtttgataggtctttggttccttcgatctgtaactgccaactagcaaagggtcacccgttgctggtaatcaatcagcttcttaatcaatagggtagctacagaaattaccttatttgatggaatattggtgctttgtgccctatgaagaatgacgccatcatttttatctactcttccctgttaaccccatttagcttgattttttttttcttttttttgagacagagttatctagctctgttgcccaggccggagtgcagtggcatggtctcggctcactgcaatctccgccttccgggtttaagcaattcttctgccacagcctcccaagtagctgggattacaggtgcctgccaccatgccaggctaattttttgtatttttagcagagatgaggtttcaccatgttggccaggctggtctcaaaactcctgaccacaggtgatgcacctgcctcagcctcctaaagggctgggattacaggtgtgagccattgcgccctgcctgctcaaattatttagtgaaaaaattgtgataaaagtttttaaagttttagaatttaaaggtaagcaaacttcacaaacctatcttgacaaacagggttttagctcacattcctgctccgtcaaggcccaaatgtcttagcgatgccgattttctaagcttctgaatgatagacactgttagtcacttggctgcaagctttagctgtaacaagaagatcggaccccagaaatgggcccactgttgtgggtgaacatcaagctgaggctatgttaacacaaaaatccaagtgttgcaatttttgcccagagtgctgaagttttcccttattaaaataatcataattgattcaaaaaaagccaactttacagttctgtatctgacacctcattaatgacttgagttcctccacaaaccaaaatacatgtttgcagaggaaaagtgttcattatgtggagagtttgggggcagaggatagacagatttgacatcacatctgcgtgtgagaatatatccatggttttgccagacttggcgacattagtatgattctaaaagacagcatggtagctgtggaaactgatgggtaaaagaggggaaaaaaagggaaatttggggggaggttagtggtccttaaaaaataatgctttaaagctacaaaatgggtgaggaaaaggctttgtctgaagtaaggagagctcaggaataccctatagtttccatttaggggacaaggagcctcgctgtgtagcatcttggatggccaatggcaaaggctctacgcatgaccactggctgcactgtccaaagggtgagatggtaaaatctgactgatggagaaggcaagaacatcgggagaatatttatatatgacaataggaaaaactcacagtaaaccgccaaaacaagcctgcagttttccactggtcttgttcatctgcagattttgcacctagtggattagaagtttaaatactgactaaattaaaacttgaatacttttttttttagtacaagctatgtatctggatatcataagtcagaatttaataactgctttaatatgtttgatcataagttaaatttctggataaaagaaagagatagaataagcatgcacaatttaggtgcattatgtggagctgtcagtgtttgacatccctgaatgttgaaacaaattcccttggtggtagatattattccatcaaaaaggataagtactgtaatggtgttttaacaggtcactccctgaatttagttggtttgaaatgcatgaactcaattagctgttgataggttctttgcttgggacagaaatgattgtatttaatacaactgtgggaattaatgctaatgatgccagtggcaggataaacacagcttatgtcaatgtaaacttaccgatttctgcttctgcttagctacagcagcatggaaaagaaacaaataacagagcatgcacgttattggcttatcaaaggacgcagacagtcaacaggactagaaatgtgacgcagtgcagttgagcaggtggacaatgggagcttggaagttaatgttaccttcttaaagaagggcattcttttctctttggagtggggtgacgttacactgtttgcactgggtttaggggagcggtggtttgctggaatatcattttcttctgcatctaagccagtagcatctatgtctatagctatatacagacaattcaaaaatcaggtggacaggagaggaaaaataggttataaagaaaataaaatgaaagcaaataaaactaaccatagtaaaaaaaactatcatgagtgctcaacacagtacgcaagaaaattaaatttaaaggtaaggcacattaagaatgcaaggtaatcaaatctaatgaaactgaaagatacacttataatctgtttgcttgaatgaatcagtttcatgctagacgtcttgaatattttcagagaaacattttaaatctgtagtttcaaatataatgttgattttctctgtatcaactgtataaaagtgcagtacagaacatttgacttcattacaatatcttaaaccagctttgagataacaaacaactactttgaaaacctttattataggtgaatgcaaaagtaattgcggtttttgcactgttggaatttgccatttgatattggaatacattcttaaataaatgtggttatgttatatatcattttaatgcgcatttctcgctttatgcgtttttgctaatgacttattacttgctgtttatgtttattttagactatggaaatgatgtcagacaaaaagcgaatttgagtgactttcttattcgagttcaaaatgggtcgtaaagcagtggagacaacttgcaatatcaacaatgcatttggcccaggaactgctaatgaacgtacagtgcggtggtggttcacgaagctttgcaaaggagacgagggacttgaagatgaggagcatagtggctgaccattggaagttgacagcgactactcaagaacaataatcaaagctgattctcttacaactacacgagaagttgctgaagaattcaacattgaccattctatggtctttctacatttgaagcaaatcggaaaggtgaaaaaactcaataagtaggtgcctcatgagccaagcaaaaataaattgttgtttggaagcatcttctcttattctgtgcaacaacaatgaaccatttctcagtcggattgtgacgtgggacgaaaattggattttatatgacaaccactgacaaccagctcagctgttggactgagaagctccaaagccaaacttgcaccaaaaaaa

SEQ ID NO: 191 - DNA, 99706 bp, Homo sapiens
atggagccgtggtcctctaggtggaaaacgaaacggtggctctgggatttcaccgtaacaaccctcgcattgaccttcctcttccaagctagagaggtcagaggaggtaagaaaaaatggatttggggaggtgggagattgccgtcggtcctactgcttctgcgcccctccccccactttacccttcctccccgctcttcaagaaaaaaaaaaaaaagcaattcccttaaatacaatccagattgtagctgctaccaggttggaattggaaactggagaaagagatgaatgtaggcgggacaataaagggagacgaggtaggtagcaggaaaaaaagatctgtcaggaggagagcctgctgaaaatgcccttcaccactttccagcctctttgaaaagaggaaaaatattaccttgaacacaagggcagttatacaaagcttttgtttgaggcacagtctttagactgcccttggaacacatctggtttcttcagattctaactaatgggaatatctttttaagggtgagctgaggagaaaatataaagggtataaaatgaaccttgataaagttctttgtctgcaaccaagtgagaagcaggctgttttagttttggggatataagagaaaccaggggggtgaatctagaagattaggaacactctgtgtgtttggggggcgggggagggtcaatctattttaagtggacaaaaattggcagattattaggaataggttcaagatagggagaacactttcccctgaatttcagtgactccccccaccccacccctccgcttcttcttgcaggttggacgtgcagttctcttggagaatgatgaaagtcgccaagcaaatggggtgggggcggaggactagggattgggagggaaggggagggggtgtgggtagggtgggaggagagaggtaaggaacagttcctacgtggcaccaccaaatattcaatggccagacctgctcggaagtctgcaaccctgtcagtacccacggagggagagcgacttcactcctcccctccgccttctccctccctctttcccccgccctttcccgaaaaggcatctggctggagcggtccgttaggtgccttagaatcgactggcaggcgaaagcctttggaggtcagggagcccagacagcttagagtagaaagcaagctttgtgaggagtgcagaaagaagctgggggataggaaggagggtgactgacgaggttgggtcaagggagataaaaatggtcaagcccaaatgcgtaggctttagcagaaacttgagtgtggccctgggtctagatgccaagatctgagctctccctaatgagagtcagccctcccggaggccgatctctgagaccaggttattccttccacacgcttagtggctttcagcttcccgagtagcaggcagcgctagattattcccttgggtgacttttcctgctaaatacagtgaaagtcctattaggactatatttgaattttgaaaggagttattatgttgattaattatgttgattcattcatttccacattttcaaggatagataagagtgtctttgaaagtgaaatccatcaaaaagtttgtattttacttttggtacctggtcaccggttggattggtcaattctgtcagcagttctgccctctgctggttttgtttattatttagaattcctgcgtctaccgtgggacatgaggcctctgtaagtccctcttaactacagtggtactggaaaaggacctttgattaaggaaaaatggatatgccatttctttttcagcatgtcacacacgcatgtaaatgagaatattgtaatggcagctatttattgaaaattataggaactgagaatttcttcggtgatggatgaaatacaagctccgagagacacttttgcatggattcagggattattttactgaagctatttatttttattttccacattgagcctttctgtggcgatatgtgaatattttttaatatcaaatttctgtacttttcatgcataaattttctattttcagtctagcaacatacctgaaacacttttaaacagcatcccagtaccacatcaaataaatggtgggaaaacaactttccctatttttatgaagccaagtaatgatagaaatagcaaagtataaggattagattttgttgggtttcttcttcatgaaatgccctgaaagttaagtggtagtttagatatttatattttaagattttgttatgtgttttatcaagctgtttagtgctcatttttcctgggaggccacatattaacataaatccacttttgtaggcattcttatcccttaattaacttcaaaaagggaataatagtatattaatgcttaaaaagaaaacattggctacaaatcctgaatcaccacacaagggaaaaataaacccagtgtccacttctgataataacctttagatttgtggttgaagtaagattttataccaatttctaaataaagatattatatcccagcatcatactatgacattgatttcattgaggtacagtgataagatttggatattaagcacaaagataatttaaaacagatactacttttatataaaattaaaacattaaaaccttaaaacatctgagttcaaaacaaagttagactctaaagaaaataatatagagaaatttcttggaagtgaatggattaaagaaaatttatgacttcatacctagtcatattattttactttgaaaaatcaaactataacttggaaatatttattatactcattaaaaatcaatccttgctgtgatttagaataacaaggttaagtgtgatttttataaatatttatttacattaacttcaattttatgtttcatatatatgtttatttttaaagtaaatgatgtatctcagcgatttattgatattctttggcagttagtccattacttactattcacaggaggtggggtttacctggaattcatagtgaccacactatgattatcttaagatagatgagtttatgtaagggttttaagtaagagttagacttagctataatgaagcactaaaaaaaaaaaatctaattgaatcactttttactaattaaaattacatttaacctttggcagttaagccaatactgtatcttgtaaaaggctgatcaaactgggaactttggaagcttgtcaggaatcgatagtgagccctgaagaagtgtagttttgagtgcccaggatcagcaggtgaaatggtcctggcttccagagtatgtgctagtccaacagtgcaaagagatcgaatttgtccatttggttccttaatcagaaatcagaaactcagatatgcttctgataagaaatgcagtgtttgctaaactcattaatattatgtctttccatttgttttttaaattcaaaattgatcaggactataatagagaaagaatatagactaaagagaaacacctttctgcatgctttacacacatagcttcagtttaggtggcacagattcttttacctagttgtccattagttttgaaattaagtttcttaatatcttaaagtgacaatttgcttcataattaatacttaactgaggggatactttatagaagttattctctaaaaggtatttgtatagttttaaacaaagttatgcagtagcaaagtgagaaatgtatttgcataacataattggtaaaaaattaatattttttcggttttttattttcttcaatttgtgactaaaatagaaccacatggttgttcatgttaagttatccttaaaatacagcaaagcaaacatctcttttcaaatttatgggttggctttctagctaagaaaattgtataaagagtcacctttcttttctaaaaatttgctttttcctaggataaattctcttcactctgattaatttagtgagatgctggctatttcatgataacaaggatttaaatcaagtttggttgagagtctctgtgtaatacaagctgaatttttaaaaggttaaaaaaaggtgtttatataagatttttaaaagagaatgctagcactagaaattatagaaattgctaatcaatcttaccttctcaataaatgaggaaactaagacacaaaaagttgtcagctgaatactcttcctcataaaaaatattcttgtaatattcaaggtttttctgagtagagtgaagatctgtaatggtgatcaaaagaattttaaataatagaagtctgagacaatggaatgagaggagagaacttagtagtgcaagttctaattaaagttttattttggattgtcaaaacacctgaaactaatgtaagtaccttttagctcaggaaaaaattgacatttaatttatgggaagtactcactctcaatggactaccatgatatctgttgtgcaatcaacaactattacaaatttaattaccatatgtgaaattacaaggaagtaaaagagaaagaattcgatatattatcgctatatttatttccagaagtctgaaattattagaccatatatttgctagagtttagattagtgagaaggtagatatagtgaaaatgtcttatataaagaaatttaaatagaaaatagttacagaatgaattttttaaatactctatttactacctttgaagaaaggtaatttttgatcatttgtattcttaattatgtcattttataagattacatcaaagtagaaggcgtaatactctattcattgctggattaagaacatagttttgtatgctctctaaagttgttaatagaagactaggtccaactttgaatttctaagaagcttagaaaattatatatttatttcaaataaaaaatggcaaatttctgatattttcaggttaatttcaattgattggatgacatatattttatgtatacatatagtatgacttttattaatgtcagataatcattatgacacacttgtgtgttgtttgtttaacagtttttttttaaacaagtggcaaactgaagaaaaaaataggagagaacgtagtagtgcaaattctaataaaggtttttattttggattgtcaaagtatctgaaattacataagtatctgttagcttaggcataaatgggcagttaatgtataggaagtagtcactcttagtaggctaccatgatatctgttgtgttgtcaacaactattacaaatttaattaccacatgtgaaattgcagggatgtaagggaggaaaattttgattttctatctcaaaatttatttctagaagtccagtcttcaactagtattcccaccaaattaagagtctttctgtttttagggaaaagcaatacatggccatagggtcctgaagattatactgtgaaagcatttatcatgagtttttatactcacaattaactataccattttatgtaaatatggagtttaaaaaatgctgagatatctccatcattgtatacaatttttaatgattatgtttaggtatttaaaagccagaattttattagatacacttttattttctccttacttttggagaagtaatcaagcatggatggcgtgatcattaggaattcaaggcaactgcaagtggggactgagcgttggtcagcatttctgcttttactccttcacttccctcatgtaatactggggaaatgtgacctgagttgggagtggtgagaggaaaccaaactttttcttttttgaccattcaagttttgttccttagcaaagaagagagataaacgctgatgttataaaaagttgcaatgttccctaagttctttcactaaagagtcaactttaaatgcagttttcagtgtagctttcagtatacactaacgcactttctacatgaggacatattccttctaaattctcttgcaatttaattcaaaacctaaaggtattttttttccattttaaaatactttctgttttagaatgcatctaatgtatttctttctccttccttcaaaaccctaatatggttttattgatataggtaagtgtattcttttatatgttcacttgtgtcagaactcaacatgaataatactagcttgtagcaaagatgaaagacaattttaaagtgatttagtgagtaatatctatttatcagttgcagtctttggcctactactaacttggctagtggttctttagacattggctgatcaccagacctactgttatctggtaaaataaactctttgcttgctgcgcatggaattagagacagtgctattaatttaggagaaagaacttagagaaaggaaaggttatcatatttcagagtaagagaccagcttaaatacgacttgacaattgagaactaaaacaaacctgtgtaaaagtgctttagcacaattaacttttgcaatcccctcaaatcttcttttttttttttcttaaaaagcatttctttcttattttaaccaaatttaattgctcttgaatggctctgtactgtacaggcaaatgaagctccctattcatagaacttgagtgcacagagtatcaggggaagcttccttcctctgtttgactggtaaactgacatccgggcttaaaggagtgaaccttagactgtgtgaggtagttggctttccttcctcactcagattttcacatagactccctgaaaggatgactgccagaaagagcagtagcttgctaataagaactctagtgcattttcatacttggtgctcttaggtagctctgcacagaaagaaaaaaatgtaaatattgaagtggtgtctgtctttcctttacttctgtctttagagtctaagagtggagctcaacctactgctgactgttactcttccttttgcatgcaaatgaaacttcaattatttcactggcttttaggataagtttgttgtctaattgggttagagtgcccttcaggatgtggcatatctttatgtccaggctcaagaccagccatttcccacctccccaagcccatttccatttaccttgcactttagtgatgttaaacctcttgcctgtgttctcccctatctttgaacactcaccctggaatgtctatctcattctcttccatcagcaaacaccttctcctactttatacttcgaaatttaagtaaaatatcatagctccagaaaacttttccttatatctccaggtgagccctaataccaaatacatgctcagtatgtacaaggttctgtcatatgcactttcatagagaatcttatttaattgagacagttttcctggaagtaagctgatatcaaaatactgattttacccatgagataactgaaaaacagagaagtgaaagattttgcctaaagtcacacagctagtaagtagtagacccagaatttgaatgctgccaagctttctccaaggcccttgcttttggccacttgtccatgttgactttgctgggtgttctaatgcttctatacagcctcctaggcttatcttattattatggtgccctggggcctaatattaatgtacacatcatgcagctaaaccacagaaaataccaggtcattgggtgaataacttgactgccttcaaggagaaataaaaagaggttctggtaaaaggtgatgttagaatccagatagctcttcagcctgcacttaagttcagtggtagagaccatattactcttaccattttatggacaaacctcagcctcagtggtagtggaggattgaaaggggagtttctgggagccatcaaatattagttttgttcctttgattaacttaaggagaagctgacagatgtatctgttagtattcaaagttccagttgtggttggcttggtttcattaagtaaaagaactcttatagatcattgcttgtcctaatcaggatccattataaaggtcatcaggacttattctacttttggggattggtgtatggaagttctcttaactgtcttcagcataaaaaatgtcagagttgattatccaaaagcttttttggagtgtaatcaactgagagaatgtaacatcattattttaaaaattactcacttatgtcagtcttcttctaggagttcctgggtgggtagtgactgtgatctagttttatttgtgtccccagtgtctaccatggtgacaaaatacacagcattgatatagtaactatttaggttaattatattctttttttacccagaagactggaacaagattaaaattgagttagcttggaatggtgtgaactgaaagtttgaggacctcctcagattatgctgttggtagtgacatgagtagtgactcctcttttttaaattcatttgctaaaagtaaataaatttcaatttacctctagctttttcatatggaaaacagttctgcattctctccaaaggtgccactgaatatttgtagctacagagtgactatattacctccaaaactttgttttgttaataccttaagatatgtagtggtattgaccgtagcataaatcatcattttacttttctactagtgaacaagaaagtttaatctgagaataatatcaatctgtaaaatcgatcattggaaatagtcctctcatatattcattattgaacctttcatctcagattggtatgctattggggattagttgtctgactttgcttattagctattagaaatagcagtttatccatatataatatatatatatatatccatatatataatgtatggatgtgtgtgggtacatgtgcatgtgtgtataaataaagtgctttatgtttatttcaataaactcattcttcaagttagaaagtaaattatatgttttatgtatattggaattattatattatgaagtaccatctccaaacaagaaatatatagagcttcaaaatgcttaataagattaatagacaatagttgtaaaattcttttggaatatagttacatagtttttatactatattgctatccatggtatattttagttacactaaaatcactggtataggtatgtttatctgatttatttcatctagaacagaatccatctagaacagaaagcatctagaacagaatccaccacatagtaggcatttggtaaaactttgctgaatgaagtgagggcgttgttgacattgctaatgacttgattgtccataacctaaccacctgagatgtgatatatagctatgtgtatcacctactctcaatgtctatggaagtatcttgaaccaatttctgctgatattattgtgatttcctgagactatcagtctctattttggttctaggccaacctatgacctctaccctaagcactctcccactttgttatttctgaaagtaaaaatcctctttgcttgagatttagatattgtctccctctagaaataactttcttcaagcattgaagattggggtagttagcctggcataacattataaagcacactatacttatccaaaactcaaatacttatctcaaaatatttttgatggtataatgaaagcaggaaatacatctttttcactgatgcaaaacattctggcatctgtcaccatatctagaggaaaatagatagccagtaaatattttttgaatgaatgaactcataagcaagatattttcaataaagtcaagaggactggggtccgtggcttagtatcataattatttccaatcctaacgctggaaattttgatgaaatagattttgtatgacatcaaagcatagatgctttataaagtttcatagataatgttgatgcagaagcaggggtttacaaaccttctgtaacaggaaaccaatatataaataaatagaaatgtatctggcttgtataactaggcactggaagtcgagtgaaaggctattcatcataatgtacaaattatttgataaatatgctattgctaagcagtagtggctctgcaataactgagttgaggagatcaactaattacaatatagaaaatgctttcttttaatccttctctccagagcatgtaataaactaaatgccaataaatattgctcttctcagtattaaagtcaaatggttatattggaagtataattttagttttataatacatcttttttttaacagccttggctatttgtaaattagaaatgctgtacttttaaaatgtcatactctcaactagtttttgttcttttcttcaccatactcagagttgtgatgccatttttgctttccactttcaggtcaagcttttatgatataaaaaagttcaggattgagtctgttcaataactgtaaaagttaaatgactatcttctatgttaatcactgtgttaagtgctgtggctacacagacaatatgatgatctctattctcatggagtgaaaagctaattaatacctgcaatcattcatttacttattcaacaaatatctattaaatccctattaaatgctcttcctgaattctaaactaattcattcatttcattgccacgttcgacaagtacaggttaaaagctcattatatgctaaaggtagttggtgggcaaagatagttataatcctgcctcgtagtgattatggtctacttgaggagacagtaattaatcaaatagtggtacaagtaaatataaaactacagctatgctagatgctttgaaggagaggtgtatggttcctggagaatacaaaacagaagtttagtaaagtcgaagaaaacttccctgagaaagtaccaattgagcattgattaattaactaaagtgaagaggaaagagcattccaggaagtgatgtgaaggcctttatgaagggaggatgacaccataagggacttgaagaaaggacttgaaaaatggcagtatgtctggagaagaagcagtggggataaaacgtgagatggtgctggggaagaaggcgggggacacataacacaagatcataaagatagatttttctgcatagcatggaaacatgtcactaattaaaaagtacaaggaaactgccaagttagcagggtcagtgcatacttcgatatcaacacataactaggttgtcccagttgattcctaccattggatcctctgacagtcagtgaactggggccatgttgttttttctggaatagccaaccctactgtcaaatcacttggggttctcaacagtaattagtacatttaagtcacactttatatggagctatggtcatgtagtcttgcaaaatatataagtaaacttccacttcataagggagtatgagaaaaatgttaaaataaaatctgctataagacaaaaacataacttagcatttctaaaccttatgtgactgttcttgttattaaccaaagtatatcagcttttagaacaaaaattgcaaacaatgatttttgtttcttaagattaatatatgaggtcatgatctctattttgattatttgagatgaccaattgtttattgtcagcatttttttaagtcttaaagttctctttcagtggaaattattcaaatagaattttaaagtaatcatgtcattgattgattaattgtagctctggatagcattggtaggctgtcaactcctaaagttttatttctatcctgctttaccctgaacttcagacttgcatacttgactgcctactcaatgatttctaacagtatttattaagtcatctcacatttagtatacccaaaactgaattgcagaactcctctcctgaaacctgttcttctcacagccttctccatctcacttaatggcaacccaatcaatcatgatgttccagctacaaatcttgaactaagctttactcattttctctcttatctccttttctacctatcagcaactcctatctgctccactttcagaatatatgtagaatctgacccttactttctgtctcagtctaagaaagcaacattttatatctggaaaattgcagttacttcctcactgccgcctgattccactcgagtgagcctagagtttcttctcaacacagcagacccagtggtctgaaagcataaaatgaatggaaactatctgcaccttcctctcaatttttctgtaaacctaaaactggtctaaaaaaaaaagttgattcaagtcatccttctcccctaaccttccaatggtttttaaatctcatttagaataaaatccagtctccctgaacattccacaggacctatacagcttgttatcagtgtatcctcacttttacttctctgaccacagctctttcactcttgttttgtccatgcagtcaatcttttttatagcagtattcacatattcacatagagtacatagaaagattttggcttttatataatacagagtttaaaataactttacagggaactaaatttcttcaatctgaagttcagctatcttttttttttgttaactttccatgctctctatccaaactgaacaatattttctgttacacaaatttacatgagaaaatatccaatgtacaaatgaagggacctgagcaggaaagagagccaaaatattaggaagtgggtatgggggataattttttgaaaaaagatccctttgttgagacatatttgtctccttgcatttctttcaacattctgggccaactattgtctcgggttctttgcacttatttttccttttgcttagaattctgttctgcaagaatagcaggatagaggaacttcctatgactttctagactttgcccaaatatcattttcttattgaggccttgcctgttctttttatttgatattattttccaggcctttgcaaccctccctataatctttttatgattcattttttccttagtactaatcaaatatttttcatatagaaaatgatggtgcatttaaagatactgagtttgtgttaattttctatgtaaaatgtaaaattagataattttagagtataaatgttgccttaaattatttaagcttttagatgttagcagcatctaggtcatctatatccaataattcccatagtttgttattccattttatgcagtattgacatacatacatagtatagtcaatataagagccaaattctacacagtaaagcattttttcttatttgatggacactatgcatgttaattcaggtgttctgagaaatgacagctgtgtagaaatggtaacggcattttgtactttgttttgttggtttaagagagccatggtgatggctacctagaaagtagtattgcccttaatcaaagataaattcagaatcatgtattttatgtagagttgacttttgaccaacataagagtaagaggagccaactccctgtgcattgaaaatccatgtataacttttggctcccctaagacttcattactaatgcctaccattcatgggaagccttattgacaaaataaacagttgattaatacatattttgtatgttatatatattttatgctgtattcttacaatagagaacagaaaatgttcttaagaaacataaggatgagaaaatatatttagtattcattaaatgtaagtgaatcatcataaagattttccttatcatcatcatcatcttcatgttgaggaggaggaggaagacaaggggctgatcttttctcagggatggcagaggcagaagaagtggaaggggaggcaggagacgcagacacacctgtgcaactttagggctatacattgtaattggtgtctgactttttgcttttttgtatctctaaaaaatgttttcatatggtaccaatccttcctccactgtttgctttaattttagttaccatatcatagaagggtctatgtgataaaagaaggcaaaagcagtcttgaataatcagaccacttctgccagattgtctaatgtcaatttgttttctgacactgcctcttctatttcttcttccccatcttctgacactggtttggaagcattcatcctcatcaagttgtcttctgctaattactcttgtgtggtgtctattagctcttgaatttttccaagatccatatcttgaaaccctttgcccccacacctccacattttttttccatatccacaatctctttcctgatttcctttattggctctgctgcaaatcctgtgaagccatggataacatatggccacagttttcttcaggaggaatttattgcttcaggcttgatggctttcaaggctttctctgtaacaatgatgacatcttcaatggtgtaacccttccagactttcatgatgttctttctatcagcgttctcttccatagcattgacagtgctttccatacagtaccatgtgagtgagccttaaaaatccttatgaccccatgacacagaggttgaattagagatgtactttggacaagtagaccacttgaacacctttgtcattgaattcatggggttatgggtggccaggggcattgtccaatatcaaaagaactttaaaaggcggtttattactggcaatgtattttccaacttcaaggacaaaatatcgacagaaccactccagaaaaagggttcttgtccaagccttcttgttgtactaccgaaagacaggcattcctgtttatcttttcccttcaaggcttggggttagcaactttatagataagggatgccttcctcataaacctgactgaatttgcacaactgtagaatttgcctgtttcttcttaccttaaatcctggtgctcacttttctttcttactaataaatatcctttgtggatttttttttccagaatagggctgtttcatatgcatgaaaaaacctgttcaggcagctattctttctcctcagtggtttttctaatggtatctgggaaatggtttgctgcctgttcatcaacgaaaggtgcttctcctgttatcttgacatttttaaagcagacctctttctaaaattatcgaaccaccctttttggcattaaattcttcagctttagattcttcaccttgcttttgctttaagttgtcatataatgacttcactttttcttgaatcatattgaacttcatagctatataatggctttctcatagccaccctcacccacataaagctgcattttcaatataagattttaaaaaagatgttttgcaaaagttcaaggcttttgcacttactggcatagatgcagtgatggattcatggatttcctttcttttcttttgtctttttctgtttttttttgtttgtttgtttttggaacaatgatccttatgctggactcatttatcttgaaatggcaggcaaccacagcagacctcaatctacagtacatatcaagcaattcaactttgtgtatgtatgtatgtgtgtgtcatgacttttctctgcttcttgggagtatgtgaaacattaatggtacttcagataggttccctggtgcttttcaaggtttacaatatcgcactaaatgtgatgaaaagcacacaagaaacatgagagatcactttttacagagataggcaatttactagagagatccactgctcatgtggaaatgatatttaagcagatacttgccacatttgggttcaccacaatagcaacaggaggtggctaacaaatgattacagtagtacagaatgcactacacttaatcttatgcagttttcatttattgctgcatctttatgtttgtttacatttctctccactatgaatggtgccatgtgtaatggtgccatgtatgatctgtgtttgtgtgcataagatttgacaaattttgactttttatactttatttgtgcctattttatggtagtaaaccataaaagacttgtatctacatatattttgtgcattcatgacatacttaactttttcttaatgtttttgatatttttagcctactttgttcttctggaaggtttctcaaattgtcacaaatctccaaaaatgtgttttaaatttatgtattgaaccatattcatacataactggacctatacatttcaaattagtattgttcaagggtcaactatttctctcaatccctaaataggttagaattataaataggcaacaatgggatgctgatacaattgattttgctggaagtcacactttttcattaattacacttcagaatattttactatgtatttttattgacctttctaattatgaatttcactatgcagttcattttgttttaaactggaattttcctggaattgtaagaaaatacatttacatttgttcactggatttctattttctgaaaagatagtactaataggcttgttatgtgtttggtttgatgaaattaactctaaaattcctaaaactccaggttactgatatatattgtctttcttatgtcattctcagtttggtgctcttcactgtttgaatatgaaatacgcagtttttttcaaggtgcctatcaaaatcttaagccattttatgccaacatttgtttatttatagtattcgtgtgtatattagtgtatatgtggagaaatatattaagtaaacagagcattattaatgacaacacatcttagttgattataaaacccttcggggaaaattgaactctaaataatattgtggaacacttcccatgtcctgtagtaattaatgtaaactatacaactgtaagggcttcatatataatcttacaatttactaatgtattttagtagtttatttctttaattttgcacttgtgttgactacaaagattagattgtagcatacaagtcaaacatctggtaatttcatccaaaaagggttctattgagggtaggaagtttatgtaatttttattggcattatttgtgtgacatcatcatttaaatatgaacttctgtatcttttcaaatatgggagtatttaagtcaatgtgcttaattttctaatattttatattcatatataattcatggttggtatgtggaatatatgtatttacaataaatgaaagaacagtgtcagaggaaagggtctacaatattacatttttaaatctttaataaatagcttagatgaggcccgctgtgtttaagctatagttatatcaatttctatgcaatgcaaagaaaaaataatgaaaagagaaaaatgctaatgatatcagtgtattaatgtccatttgtactactagggggtaatgaagtgctgagcatgaaaatatagatttaagatctatttggttgcttaagctaaattccaggaaacctcctgaggttgtttgcatctggaatacaatatgaacatgctgaagagattgctaagcagtacataatttttatggatgattttgaatggacatttagagatcaaaactgtttagtattctactcaactgcagagaactttcccaaggtagtctgaggaagcagataacaggaatcaatttaattatagctctagggaaatgtggatggtattaaagatgttcagaaaggtagacattttcatggaataataattttagataatatttttattgaatatgtattatgcattagacaccattctatgtttaaaattccttacagcgtttaattctcaaaatgagactaaattgagaaaactaagtcttggagaggtaaatagcttatccaaagtcatagaaataataactactgaatttggattagttgttgggcagttcttactgtggaaactagttatcaattgttgtttataggcttggcatgtcccagtttttagactctttcttaagagccatcatgattttgaaatatagcagaatattagtagtaggaaaattataagaaataatcaattttctatccttttctcttttgtcagtcctacatctcactaccacatgctcatagtagcaatactggttttttgactgagtggaagatggctgagaactttcttctgtattattttatttttattagttccataatggtatgcctcacatatagtctgtgatgtgaggtatgggttgagaataagtgactctcaagaagttgggaaaatatctacattaggaaggctactttattattgttacttattttattttattttattatttatttatttatttatttattttgagacaaagcctcgttctgtcccaggctggagtgcagtggtgtgatctcggctcgctgcaacctctgcctccaaggttcaagagattctcctgcctcagcctttggagtagctgggattacaggtgcatgccaccatgccaggctaatttttgtatttttagtagagacagggtttcgccatgttggccaggctggacttgaactcctgacctcgtgatccacccacctcggcctcccaaagtgctgagattacaggcgtgggccaccacgctgcttcacacctatattcttcccacacctgaatcaaacaatggcaacaaacaaacttggaaacctcttcaagttcttggtaaaggtcacttccaatcctcttcctttcccatctcaaactggtaggaaaaatgcttcaactatgagacagcttgtggctactcatttattcatccattaaacatttctccattgattatttactgtgcttcagctgctatgtctttgcaatttgatagtgaatatcaatagcactgatgttcactgtcagagggtttacagtgtatcaagggaggcagatgttaaacaataaattacatgcttaacagagagagaaaaatattagctgatgtgagtatgtaacaagaaaatcatgaccataatttagacagatgctgtgcctgagagcatacagcctagagccaaagacataattaagcaagcgaacaaaatagtgtagggtgatctaaggggaaatacaagacactgggatcatataaagaggtcacatcatcctcttggatgagctaagaataaatctcctagaataagtcatgcttaggtttacactaaaaggttgactaggtctgaagccaccgagtttcaaccctggctgcacattaaactcatctgggaaacttaaaaaatatggatgtctgtacccaatcattctagtttattagttctggggtgggttccaggcattcataggttttataaactcttcagatgattctattgacaggattgaaaaataagtcaactgtccttaaccaattgaggaaggactggaaaaaatctacagataaagacagcaaggtacattttagaaactgaaaattattccagttctagtaataaatgtcaggatgggcgagtcgatagtttttattggagatggctcttggagtttgtggcagtgaatgcatgatgaagatatgatttttctccagtggtcctcagcagccatggtgcatccagggataatctggagagctaaattttctccgtgtccatgtctccttgggcaagcatggctggtttccttgaactctttactctctttgtatctgtgctaccatatctgctgtttctttccttctcttcttcactgaggaactcctatttatccctagggactcagcttaaaagggctaggtagtagatattttagttgttgtgagcacacagtctctgttgcagctacgcaactctgttgcagtacaaaagcagctatggacaatatataaatgaacgggtgtgactatgttccaataaaaactttctttatgaaagctgaaatttcatatagttttcatgtgtcacaaaatattgtccttttatttttcaacatttaaaatgtacaattattcttacatcatgtaccatataaaaataggcagcaaggaggtctatgggaggtctatacccacaggcacagatttccccaccatcattcgaaggcattgttacaaaaaccaatttagttctgacaaaaaaaaactctttgaagtaaatatttttgttattctcattgtactgatatagaaacggaggcccagagtaattaagtaatctgtccaagtcacacagatgctaagaggcagaggtggacttaagaagcagttttgctctttaacactgtaatgatgcggttcactactggtcatgggagtgtgcaaagaagcttagagaaggaattagagatgaaacaatcaaagtattatgagatgtttcatcagtaatctatatggatggtgaaggcaacaagggagaaaggatcaaagacttgggatcaaactgatcagtgaaagggtggtggtgtttaagaggtcaatagactacaataaaaagtacatattaggacctaaaaaaatttaatttcgacactagatagcctgaggatttcagaggaagttccttccatatattttcacattatcgtgtttcacattcaaccaacattttcataatctctgtgtgtttgtgtgtgtatacctgttccttactagtttgcaaaaattggcaaagacaaggcaaataattttaaaaaagtatgaaaggtgctataatagaggttagcagatctaacccagcttagggagacagagaatgttttctgcagaagatgcattaccaggtatattcttatccttcaggtgaggtggagctaagtgtttgaaacagagagtagggtttataaaggcccagaagcaagccagagaacatggtggattctggaaagactgagtttagtatggtagaacactgaatgaggacagaatgagggactcatgagagctaagactgtacattcagtgagcttagagtggtaggataagtgggagtgtccagatatccaagttgtatattcaaggaatgtggaaatcatctgagagccagtggggttctttgaaggaatttaaacatcagagtgacatgagacatggatttttggaagcttaatcaagttggtggaatgaagattgatgggaaaaagtatggaacccagttaagtggctattttagtagcacattgggctctgatattctattctcccgtttaataaacctataggtattcaataaaggacaggaaaatataattgaacaaaacattgtgctgaattggatacatctgaattgcatacacatggtttgtgccagcagttggcaacatagagataattaaaatattaaggtcatttaagaattgctttgaatatggacattttacttttttcatatatcatatttagccataaaattacttcttttaatctttgaacagttgcagttagcaaaatataaagaatagctttcccacatatatgtatgtatgcgtataaaacagtagaatccatttaatgacaatttattaaacgcaatatctatgaggattatgagatcaaataacaggcagaatttcaaagtagcttaattcattatttagttcacttgaaataaaataaacttaaggacttaattaatggagttttacttttttgtaacttgaaatgcctttttgggaaaaaaaaaaaggcttggttgatacctttattatatgtctctacttgtattgttttttgaggagtgaacacttggataaggtcatggtgttaaaagatacgttgttgccgggcgcggtggctcacgcctgtaatcccagcactttgggaggccgaggcgggcggatcaggaagtcaggagatcaagaccatcctggctaacactgtgaaaccccgtctctactaaaaatacaaaaaattagccgggcgtggtggcgggcgcctggagtcccagctactcaggaggctgaggcaggagagtggcgtgaacctgggaggcggggcttgcagcgagccgagatcgcgccactgcactccagcctgggcaacagagcaagactccgtctcaaaaacaaacaaacaaacaaacaaaatagatacgttgtggactttgcagtccattttatgtattatttacctctgcccaattgtgattatgacagtggggatgcattttgttttccttttcagaaaaattacagccttcatagatgtgttcatgtctatcctcaagtctttattcagttctactttggagaatggcttcagagcaaaaatataagataatttaagcagataaaatgctgtggttttcagaaacattcttcttcagagtcatttatatactagaacaagtaatgagtttagtttaaaataaatatgaacatcaggaatcaattagctggcccaaataacataaacatattatatgtatgttttaagtttatttttgcagagtttttattttggggtatagcagggtgagtggtgaagtggaaggagcatagagttggtatttacacagatcttaagagtaatcttagtttgttctctggttcttaaatctcaatctgcacaggacggataagaacatatggtttgtgagggttaatccctgtaaagaacttagtccagagactggcacatattaggctctccctggcagttattatgattagcattttcttagttatgaggtaagagaaaataacacatataaaacagatatcctattggcttaaaaacatagccgttgcaagcaggactagtgcaaaaaaatgttctcaaacatcattataatttttatatctcaggcatgctgaatgatatttggccagcatatggtctactctgaatgttttgcttgtttttgaatataggtatgaagccaatagaatataagtcaagcaggtcctcaaatactgttgttttgttcaactcgttcagtgataatgttgataagaaaaaaaaaaagtccgttcccagtcagggccactatgtggcgattacatgttctccctgtgcctccgtgggatttcactgggcactctggtttccttccacatccccaaaatgtgtacagagaattgctgtctctaaatggtcccagtctggttgagtgggtatatgtgccctaccatgagatggtgtcctgtccaggactggttcccgccctgcgtcctgaatgtttgggttgggctccagccatttggggccctgaactgggataagcaggttggaaatgaatgaacaaatgaatgaatgaatacaaattgttatcaaataaaaatctgtaaactctaccataattatccaaatgcacataataaataatgcagtacaaaagcactcagagctcatcatatttgtgattgattctgaactgcatggtgggaggacatgctccttacaattttcacttttcaaacgtttataccttaatttaacccagcactactatgaccaccgtcattcactgattcaccaaaaattggataaataattatttcatttttcattaatctttcttaaatgtatgtgtagctcacatttagttcaatgttcagtatgaaacgtgttttcagtctttatttagaagtttggtggtgtatttgtgatcagaaatagactgtaggaacttaactctggtttatatcagtgagcctatggtcaaattggtttcattaaagttgatttgctcaatgtagaagtttccaagagcctatcgaggatattaagtgaggacttactgtacattgagtaatatgggttctaaagtctgtttttaaaataatacttgaactgcattattcatgtcctgacttgcttagtgacttaaatatatatgtaattatggaccagacaacttgaagatctaaaaaagataaagtgtttttttttttttttctaaatggcatatttcatgtagtgtactgttttgaaggttgatccgtgttatagcctgtatcaggacttctttcctttttatggctggatacttttggttaatccattcatctgttgaaagaaacttggattgtttccaccttttggctattgtgaataatgctgcagtgaacattgtgttcaaatttttgattgagtcccagctttcaattattttaggcatatatgtgggagtggaattgctgggtcatatggcacttctgtatgagtctacttaaatgaaaattctcgaatgagtaactagagacagaaagtatataagaggttgtcagggggtaggaggttgaaggagtgaagagttattgcataatggtgatgaagtttgagttgatgaaaaatgttcagaaatagataattatagttgtacaatattgtgagtgtaattaatgctactgaattgtacacttaaaaaatctaaaatggcaaatttaatgttatatgtattgatcacaattaaagataataatagtacaatataccaaaaaccactgtttgcttttaagtgggtgttttgtatggtatgtgaattataacccgataaagctgtttatacaaatgggtcacacttacaaagggaaagtttaaggttccaaacatattttatattgaccacgtcacagtaactaccaagtacctggaatgaattagatttgggaaatttatgcttccactaaaaagtagcctagttttacataccctaagactacaaaaaaaatgtgaaggggcacaattactaaattactcatctccagggactttcagcctaaataatgaagtatggagtaatatccatgaagtgactggtaagttgagataataaaaatcgataaattacatatagatagatacatacatacacctttgtgtgcatatataagtacctgtatataatttgtaaataactaactcaggaaagcactgaaaaaggcattgtattgtgctacctatttttttaacacctttctttcaacttctcttgtgtatacaaaatgactaagtaggtgcacattttacagagtttacatataacatccattgtacatttgaatcttcaaaatcacctctgtttagattatgaatagtttattagtaactgttggaaaatgaaatatttacaaatgctggctttcactttaattctacataatgttattacttggaattattaaatattttataaattataattgagatacatatgaatgtttataaatcatatataggaaactttaaattccagatgcacatatgcctatgtacacacacacgcacacacacacacacacagacacagacacacacacacacacagacaccccttctgtgttgcttaaccataatttgattccagatttgagatattttgaatttgagaatgttgttatggtttatattactacctgctgccccactctccaaactcccacctaaatgttagggaagcatggcaagtgataaatagattcaaggtatgaaatgacatactatcctgtgttaaaaatactcattgttatatcagatcgttgttcaattctggttttttattgtttgcttatttttcagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtatattcactttattattattattgttattattactaaaagttattacacttttgttactactaaaactacttttagtatttctttactaattagtatttttatcaggttagataatgtgcaattatatggtaaaatgcaattctttcttatatcagacaccaaataccttgtggtcaccaaagtaatgtaatgaaaataacaaaaaatttgataattgccagtcttaattcaacacaatcacatttctgtgaaaatattcttatttgaacatttagtacttcattatttgtacataatatatggagacaacattttatatctagcctatttctacttgtaattaggtagagcttattcatcgtgactggggtataggagggaatctttccccttaatgactttctaagttaatttaatgggcatttgaatgtaaacatacttagtgcatgttttcctaacattaaggtaaatgtttctgttgaaagagatactttttctttgcaaataattttgcattattttttcatgccgctcttatctaaaatataagaaaagttagtcacatctcacagttatccctcctgaaactagagatttttttaaaatatcagctggcagtttttcataatggtactgaaaagtacttgctgaatatttgtttttccttccatgagagcactaattgacctaataacactaattatctagaaatcatgataatgtggagaaagggaattgagtggtgaaatgacaattttcgagcctcatattttcaaagcaggtaacttgttaactgtgcttgcctccatttgatacataccagttatctattgattggtcagttgatgggtgttctcatccttatttaacagaggaggaaactgaatttcacagaggctctctgacttgaccaagttatgtgcagtcaatatttaatctaggtctgttctgctctatatattttatatgtcatcaaatggtcctttctggcactttgggatcttctcagcagcaatttatcatttaaattcttcatattatcctatattatctctgcttgaggaaatttgagtttcctatcttcatatgaaactgttttctaacaagagaaaacaagtataaatcaagggattaaaacattacaaaacagcacagtacacttttcatagaaggacattttaaaatatattgaaatacatttattttgattgttcactgattcttccaatatattttctgttttgcaatactttgtggtgaacaagaacaaactgaaaatataaagaataaaatgaactttttttctgactttgaaaataaaaaagttaaagtgattattaaatccataaaacattttaaaaatagatttaaaaaaattaaaagtaaaaaggtaagctgctttttctatttatgtgcactctgctgcatttcctaaagcatccttaatagaaaaagggatgggaattttgaagagagtaaaacaaagaaaaatataccaattaaaaacctttagaactactcagattacaggttacaatttttatactttagctcattatctcagggtcagtgtgttctgcattccaatgtggtagttacttaaaatcattaattttatataactaattttaaatactatatatttaagtgataagagccatataatcaacattatctgactgctttctttatgatacagtctcatataatttccacaatagttccatgggacagattaaattattagcccagccaatggatgggaagggcaagtaggattttatttgccaagaacacatagctaggagatggtgggttgattccatatattggctattatgaataatattgcaataaatattggactgcagatatcccttcaacatcctgatgtcatttacttgggacatatacccagtagtagggttgatggataatataacataggagtgcaggtatctctttgacatactgattgcatttcctttgtatgtatactcagtagtgcgattgatggcactagctctaattttttgaggaaattttttactattttctatatggctgtattaatttacattttcaccaatagtatgaaacagttcctttttctctacatctgcaccaacacttatcttttgactttttgatagttgccattcatactggagtggggtaatagctcattgcagttttgatttacatattcctaatgattaacgatgttgagcatttttttcatatacccgttagccatttgtatgtcttcttcaagatatgtttattcagacatcttgtccatttttaattggattacttgtttttttctattgagttgtttgagttccttacatgtttttaatattaaccccttatcagatgtatagtttgcaaatattttctcctgttctaaaggttgtctcttcactttgttaattttttcttttgctttgtaaatactttttagttaaatgtaatcctatttggatgtggtagggctgggatttgagccaaatgatctgacaagattcagaactttcaattgagatactgtactgtcttccacttaactagtctatgcatacatttatagcataaaaatgtattcatgcctcttgctgttttttcttttgtaatatgttttaataatttccacttcataaaacatctttctgctacattaagtggctgcatacgattctattacataccatacatatttgtattttatttaatcagtttcaatcattgcagcttattataaaattttattattataaatagtactttggtgatttgaaagtacaatacatttacacataagcatcctctccccatacattcttagaagtagaattgctgatctcctacaattgtttgaacttgaatccaagccagacataatcatatttcttttatagatttatactactgcctgtaatagaatttggaatgaatggattgaaaaaggaaggccttgatattaggctagatattgttgattacacatgcacatacacaatggttttgcaaaaagacaacttttcaactaaaggcatctcatttctcaaataataatgcttgctttatttatatgccagagtagtaagaggctcaaataagatatatttgtaaaactattttgaaaaataaaacccgcaacttaatatacattgttttataaaaatataagtactcattacttaattatttgagatatacttagggtaattgtttaactgatatatttatataacagatgcttagtaaggaccaatgtagatcagactgtatgctagatatttggcatatgattgagagagagaagaaaagaaaaagagtctgccttcttgaatttaaaatcaagttagccaattacctaatagttctggctcataatgacatatgcttctttaataagaagcaatatacagtgaaactgcattgtttgatattaagaactaatcgaaaactcttaagcttttaaagaaacaacagaaagaatacgtttgtaaattgggtcattacaatgcctctttaaagtgggcatgtatggctacggactagacaaagacaaaaaatacaaactttaggccaaaattagcacttaaataaatgttttaagagtggtggttatgtgtttgatatttactggtatcataatcctgttgcctaaaccaaatttaatttcacataaacattgtgctttaagtactttaagtgagtgtctttaaagtttgactatagcttggataaaaattgaagagaaaccttaatggaggacccctatttatttattaatctgtttactattcaaagttagttgatttataaaggccatgtagaaatttcaaaaataccacagtgatctaggaataaagtagaaattggaaattggaaatttctaactctttggccttttcttctcaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtaagtaacaaaataatacaatgttttagctatgccaaaatcattttttttattcagtcacttaacaaatatttatgaagtgtgataaggtttttctagaggctggtgataaataaatgagcaaaaaatacataaagacataatttatagtgtgtacagggaaacaataaacaatgttttcaaaataaattactaataagtagtatagcaggtggtaataagtgtgaaagaaaaagagagcagtaaagaggttagggtgtggcagtggggtgggtagttttaagaagtgacatcaagccaaatcccactaagaaagtgatatgtaaagaaggtaaagtgcatgccatgctgttcattaaaagactagtgttccaggagaagcaggaagccaatacagtctctgattccagggtgtggccagtttgttccaagcaacatcaaggataccagcatggcaggagaagagtgggatgatgaggatggagaagcagagggaggccagatggtataacacattgtaggaggtcgtaagcactttggattctactctgagagaaacaggaagttactggaggctttttgagcagaagaatgatctaatttgacttacgttttactaataatattaatattggagatcagaggaagcattatagagtgctgatatgtgccatgtactaaggtctttatacattgttaactcatttagttttattgattcctttaagaaagtaatgttaacaaactaattttcctggtaagggaactgaggctcagagagtttaagtaatttgcctaagttcgtatagttggaaagtgatagagatggggtttgaactcaggaagtcaggcttgcactgcgctcttttgcaaatcatgtcgaattctgaattatgtattgtggttgtttcctttcacttatggagcagctaaatagaaattaatgcttattaaatttactcaatattttatcactgaatccagacctctaaaaacagctttatccaaaatagcacatttggttatagctataagaaggaagtagcagtgatcattgacactcattatatttttgtcaggaccacagagaaactctcaagtctcagttttactgagactttacaactttaggcttttacaactaatttacattattatcctataaacaaattagatataatagcacgttgtgtttctttttttgactgttagcaaactccatgctaaggttttaatctatatttggtaaatgtagaaaatattttgaattcatcttattattcacaccttatttttccttaatcctgctttcctaactgaagaaaaaaaaacaaaaacatcaatttattgcagcccagcccacatcctattcaaaactagcaggtagtgtttactatgaatgtatccttaaagtaaaacatgaaaaaataaaaataaaaaaatggagaatgttcaataaatatttttaattgattatcaaacagaagttatatttacatatatcacagtagtaaaatattatcttgataatatgttgaatacagttaatacctagtagtattaatttttttcatttgtatattccttcaataacaatttattaaatgcttactgtgtgctaggtaggtcctatacttttacttgagacagttaaaaagtgacatacttgttgagctcaactgccataataatttagatgcaaaaatattggtatttaagcacactgtgatgtttttaaagaacaatcatgacattcatcatgagtgaacattcattccataagtatttatctattagccaccgcttggctggcagtctgtagagcacagcagttgtagcaatgaacaacccaggtgaagttcctccactcctggagcttaaatatgcgaagtgctgatagttctttgaacgaaaataaatcaagataagagatgtagagtgtactattttagataggacagtttaatatgaatgaatcctcaaagtaaaacatgaggtttcactcatgtttttttgagtgaggttgcattgagcaaaatcacaaaggaagtgagagaatagccatgtagggatgtggagaaagaacaatcctgcctgggtgaagaacatgtgcaaggggcaaaaaagaggcagccttgtggctgggatgccaggagtccagggggcgtctgagctcatgaggtcatagaaggataggggaccctcctgtgaagcagaataatggcttcagcttttactgtgagtattgtatttgatagttttaagaatgcagatccttgatctgacttagatttttaaaaggtggctctggatgcataagagtagaagcagaggccagttaggagtctagctgtgagagatggcagcttgtactaaattgagagatattggattctgtttatacttttgaatatatgaactgatagaattttctgactataggagtgtgtagtatgagaaaaagagaataattaagaatgcctctaaggctaaatgttaatttggtattttgaatattatatatgacaccatgattatgacatatcattatcatagcctacattaattaaacaaaaatatcaagtttagagttctaatcagttttaattattgaaattgtttttattttctgttaatgaaaagcacatacctataatactgggaatggcttaagtgaagacccagatttcttggcatgaagtatgtgtaaattttactctcactatattaagtagctccttatataaatctttgctcaattcaaaccaagcagacacctatgccagttgaatgttctagtggaaagaccaaagattaagtgtatatggaaatacacttggtcaccatgccaagtcacatgaaacagacattttacgagggctcctgcaactttttgggtattttattttatggatctagtcctagacacttctggaatattaatctagcacttttcatttggaaaaaaaataaaatataaaccagactggcttgcagaattgagtgggcttcatttaatggtttatgttagcactatacattgttaataaaacccaccattttacagtatggttagggaatgtgcatttccaaagggctggccatgtctccccagccaagcctgtcatcactgctctaaattagctggagcagtagctgcagagtgaattgagagtctcattccacacatgcgttgactatgttttctttcagttttccacatctgccaaccctggaaagaaggaaagatattgtgtctcagtcttggatcctgcctacagtagtgatctataactgtcttgaaattaaagtggaaaaataatgaaagcacttgaaataaatgtgaataaagacagagaagcacattgtgttttacaattaggacgttgacttgctctagatggagcgctcattcaattagtagacataccctgttacagtcaatctcaggggatcactagagcggagtttttttaaatggaattccactttggaagaaagcatttatgtacttggaaactattacttaccccatatcccaccctaatctctatcaaataccttcatcaggacacagtgagattaagcttttgttactacaacacaaagtgaagcaaaggatgggcacttccttatcagcacagacagctaattctactgtgcattttatgctgcttgtgtccttttgggtacctagtactgttgggtaacgagtaagtagtcatctgttaactggctgcttaataaatgagcctacattttttgtatgattttagctcatttttataatttaaaatacacagcatttttatgtgaatactgctttggcaaccactgtttctttgaagcttacaaaagaattacttgtcttttttaggtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgaggtaaaaataaatccaactctaagctgaatattgacaaatcagatgaactgggttaacaacagtaaaaatatcgctttatagcaatacgttataaagcaaagttgaaaactctaaagggtgacctagtttcttcctctgtgagtatagtggtgatgttttctattgttcagtaagagaatgaccagacaatggtgaccgtaacgcctgggaaacatttacagggattggttgatttgaacacagacatgctattctcctgggaaggacaaacggcttaactcttagtagtttgtattattttctttgcagaaaagaacattttcttcatttcattctatgggaggttaatttagagagatgcgcaagtcatatattttgccttcctctgttctttgtgaatgttttttaaggtaaaatagagatcatattgcaaaatataaattttaagtgtttaaatcactttaaaaaatatgtaaagatcatggtaagatatttccatcaaattatatttcactaattatgataatcacattcttttagtcctccaatcattggatatgacaacttatgctttaactttcatttagtcactttttaaaagaacaaatgacctgaattctgacaccattaaaggatgcactctcgagacattatttattatttctgtgattgtttttaaacaatttgagtcgtttctttgtcaaggtgtaacaaagtaaagctgtgtaatatattacaaattaatagacagtttcacctggagatttgctatattttttgatgtgtgactatacatacacagatgtgtacacacacatatatatatacaaacatacagacagtatgtattttcataaacagaacaatgttcattcagagcatcagctagactatttcattcctgtacttataaatatatcctacagtgtagttttatttaaaattattattataataaacatttgtgaaagttccatattatttatttgagatgctatcgtttctgacttttatccactagtgtgtaccaaagcctttaattctacataaaatattttaaactatcatatcatgctagattatgtaaataataaactgattcaggtagtttataatggtaatatactctcagatatcccaatatccaacactgattgcatgcacattatgataaacaattatttattcattaggcaaataaatattaatataatttctaatcttgaaaagcattattttaaaaataaaactattcataaacataagttgcatgtgaattatgaataaattataatttatttttgtaacccacaccttattttccaggaacataaatgtgtaagacaaaagcacagtatcagtggaatttctttccttttttaaaaattgatgcttaactttgtaaaactatatcccacattctgaatcctggagtaacttcagctctttagttggagaagctattaaaacattaagaaaagtaatgttgaaaggattctttaatgaaacccttagtgaatatgacagtgagtagtgaaaaataagtttattaagctacttcgcatcctagagtttcatgaaaccctatgaagttttaaataaaacatttatttactattaagtgtagttagtttttaaaatgttaatgaataaagaacttactctctcagtttatcttttacaatctttgaccagttaaaggggaaacaatttttacttaataaaatatttagaagtctgtagagtaggaatctttgaattggatgaaatttagtatttatctaattcatatactcaaacagccatcagatataagattcaggtcttactttctaaattatattattgtatgtatatatgaaatttcaaaaacaatttggtctctttccacttgaaaatagtgcatgaagaaaataagtaattcaaatatatggatgtttagtccaaatttagaaatttccaccattttgtaaaattagttcattctacctgatgttaatatctcttttcttaaaaacttattcgagtatgtttttccttttatttttggtttatattataatacctatatacttatgaatctttgcaagtaaacacatagaatttaaactgaaaatgacaggagatagaaattgtactgtctatatattatgttagtgttttataaatagttgtgatgatgaagataatatgataataccagtgattcattagtctgaaaactagaaatgtcactttttcaggcatagcataagtcagatttagttgcagatttgtttggtatatgtaatttcatgtatacactgccctacattaatagaatggtactactatggtaaaaatattaaacatggtcatatttgaatttcaatctaatgactttttagaattcaactttatacagctaaatgcaaaactgaagatgattttaaagttggaacaattatagtttacatattatgctcatcatatgctcaccacaagaagagcatatagactcataattcagattttataatttcagcatagcagagtgagtatatgaattgatttggggatgacaaaaatccgattttgaatcccagcatatagcttaatattcaaccttctctatataattactctatatcagtttcaaatgggaaatataacagaatcttcctcataaggatttatagaaaaaaaatgagctgatgtatgtacagtctttaagatactagtataaatatatatatatatatatatatacaaacacatatgtaatataaatgtggttgtatgttaacttaattatccattaatgtgtagttttacaaacattattattacttctttttcttatgattttacaaccatgacatttcaacttttgatatgggcaactaacagtgacccatctgtcagtcagaagtcctcgtgggtccctctgtctgtctgctaaaagtcctcatgggtccgtctgtctgtgttctaaatgaagtacttcttttctggcctactgcaattttacaaattaccttgtagagattagatacatttgtcccctctagacagaggtaacacctgagtacagaccttaataaatggagtgtggtctgattgaatgaatatttccatgcaggcaaaaaaaaaaaaaaaaaaaaaaaaaaagtcctaccaacacaaatcaacagccttgatttttttttcctgctaaataagattcaaagatgtgaggaaaattaaattagaaaagttgtattgcttgtatttattgtcaatacaattatttttggagtcttttaaacaggaaaatttccttattaaatagcaagttatagccattgctcaagttttcaaaacatcattatttctgtttcctaattttttaaaataatcaaaacagattattgcaggtctttcatattttttaacaaatagccatctttggggagattatttatttcgtggaagcaatgagtagaatatgacatatgatggctatttgagtagaaaagctttgtgatggacattttgcatttttttaaactcctcagaaaatattttgaattcaattttctgtggagaaatcaatgaataataatttataacaactatgctatttgataactgtacaaggcctgaaaaaagtaagattagcaaacttttttgagatggcgtttgagatggccaatactaaagccatctcaaaagccattaagagcttgattattgctttatggtgtccatatatctttttaatgcatatattatccaatatacacacttaaaagttgaattttagtagacatggttttcctatagaacaatgttataagatggagataacctttccatttatccactttacccagtctagatgcatttagttcttggtccttgtgattttttttctaaatttattgagttacaattgaatcacaataaactgcaaatattaaaagtataccatttgatcagttgtgacttatgtatacagctgtgaaaccatcatcataatcaagaaaataaacattgccatctcacccaagagattccttatcatcttttttaattcattccttcttccatcctaaccccagacaatcatgaagtagctttttatcactgtagcttttctgggacttttacaaatggaattatactgggtgcactcattttaacttaactcgttttaactcgttttttttcccttgttattaatagtatgtcgaattatgttgattggtttttcaaatatttaaaaacaacttttcaatctttagaggtctatagactgtactggtgatgtagtatgttgtcttatttatattacatacaattcagttcttacttagtataatgatcttaagaattacccatgtttattgtatttaatattattattattattattattattattattttgctgagtaggattttaacacatagctacaccaaaattttttcatccattcaccctattagtgggcatttgtgttacttccaggttatggcatctataaagccactataaacattcatgtctacattttggtttgtttggttgaatacctagatgtggaatgcatgggttatttggtaggttcatgattaacattaaaaaaaaagaaaattatcaaactatttttcaaagtggcattaaccattttatactcccttcagcagtgtatgagagttccagtcattatgtctccttgccaacctctgatatgctcagtctttttcattttaggcattctaactagacgcattgtagtgttacattgtggttttaatttacgcttctcccttgactgatgatgtctgcattttgccaggttcttgtgggccatttatgcatattgttttgtgaggtgtcttttcaaattttttgcccatttaaaaaattgagctgtttgttttagtttaaggagttttaagagtatataaaactttatcctgcataaagattttttgtctgatatatgtttgcaaatattttttccagtatgtgacttgccttttttttgttttcttattggtgtctttccaagtgtaaatgcttttaattttgataaagtttaatttatcaattttgttgttatgtttgacactctttgtgttctaagaaacttttactccaagatcacaaagattttcttctatttttagtatcagaacgttgttgtttcaggatttgcacatgggtcatgacccattttgagttaatatttgtgtatgatgtaaggtaaaggtcaatgttcactgttttctacataatcatatccagttcattcagcacatttttctgaaacgactttcttttcatgatttatattgccttggtctttaaatcagaaattaattgactaccaattagtgcacctattactgaactctctaccttattatttattcattttttttactactaccataatatcttgattactgtagttttagaaaacattttaaaatcatgtgggtaaatactcctactttttattctttgtaaaacattgttgtagcaattttgggtcattttcatttctacacacatgttagaataagcttattaacttctacaagaagttgtggttttaatggggatttcatttaacctacagatcataatgaagacaattgaaatttttaaaaatcatggagttttctatttcctgtacataatataactccatttattttggtcttgtttaatttttttttacaatgttttctagttttcagggtaaatgtcttggacatcttttatttaattttttcctaagtatttttttttagtgctagagtaaatgaatttgtttctaatgtcatatttgaatattttcttcctaatatagaaaacacgattttttatattaaccttgtatcctatagccttgttaaattcatttattagttcagggtttttttttagtgtaaaaagttatataatctgaaagtagggaccattttgcaagttttctatctttatgctttttacttatttttcttacggcaatgaatgggatatacatcgaatataacttttatatatattgaatatatcttgtgtaagcaggtattcttacttttttttctgacctcatgtggaaaataattcagtctttcagcattaagtatgatgttggctgaaagttttcattggattctgtttatcagtttgaaatttactgtttgtcttagtttcctaaatatttgttatcaagaacatgtactaaattttataaaacgctttttctacacctattgaaatgatcatgcgggttttttttcctgttagtatgttgaattacattgattgatttttcaaatatttagaaataactttgcattccttaaaggtgtatagattccactgtagtcatgcagtatgttatcttattaatgtaacatataattccattttgtaaaatatctttaaaaagttttagtctatattaatgaggaatactagtctatgaatctctgtatttataatgtctttgtcaggttttgatagggttatactggcttcataaactcatctgtgcagtgatctctccttatctattttctgaaaactttcttatattactgatgttatttccttcttgaatactggatagaattaaccagtgaaaatttcagggccctgagttttctttttagaattgttttaacatattcaatttctttactcgatacaggttaattcggtttttctgtttcttcttgtgttgatcatgttaagttttatttttcaagaaatttttctagttcaactaagttgttggatttgttcatataaagctgtttgtagcatttcattattttaaattttaatatctttaaaatttctactgaaaactactttttattctttatattaataatttgtattttccccccagatcaataatttgaacaggtacttgaaacttttgttgatattctcaacaaaccagtttcaggctctgttaattgtcactcttaacagactcttttctatttcataattattttttcctatcatagatttgaaaaagaaaaattgtttctctagcctctcaaagtatagggttattacttcgagatttgcttttttcccagtataaaaatttaaaattacacatttctctctaaacacagttttagctgcgtaacacaattttactatgtcatttttgatggttatttagttaaaataattttcaatttctttttttattttatttccagcccactaattatacagtgatgtttaatatctagatacttgagcttttcttagagagcttattggtattggtgtctaattctgttgtcttctgagaataaatttggtatgatctcaatccatttagatttattgaggtttgatatatggtctaacatgtagtctatctcagttaatgtaataatgcccttaaaaagaaagtgcattgtgaaattgttcgatgcagacttttataaatgtcacttagatctttccttatatttcttatttttttgtctacttgttctatcagttgttgaggagtgttaaaattttctaccataattgtgtaattgggtatcttccttttcattttgccattttttgcggcatgtattgcattctcaggcatgtgcacatttatcattgttagatctttctgcttgtcactttttactgtgaaatagctctctatctccactagtattttttgccttgacgtctactttatgtgatattagaatggccactccttttcttgttaacctacaatttgaatgctatatatatttttatgtccatttattttcaaattatgtgtctgcatagttaaagtgtgcctgttagagtcaggttactggggggcctttttttatcccctctataaatttctgccttttaattggtgtcatgaaactaataacataatttacattaaatgttatgctaaatgtcattgatttgttattgatgtggctggatttaagtctgcatcttattatttgtattttctttgtactctctgttttctgattctttgttcttcctttcctgcctccagtctttttttttttttttggtgctgagggtttatttgaatattttgtagtattccattttgttttacttattggatttttgctatttttttatttaagaaatactttttataataattgtaaaatttgtaccaaaatgttatgatatatttcttgctaatattgtatcattgtatgtatgtaatgcagaaacatttcaatctccttgtcatactgatctttgtggtacagttgtcatacttattagacctgtatatattgaacataccaccaaatgttatttttgctttaaataatcgtatattttaaagcttttaagataaaaatataattttatatctaagtaaatatttgttatttctgtttatcttttatttctgaagctccatatttttctaggatacacttttccatcagtctaaaaagttttctttaacatttcttatacaacagatatgctactgatgtatctcttagttttcttatatgtgagaatgttgttcttttgccttcattacagaaggatattttcactgaccatagaattctgggttgacagttttattattttaggactgtaaaaatgttttgtctctggtccctgtgttttctgatgcacaactcacattcacattgttgttatcatgtacttgatgtaccactttagctgctattaagattttttttttctccgtgtttgcttttcagtagattgacttcagtagattgtcataattttgttttaatttattctgtttcgggtttattaagcatcttacatctgtaaatgaatatttttcaacaaatttaggaagccttcactctttaaagtttctactttgctgctaaatattcttatattttcattcttttcaatagtgtatcacttgcttcttggaggagagttataatagctgttttaaaaactcttcctgagagtttcaatgtccaccctatctcagggttggcatctgtttattgcctttgttgctattttttttgtttgtttgtttgtttgtttgctttctttttttttttttttttttttttttgagacggagtctcgctcttctgtcgcccaggctggagtgtagtggcgcgatctgggctcattgcaagctccgcctcccgggttcatgccattctcctgcctcagcctcctgagtagctgggactacaggcgcctgccaacacgcccggctaattttttgtatttttagtagagacggggtttcaccgtgttagccgggatggtcttggtctcctgacctcgtgatcctcccgcctcggcctcccaaagtgctgggattataggcgtgagccaccgtgcccggccaattgctgttgttgttaataaacaatctttattttagagtaggtgtaggttccaaagttgagcagaaaggacggggagttcccatatactatttgccccaccccaacatataaccttccctattatcaatatcccatatgagagtaggaatttattacaacagatgaaactacattgactcatcattatcacccaaagtctatagtttacatgttcactcttggtgttgtacattctaagagtgtagacaaatatgtaatgacatgtactcaccatattagtacctaaaagaataattttactgcactaaaaatctttctttctctacctaatcttcctttctctacctattcatccttctctccctgattaacccctggaagttgcgattttttttttttttactgcctctataattttgacttttccaggatgtattagttgcagtcatacagtatgcagccttttcagtttagcccctttcgccaagtaatatgcatttaaggttcttctatgtattctctttttttttttttttcttttttttttgagatggagtctggctctgtctcccaggctgagtgcagtggcgcaacctaggctcactgcaagctccgcctcccgggttcacaccattctcctgcctcagcctcccaaatagctgggactacaggcacccaccaccacgcctggctaattttttttgtgtttttagtgaagacaggttttcaccgtgttagccacgatggtcttgatctcctgacctcgtgatccacccgcctcagcccccaaagtgctgggattacaggcatgagccaccgcgcctggccctcttctatgtattttcatgactggtaggctcatttcttcttactgctgaataacattctactagccggatgtggtacatatttatcagtttacctactaaaagacatcttggttgcttctaaattttggaaactatgaataaagctactagataattatgtgcagttttcatgtaggcataaattttcaaatcatttggataaataccaagaagtgtgattgttgtatgaatatgctttgttttatgagaaactgccaaactgtcttgctaaataaacccttttggattcccgccagcaaggaacgagagtttgttttgcttcacagcttttccaggagtttttgtcatcactgttttgaatttgccccaaaacagccctattttcttttggtatgttgtggtttctcattgttgttttaatttgcaattctctaatgacatatgatgttgaacatattttcataggcttactttccatctgtatatcttccttgttgaggtgttcaacatatttgtgcatttttaagtcagattgttagcttttttattgttgaatattgaactttttgtatgttttggataacagtcctttatcaggtatgtcttttgcaaacacatgcacctgctgtgtggtgtattttctgattctcttgatattgtcttttcagaatagaagttttaaattttaataaagcctagattatcaataaattctttcatggaatatatctttggtgttgtgtctgaagagtcatcaccatacccaaggttatttaggttttctcctatattgtcttctaggagtttcatggttttgtgttttacatttatgaaccattatgacttaatttttctgaacaatttaaggtttgtatttagatatttttttgcatgtggctgtccagttgttccagcactattagttgaaaagattatcattgctccattgtatttcatttgctccttttgtcaaagatcagtttagtatatttatatggatctttttctaggatctttattctattccattgatctacttatcagttcttccaccaatactacgttgtattcattattgtaatattatattaagtcttaaagtcagataatgtcagttctctgtctttgttctttacctttaatattgagttaattgactattctggatgtttttcttcttatgaatttggaatatgtttggaaagatccacaaaataacatgctgggaaattaattgtgagtgtattgaatctatagatcaagttgaggagaactgacatcttgacagtattgagtcattctatccatgaacatagaatatttttatttttaaagttgttcgatatccttcatcagagttttgtagttttcttcatatagatcttatatttattttgttacatttatacatatgtatttcttttttgagtgctcatgtaaatagtgttgagtgataaatttcaaattcttcttaagaaaatgattgatgttttatataccttgtatacacaaccttgtaacaatcatttattatttccaatttttttgtcaattattttggattttttacctagacaattatgtaatctgtggaaaagtttaatttttctcttccccatctgaatacattttatttccttttcttgtcttactgcatcaactaggactcccagtatgatgtagaaatgcaatattaacagaggacatccttgccttctttctgatcagtttgagaaaatgtccttctgttcctagttttcagaacatgttttaaaatcatgaatgaatgctgtattttgtcaaatgctttcctgcatctatgatatgataatttatttattttttctttagcttgttgatggtgatactaatttattttcaaatattgaaacagcctggcatacctgggataaattccacttgactatggcatttacttattttatataccttgggattcaatttgataatattttgttaaggatttttgcatttatgttcatgagagatattggtctgtagtattattttcttttaatgttttcacctggttttgatattagggtgatgtgacctcataagatcagttagtaatattcctttcgcttctatattctgaaaaaggttgcagagaattggtatatctttttccttaaatgtttgatagacttcaacagtgaacccatcttgttctgatgctttctctttagaaagtttattaatttttgattcaatcttcttattggaccttttcagattttctaattctttatttatgagtttttacagattggatctaccaaggaattgacttatttcatctaatttatcaaatttgtgggcacagagtttttcataatattcttttatcatccttttaatgtccatgggatctgtggtgatatctcctctttttcctgccaataataatttgtaacttatctcttacttagttggcttagctagaggcttataaattttattaacattctgaaagaatcaggttttggtttggatgctaattctatggtgactttctgctgtctgttttattacttctggtgtaatttaattttcttttgttctgtttatttcagatttattttcctcttttttgtttagattcttaggatagaagcttagacagttgattttagatctttcctcttttctaatatattcattcaatgctatagatttccctcaaagaaaagttatattttgatttttattttgtttataatatttttaaattattcctgagattttgtcttcaatccatgtattagttagaagtatgtttttacatttccaattattttgggatttcccagttatctttctgttacggtttgagagcagttattggattatgtatatttgttcaaatttttaagagttttctttttggccatgaatgtagtatatcttgaggaatgtccatgtgaactttagaacgataagtaatctgctgttattggttataggagtatatatatgaaaattatcttttttgattaatagtgtttttagttcaactttgtccttactaatttctgcctgctgtatattttcatttctgttagaatggtgtttaccatttaaatgtaatagtggattcatctatttttccttccatatctattagattttgcttcatgtattttgttaggtgcatatgcattaaagatttatgtctttttggtgcactgacctttttacccttattatcatgtaatgcctcactttatctctaataattttccctgctccaaagtttgcactgtgtgaaattaatttagctactcctgttttctttttattagttttagaatgttatacctttatacccttccttttactttgtatgtgtttttatatttaaagtgtgtctcttgtagacaacatgtaattgagccttggtttttttttgatccactctgacaacctgtctttaatgagtgtatttaaatcattcatatttaaggcaattatatatatagttagaataatattcaccatatatgttattatgttccatttattaccctgggctcaggtgatccttccagtaccaccatgcctggctgattcttttctatttttttgtagagatagggtctcactgtgttgcccaggcttgtctcaaactcctgggttcaataaatccaccagccttggcctcccaaaatgctgggattaaatgcatgtgccgcctcacctggctaggtttttaaatatgaacttacacctattccaagtcaacttttaaataacactatactgatttatgagtaatgcaagcaagtatcttataaaatatttcaaattcctctctcctgccttttctgtcattgcaatcattcattttacttatacataagcatatatgcagtgaaatccattattgctattattattttgaaaaaactcataccttagatcaattaataataataaaaaatattttaccttcacttattcattctctgaatagtttatgtagatttaagcttctcacttatataatttttattatttctgaaaagcttattttaacattgcttgcaaggcaggcctactggcagcaaattcctcaatttttgtttgtctgagaaagtctatatttctccttcacttttgaagaatgatttctcagggtacagaattctagtttggtggtatttttctctcaacactatatatttcactttagtctctctttcttgtatgatttctgataagtcagatgtaattcttatcttcgcttgtataggtaagttggtttttttcccctctgggttcttttaatatttttaaatttatcttagattttctgatatttgaaaatgatattcccagatttttggtctgatatttgaatattatacttctggaattttggtttgatgtctgacattaatttgggcaaattctcagtcactattgcttcaaatgttggttctattcttttctctctttctccttgtattcctattgtgtgtaattacatattttgttgttgtcccaaagcttttagatatcctgtttagttttgtatttcccagctttttttctctttgcttttagttttggaagttttgattatcacctcctcaaactcagattctttccttagcagtgtctaatttactaatgagcccatcaaatgtatgcttcatttcaattatggtgttttttatctacagcatttatttttgattctttgttacagttatcatctttctgcttacattagccattctgttcctgcctgttgtctacttttttattaaagttcttagcacgggaatcatagtttgaaaaattcctagaatgataattccaacctttctgccatatctgactctggtttgatgcttattcagtctctttaaactgtagtttcttttccttgcagtatgccttttaattttgtgttgaaaggtgaacatgatgcactgggtaaaagaaactatgttttgtttttttttaataagcccttagctatgtgttggtaaggtgaaacgggaaggactcattctatgattaggtctcagattttggtgagcctgagccctggactgtgaattttatcagtgcttcacagtccctcaccccatgaccttaggtggaacaggatggctgaaggtggctggggttattttccttcttccacatggaagaccagagggagctgtagtagggaatttcctttctttcacactgaaggataatgctgcactgcagttaggcacaacatacattgttatatcatgcttttctttatgctttgtggatattgctcttgttacaaattgaaagtttgtggcaaccttgaatcaagcaagtctgttggcatcatttttttccagcagcatgtgctcacatcatgactgtgtcacatttcaataattctcacaatattttaaactttttattattattataagtatggtttatgagaccccaaaacaattacaactgtaacattaaagatccctgatcacagatcaccatagcagttataaaaatgaaaagatttgaaatgtcatgagaattaccaaaataagttacagagacatgaaatgagcatataccatcttatatataataataatgtacacaataagatggtaaacttaagtgataaatgttttgtgtgttctgactgctcaactggctcaactgaccagctattctcaaattctctcctccttgaggctctctattgcctgagacacagcaatattgaaattaggtcatttagtaaccccacaatgacctatgtgtgttcaagggaaaggaagagtcacaggttcaagtgttcaagagtcacttgagatcaaaagctagaaatgattaagcttagtgaggaaggaatgttgaaagctgagataagccaaaggccaggccttttgtgccctgtgaatccaagagttatgaatgcaaaggaaaatatttttaaagaaattaaaagtactactctagtgaacatatgaatggtaaggaagcaaaacagtcttattgctgatatggagaaagtttgagtagtctaatagaagatcaaaccagccacaacattctcttatgccgcagcttaatccagaacaaggccttaactctcttcaattctgtgaaagctcagagaagtgaggaagcttcagaagaaaagatcaaatctagcagaagccagttcatgatgtttaagaaaataagttgtcttcacaatataaagtgcaaagtgaaacagcaagtgctgatatagaagctgtagacaattatccagaagatctagctaaggtaaattgttgaaagctgctacactaaacaacagatttccaatgtaaacaaaacagccttctgttggaagaagataccatctaagatgttcctagagaacagaaatcaatgcctggctttaaagcttcaaaggacagcttcaaactctcttgttaggggataatgcagctggctactttaagttgaagccagtgctcacttaccattttaaaaatcctgggacccttaagaattatactaaatcaatcctgctgtactctataaatggaaccacaaagtctgaatggcagcacattcatttgcatcatggtttactgaatattttaagcctacagttgtgacctactgctgagaaaaaaaatgattcttttcaaaatattactgctcattgacaataaacctggtcacccaagatctctgatgtagatgtgtaaggagattaatgttgttttcatgcttgctaacacaacatcaatagcccatggatcaatagtaatttcaactttcaagccttcctatttaagaaatacttttcataatgctatggctgccatacatagtgattcctatgatgaatctggacacagtaaattagaaactttctagaaaagattcaccattccagatgtcaataagaacatttgtgattcataggaggagaagtttgtttcaaaatgagtttgaagcattcaagatgtcagtagggaagtcaatgccgatgcggcagaaatagcaagagaactagaattggaaatggagctcaaggatgtaactgaactgctgtaacctcatgataaaacttgaacagatgagttgcttcttatggataaggaaataaagtgtttttttctgagatggaatctacttctggtgaagaggttgtgaatattgttaaatgacatcaaaggatttagaatattatataaagttagttgataaagcagcaacagagtttgaaaatactccagttttggaagaagttctattgtgggtaaaatgctatcaaaaagcatcacatgctacagagaaatcttttatgaaaggaagagtcaattgatgtggcaaacttcatcattgccttattttaagaaattgatacagcaacctcaaacctcagcaaccaccaccctaagcagttatagacacagaggtgagaccctccaccagcaaaaatattacagtttgctgaaggttcaaataatcgttagtattttttagcagtaaagtatttttatattaagatacatacatttattttacactgaatgtttttgtacatttaatagacaacagaatagtgtaaacataacttttatatgtactgagaaactgaaaaaaatcttggcaatattttctttattgtggtggtctggaactgaacatgcgatatcttcaagttatgcttgtatttccctttctcaagttaggttaaactatgatgaaatcccagcaggttactctgagggcatgctttttttaagaagaacagaatgttctggtgttttcaacatgattccttttctcctcccacttccagaagcatgagaggaagtctttatgatattcacttacaggccttatagagctcttccaagtaaaactcacaaaagtgcaggattcccccatgactgagtctccttggtgtttttaactcttggaagttttaactgtcagaatattggtattttctctctcacataacataaattcagaagctattaggagacctcatataggtagttttaatttcagttcaattccttaagtttttcctcaattggtttgggtctgttacacatgcttaattctggagatagcctgaggtttttatggttcatacaaaaattaggcaattcccctcttcatttttctcatctcagattcccgtacactttctaacctgcatttttcccctagttcctatgtccaaaaacacagggtttctttcaaagttttaggcagacaacagttgttctgctcagctactggattccacccttgggacaaaaccttgataaaatatgaaacaaaaacaaaaacaaaacaaaataaaacacaagtaagttatacctgtaggctaatttctccaaattttgactctcttctataatctgcataatttacagaattgtcagctagttgtttattgcattttgttcagagtttatagttttcaacagcaagagagttgggctgtagcgggctcacacagtcataggagtattggctttcccaagatacgaacgtttgaaaagtgttcatttcttatgaaaaatgtataccagaggtgtccaatcgtttggctttcctgggccacattggaagagaagaattgtcttggggcacacataaaatacactaagactaatgaaagctagtattttaagaaagtttatgaatttgttttgggccacattcaaagcctcctgggcctcatgtggatgtggttcatgggttggacaagcttaatgtataccattaaagagataagcatggtacttgctcttgcctcatcttccaaatccctaaaattggtacaattctattatctcacagttaagtctgaatcctccttgctctgtcttctctgtggaacttctttaattaagaaagaaaacaaaataagctatcactatttaaaaaaattaacattatatgttttctatctggattttaaaatataaaggtgtgttcactaattatttctctaaatactatctttgtaaatgtgtagaaggtcttccataaaatatgaacttaagcagaatgttggatgtgagtaggcacagatgataacataatatttattgtttaattgagaaataaaagatgaaggtaagggtatcatacagtatctaacaagtacaggtatggttgaatgaaaaagattataataatgatgaaatgatgataatttaagtatttgcattttaaaatcacacacatggtagttaacaatgttgactctggagtcagacagccctggcttgaattttggttttggaaattaaccagctctgagattacagacaagatatccagtctccctgtttccttcctcatctgtaaaatggaataacagtgctatgcatcctatagagccgtttggaaattaaattaatgtttgtaaaatactttaatctgtgtgttgcagtattgagtgttttatgagtgtttgctttttttctttttaattttttttgagacagagtttcacttttgttgcccaggctggagtgcaatggcatgatcttggctcactgcaacctctgcctcccatgttcaagtgattctcctgcctcatagtccagagtatctgggattacaggcatgcaccaccatgcctggctaattttgtaattttagtagagacaaggttttaccacgttggcgaggctggtctcgaactcccgacctcaggcaatccatccacctcggcctcccaaagtgctgagattacagacatgagccaccgtgcctgacctgttggctttttttttcttttttttagaaacaacaacaacaacaacaaaacacccttttttcatttattattgctgaatttaagtgaaaaacacagatatggttaacataggagccacatttggctttgtaaaagactcaggtttatagtttattattttaaagaagccttcaatacctgaaggcaaaagcaaaatgccatttgaacgtggtactttatcatttactcttgttagagtagcatagagtcagcaaaagagaaaagcaaggaagctttgagtttacttatgggtgttaagtttaattcttgtctgtagatctttggttcgcatgtgcatttcgcaatgtagctgtggctttttaattattgaaaatattgtctggaatctgtttcatgattcattttttgtataatgtattaaaacaacaaaattactttctaaaatcagaaattaatgtacaattttaacagaaataaactgtggacaacaaacattaggtaaaaatgtggtagacttgatattcaaaaacaatccaattccaaattcagtgtgacacacaaattcaatgcacattagtgtgaaaatctcaggggataccacacacccaggtaaattagagttttgtaacaaaaataatataaagcctcactgcattcacaaacatgttgaatttctttaatatagaacaatatatgcagttgttctttctaaaaggaggttttatagttttcgtgaagaaatagtcaaatgtatttacatgatagtatcttttagcagtatttaaaatgtaagatgtttttatggcaataagttgagcatttgttagattttattagactattattaacaaattgagattccacataaaaatttttctcttttgatttttgtttttaggagatatttaagttccactactgaccacttgtataagagtagacagagccacaactttgatgtaattcttttttgagagttatccttagccaagactcaaaagcgcatctgtttttggctgttttatgtataattacattctttattgctgcacactgaatttgtctgtcaagtgtagtgaaaaacaacaaacaaaaatgtgccacattatttatgaccaagcttcagtgattctgtagggctgaatttgaaatggattttctcagttctcctttctagatgctactgtactttactatacaacagcctcaaggtatcctgttgccagtcagaccatctggaatcagatcagcaccattgtattgtgatatgcaaataaagtcccatattttgggactttattgaccttttgttataattttatatttagtaggatttgtggctaaaactgtttcaagaagctcaatgacgcatttaaggcaaatttagatttctgagctctatagagatccaaagtaccacagtttatataggatgctacttgtcctctaaaaggggcattgccctgtttaatttggatttctattttgctgattagtgcgtcattggattagctactgccggcaatgcacaatagtgtttcatacattttatgtttcctcttttacaaatattgtctctgtattgatgaccttagttttatttcccccttttaaggtctattattagcctgcagtactttattaactttttaaagaagaaatcatcttacatttgcattcttgtttgtctgtaattaccaggttgttttagaattacctattaatgtacagcttccttattggactacgtatttcttgagtgctagatttttatattccattactttaccattccaggagcaacatcaatcccaaagtttgtcacggtgtttatagttaataaagattagtaaatgcatgaatgaatgctttacccagaaatggctaaggctttgttagaagtatcagggagaataaagggttgggaaagctgtaagatagcatatgttattcaaaagctaggtgttcacttaagttgattattctctgttgaaataaaataaacattatgtgtcaattgttgtgcttaagtaagggatatagaaacatagttgtaataaaagacttgtgttacataataaagacataaaaatattcaaggggggaataataactaaacctagagtagtaaaaataaaaggacatttaaaggtgagaacacatgtaaaagatgaagatttgtaataagcccagcagttctgagaaatgtaatgtggtttgggggcatttgggaggagacctgggttagtgtgtaaaagcccatttgtcttttataccatactaaggtggttgaactttaaactataggctatgagaacattccttaagtagaggaattaaacattaaggttttttttagaattctttttgtgacagtgaaggagctagtttagaattggaagaatctgacttaaaaaaaagaaaacatgaattgttgaatattggttcaaataaaaggtacttagagtagagacaaggccatagcagaataaatggagaaaagggtcttattttcaatatggaatagaactggtaggtcttggggactgttaggatatgagaggtaatgggagggaggaacttaatatttttggcctttagcacataggtaacaaataggtgatatttactttttacatatacaaactgtttaaatttgagctgaatgtagaggactttaactatctttcatattacttatgaactatgtgttttaaaccatgctttaaactagtaaaaggctgtggaactatcctgagccaaagaatcatttcaccatcttttctatacttcttgagttttatagtaaacacacagttaatgtgagattgttattagctaaaagaagtgtaataagaatattgatatagggaggagccaagatggccaaatgggaacagctccagtctacagctcccagcgtgagcgatgcagaagacaggtgatttctgcatttccaactgaggtaccgggttcatctcactggggtgtgccagacagtgggtgcaggacagtgggtgcagtgcaccatgcataagccgaagcaaggcgaggcatcaccttacccgggaagcacaaggggtcagggaattccctttcctagtcaaagaaaggggtgacagatggcacctggaaaatcaggtcactcccaccctaatactgtgctttcccaatgggcttaaaaaatggcacaccaggagattatatcccgcacatggctcagagggtcctacgtgcccacggagtctcactgattgctagcacagcagtctgagatcaaactgcaaggtggcagcgaggctgggggaggggcacccgccattgccaagacttgattaggtaaacaaagcggccaggaagctcaaactgggtggagaccaccacagctcaaggaggcctgcctgcctctgtaggctccacctctgggggcagggcacagacaaacaaaaagacagcagtaacctctgcagacttaaatgtccctgtctgacagctttgaagagagtaatggttcacccagcacgcagcttgagatctgagaatgggcagactgcctcctcaagtgggtccctgacccccgagtagcctaactgggaggcatcccccagtaggggcagactgacacctcacagggccaggtactcctctgagacaaaacttccagaggaacaatcaggccgcagcatttgtggttcaccaatatccactgttctgcagcctctgctgctgatacccaggcaaacagtgtctggagtggacctctagcaaactccaacagacctgcagctgacggacctgtctgttagaaggaaaactaacaaacaggaaggacatccacaccaaaaacccatctgtacgtcaccatcatcaaagaccaaaggtagataaaaccacaaagatggggaaaaaacagagcagaaaaactggaaactctaaaaatcagaggacctctcctcctccaaaggaacacagctcctcaccagcaatggaaaaaagctggatggagaatgactttgacgagttgagagaagaaggcttcagacgatcaaactactccgagccacaggaggaagttcgaaccaatggcaaagaagttaaaaactttgaaaaaaaattagacgaatggataactagaataaccaatgcagagaagtccttaaaggacctgatggaactgaaaaccaaggcacgagaactacgtgatgaatgcagaatcctcagtagccgatgcgatcaactggaagaaagggtatcagtgatggaagatgaaatgaatgaaatgaagtgagaagagaagtttagagaaaaaagaataaaaagaaatgaacaaagcctccaagaaatatgggactatgtgaaaagaccaaatctacctctgactggtgtacctgaaagtgacggggagaatggaaccaagttggaaaacactctgcaggatattatccaggagaacttccccaatctagcaaggcagggccaacattcaaatttaggaaatacagagaacctcacaaagatagtccttgagaagagcaactccaagaaacataattgtcagattcaccaaagttgaaatgaaggaaaaaatgttaagggcagccagagagaaaggtcgggttacccacaaagggaagcccatcagattaacagctgatctctcggcagaaactctacaagccagaagagagtgggggccaatattcaacattcttaaagaaaagaattttcagcccaggatttcatttccagcgaatcaaagcttcataagtgaaggagaaataaaatactttacagacaagcaaatgctgagagattttgtcaccaccaggcctaccctacaagagctcctgaaggaagcactaaacatgtaaaggaaaaatcggtatcagccactgcaaaaacatgccaaattgtaaagaccatcaaggctaggaagaaactgcatcaactaatgagcaaaatagccagctgacatcataatggcaggatcaaattaacacataacgatattaactttgaatgtaaatgggctaaatgctccaattaaaagacacagactggcaaattggataaagagtcaagacccatcagtgtgctgtattcaggaaacccatctcacctgcagagatacacataggctcaaaataaaaggatggaggaagatctaccaagcaaatcgaaaacagaaaaaggcaggggttgcaatgctagtctctgataaaacagactttaaaccaacaaagatcaaaagagacaaagaaggccattacataatggtaaagggatcaattcaacaagaagagctaactatcctaagtatatatgcacccaatacaggagcacccagattcataaaggaagtccttagtgacctacaaagagacttagactcccacacaataataatgggagactttaacaccccactgtcaacattagacagatcaacgagacagaaggttaacaaggatacccaggaattgaactcagctctgcaccaagtggacctaatagacatctgcagaactctccaccccaaatcaacagcatatacattcttctcagcaccacaccacacctattccaaaattgaccacatatttggaagtaaagcactcctcagcaaatgtaaaagaacagaaattataccaaactgtctctcagaccacagtgcaatcaaactagaacccaggattaagaaactcactcaaaaccgctcaactacatggaaactgaacaacctgctcctgagtcactactgggtacataacgaaatgaaggcagaaataaagatattcttagaaaccaacaagaaaaaagacacaacataccagaatctctaggacatattcaaagcagtgtgtagagggaaatttatagcactaaaagcccacaagagaaagcaggaaagatccaaaattgacaccctaacatcacaattaaaagaactagagaagcaagagcaaacacattcaaaagctagcataaagcaagaaataactaagattagagcagaactgaaggaaatagagacacacaaaacccttcaaaaaatcagtgagtccaggagctggttttctgaaaagatcaacaaaatagatagactgctagcaagactaataaagaagaaaagagagaagaatagacgcaataaaaaatgataaaggggatatcaccaccgatcccacagaaatacaaactaccatcagaaaatactataaacacctctatgcaaataaactagaaaatctagaagaaatggataaattcctcgacacatacatcctcccaagaataaaccaggaagaagttgaatctctgaatagaccaataacaggctctgaaattaaggcaataatcaatagcttaacaaccaaaaaaagtccaggaccagatggattcacagccaaattctaccagaggtacaaggaggagctggtaccattccttctgaaactattccaatcaatagaaaaagagggaatcctccctaactcattttatgaggccagcatcatcctgataccaaagcctggcagagacacaatcaaaaatgagaattttagaccaatatccttgatgaacattgatgcaaaaatcctcaataaaatactggcaaactgaatccagcagcacataaaaaagcttatccaccatgatcaagtgggcttcatccctgggatgcaaggcttgttcaacagacgcaaatcaataaaggtaatccagcatataaacagaatcaaagacaaaaactacatgattatctcaatagatgctgaaaaggcctttgacaaaattcaacaacccttcatgctaaaaactctcaataaattaggtattgatgggtcatatctcaaaataataagagctatctatgacaaaccacagccaatatcatactgaatgggcaaaaactggaagcattctctttgaaaactggaacaagacagggatgccctctctcaccactcctattcaacatagcgttggaagttctgcctagggcaatcaggcaggagaaggaaataaagggtattcaattaggaaaagaggaagtcaaattgtccctgtttgcagatgacatgattgtatatccagaaaaccccatcgtctcagcccaaaatctccttaagctgataagcaacctcagcaaagtctcaggatacaaaatcaatgtgcaaaaatcacaaacattcttatacaccaataacagacagagagccaaatcatgagtgaattcccactcacaatttttacaaagagaataaaatacctaggaatccaacttacaagggatgtgaaggacctcttcaaggataactacaaaccactgctcaatgaaataaaagaggatacaaacaaatggaagaacattccatgctcatgggtaggaaaaatcaatatcgtgaaattggccatactgcccaaggtaatttacagattcaatgccgtccccattgggctaccaatgactttctacacagaattggaagaaaactactttaaagttcatatggaaccaaaaaagagcccgcatcaccaagtcaatcccaagccaaaataacaaagctggaggcatcccactacctgacttcaaactatactacaaggctacagtaaccaaaacaacatggtacttgtaccaaaatagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaacctattcatctgacaaagggctaatatccagaatctacaatgaactcaaacaaatttacaagaaaaaaactaacaaccccatcaaaaagtgggcaaaggatatgaacagacacttctcaaaacaagacatttatgcagccaaaaaacacatgaaaaaatgttcataatcactggccatcagagaaatgcaaatcaaaaccacaatgagataccatctcacaccagttagaatggcaatcattaaaaaggtgctggagaggatgtggagaaataggaacacttttacactgttggtgggactgtaaactagttcaaccattgtggaagtcagtgtggcagttcctcagggatctagaactagaaataccatttgacccagtcatcccattagtgggtgtatacctaaaggattataaatcatgctgctataaagacacatgcacacgtatgtttattgcagcactattcaaaatagcaaagacttggaaccaacccaaatgtccaacaacgatagactggattaagaaaaatgtggcacatatacaccatggaatactatgcagccataaaaaaatgatgagttcatgtcctttgtagggacatggatgaagctggaaaccatcgttctcagcaaactgtcacaaggacaaaaaaccaaacactgcattttctcactcaggtgggaattgaataataagaacacatggacacaggaaggggaacgtcacacaccggggactgttgtggggtgggggtaggggggagggatagcattaggagatatacctaatgctaaatgaggagttagtgggtgcagcacaccaatatggcacacgtctacatacgtaacaaacctgcacgttgtgcacatgtaccctaaaacttaaagtataataataataaaattaaaaaaagaatattgatatattatttaaattattgtttaagtaagttttttaagaccttgatgtttttaaagcataaactactctatttctgtttatgatttgactgtatatagttcttagaagagtggcaggtatatagtgagtgccaactaagtattgtctattattataactatcagtattacttgttccttggataattgcaagagcctttaattgatctttctgcttttgccatttcatctgttctctaagcagcataactagaaaagcaagtctatttctttcaagtagcacctggccaaaagaacaaatgaatgaatgaagtgtgccacctctttgctcataatcttccagtggcatttcatttcatttgtaaagttattccaatagtctgcaggaccttatgtgacccataccacaccctctgcctctcctgttagagtttatcagtgtctcctctccatgttgctacctgtggattgttggttcacaaggtgtccctcacttgaatatattaattaatctcttgccttggggctgcttgtgccatggggcctggacattcattagtccttctgcctggaaagctctctcttagatatagcattttttatttcctcagttcctcaagtgtctctgtctcagtgtctcttaatcagtgaaactttccatgattgcactttataatagagtatcctactttctgacatatattcgctatcctttcttactttatgttctttacagcatttattactttctggcatactacattattcttattttgtttctccctctggaatataaactcctagaatgcaggagctttgtgctgtgtccacaaaatctaaaatagtacctgacatgtaatactagtattttttagtgaatgaataaatatattttctagcacttattaattcaaagggtataggtcatctatagcagacaaggaagtgggaagcaagatctgttacctttttataaccttttaattaattaaatttatttgatgcaatagagccatattggtagttatgctttagtaagaatccttgtttaacattgataacctagaaagtataagataaacgtacagttttttcatagtgttttatccaacttttggcattttctgtagtacttggtaagcagatgttgaattagaagtacattcaagtaatataagacactgctaattttctcaaagctggtttcttaagttagttttgggattctgcgcaatacaagggctgtgtgggaagtagttatgtctgtgattatatggtttccctcattttttcctttgaattatggttcaaatgcaatctctgatgcgtttttcaattacactaaaattctaagcattttggcaactttcctttaccacagaaaacagttgagaaaaaaaaatcattaactgtatggggtgtttgaaaaaaaaaaaaactggtgagagttaatgccttggcaaattcagaattctaagtagacaggaagcataggttttcattaatcttctgattatggtagttacttcttaagaattttatgccacatttaagatttaatttcagccttgtatatgcaatcaaaaactctgccaagagccaccagacttttcctgaaagctctaatatcaaatgtgagcagaagttttagggtctaggggctatcttatgaaaatattatagaatgttgttaggctatttattttacactggcacatacaaggctacttacctaaatgtatttttattttctttctattacatttttcctcatgtgtttgatttatagaataatgactttaagactcctgaaactggaacttatttttagaaaaattataactagaagtctgccacttaaaggtttgttttcctttaattgactccaaacactggaataaaatatcttatatttgtatatactttacagtttataaacagcttaaatctatattagttgtgtttagaatttctgaggaaatacaagtaatagtattcttcatttacaggtgttgaaataaagtctttcaatggtgaataaattattggccaggagatccatttattgatcatttattgagtactcactatgagaaggcctagtccaggaattgtgaaaatctctgacaacaaaactgaaaagtccctgctctcatgaagtttatattccagtgaatttaattgaacaaaatagattgactggttaagtaaggagcccaggctgtaaactatgccttttattgtcttgtagagatgctataccttcctgacatgtgacacacatactggttattcaaatccttaaacttactgtttggtcatccagatatacatataaaatatatatttcatatatatgatgtatttcatatatacattatatatatatttcatatatatgatgtatttcatatatacattatatatatttcatatatatgatgtatttcaggtattcattatatatatttcatatatatgatgtatttcaggtattcattatatatatttcatatatatgatgtatttcatgtattcattatatatgtttcatatatatgatgtatttaatatatatcatatatatttcatatatatgatgtatttaatatatatcatatatatttcacatatatgatctatttcatatatatgatgtatttcatatatatatatatttatatacatgataccaatttctatattaggtcttcaagtagatggtgtttccccaacttctcatattcttttgggttcactctgagttcccacagaaaacagaactctcttcaggtagtttcagaagtttgagcagggaggctgggaaatctagtaattagcattaccttcctgaggactaaaggggcaaggggcataaatactgatacagtgctcagtgaggagctgtagttctgtagaagtactttctagcagtgtcaatagtgataagggtcccagactactgtgacaagctaggaaagtatgggggtaaacaatgccaacctttttcccttcccaacttccaaactcctggtggtagcttccatgtctgtcccggaaaccaacctgcgggagagtctggtgatgcagactttaggggtcagattcttgcaggcacagagtaagagacagaaatgttagtaataggaattggggtgccaacagtgaataacaagtattcctttatttaaaagaaaaactgaccactttcacataaattatgccaggaaattctagataaatcctctaattttctcaggtgaaagttatttcaaatttcttatatcttcataattggaatatagcaggtagtaaagaaatatgtgtctcatatcttatttatttgtgtataataatctgaataaccagtctataagtatttgagaggaggtttattttcctcctattcatagtgtcggcatgatactttgcctccataaatatttattgaattaattgatagatgaatgattggtaaacagtcaaagacaaatattctcaaagtaacctggctgttaaaatccttgtacaagttagaattaaaagttataggagaaatataattactatcttatttataatatatcttagcctattaacttgttataatacacacaaaagaaaacattttgttttgggaacaaaatatagcttttcctaaaataacgaacctatattgttatacaacaatgttgtataacagattgtttttgccttcaaccaaaatacagtttttccaaaatatacccatatcagtagggaattctcgctttcaattttgagcaagccttccatcgtttactgttcaacagatattgcatgttcaaggcacaaactgactatattttgtagaggaaacaggttttcacatttgacaccaaaacataatttttgtttcagaatttgaaaaaataaaggtatgctgattatattatatatatgcatactttaaaagtcctctccgaattacatactttataaagtagccgatttagatttaaagagacttcaattctctaaagaatgaatgtatcattcattgttatagaggattgcaacagagcaaaaataagggactatttttaaaagacctgttatttctgggatagtaccactttatataaaattaaaataataaatatatagaaatgcaattaccaattatttatttttattctctgacaggtattttctctgagggacttagaacaggcaccaaaaaaaaaggatgatgctaaaaattgatatgtaaaaagctgatacccaaatatctggtattgtgttggaggaataaacgtgtcagttcaactgttaactctttatgaaatagtgaaaatagtctataatttctttcatattccaaaaataacaattactttaaaaataaatctaaaatttactgccaagttaaatactatgaaataaaatgtaaatgtcaaattctaatgctaactctgtgaaacaggcagtgaaagtactacctaatgcaaaggccatatttgaccttcacaatgatattaattatatgaacttgtcttttgagtctaagtgttaaaataaaagttaatcattatgtgtcaattcaaaataaaaatataaaaattaaaaagcacattaaaaataaatactgattaagaatttatcattaataattagcattcaaattgagatgtgctctaaatgtaaaatatacataatctttcaaaaacatggtaggaataataattaatagcttttatgttaaatacaaattgaaattatatgttttgaatatattatgtaaaatgtatgataaaagttaaagaaaaataaaaatattacatacttgtttccttacatatgaataatttttctcaaattgattttttaaaaagaggtctcaaaatgattttcattttgttttaaaatcctctttagtattttaaatgttaatttcaatcatattattttggacaacaaatgtttttaaaatgtatcagatgaatttattttgggagggggatcaaactgtggtaacattttaaatgttaatcatttaaagaaacattgatatgaagaatccttttgtaatctgagaatcatctctaagtattttttagaattgtaatttaaatttttacataagagtttccttaaatcaacaaggaactaaacatgtttagtcttgattcatgttaacataaactgataaaatgaaacaaagaatacaaaaaagtatataatctgagattatcagaacatatactttaatatatattttgagattaatatgagaatatgtactttttgaactatatatttgaactctgtctatatataatatatataattggaatatatataaatgtatacacacatagttcaaatattaggggtatgtttttctagcattttttgttttctattgtcgacatgaagtaggattacaatataactttattaagatggaattaatgatacaaacaaaattattttaatcttttactagcacaataaaatgtattttaaaaataagactattttatggatatttcttaaaaatttgtcctctttaaattctttatttgtagttggaatgatgcttttttacatttcttattttctattttcttcagtggactgaggggtgtctatgatgatgatactgtcaggtgtataacttctgattaccctgtattctagctacttgccaaattaaatcagccaatatttctacagcatctacttaataccggaccctggatatagtcagttattacttttgttataaataaacaaatatccattttgtattttttttcaattgaaatgacctttgctctgttacaaagacagaacttcagacgaataaaaaaaaaaccctagtattaactgatttatattagttttttagggctgccataataaattgccacagcctcagtggcttaaataacagaaacttattttttcaaagttctggaggctaccagtccaagatccaggtgttgacagagtcgttttcttctgtccgagcgttcttgccttggcttggaaatggttgtcttctccctgtgtctttacatggtctttcctctgtgtgtgtttgtgtcttactcctttcttaaaggagaccagtcagattcaatcaggaccatactagtggcttcgtttaaccttaattaccttcttaaagaccctgtctccaaatacagtcacaatgtgaggtattgggaattaggatttcaacatacaaattcgaggggacacaatttaacccttagcactcagtctgggcaagctcatcctgttcttgataaacaatgaaaaaaataggtataagattgctacagaaagaagtacggactgtcatatcaaagggaaattttctgccaattattattgattcttgaaacttggtttggtttcaatgatgcagtctgatagtctgcaggtataggagagatacagttcaaaaataaataaaagtcactgtcttaagtgataaactgaccttactccagaaatgactgttagttattattctacttcttagacttaagagattgaccctccaattttttccttttattgtagttctatttgagtaaatggctttgccatcctaccattgcttacttgagaaactgcagaattgctctacgttcctctgttaacactttgctccatatttccttatcattctcgtctcactccatcatcagcatccagtcagtttccaaatctcacagatatattttttactaatatatgtactgtctgttccatctattccattcctagtatggctgacttggcttcaattctcaacacttttattgaaatcaactcctaattgatttatctgactccaaactggctgcttccaaattatcctcccttttgctgtcaaagtgatttttttaaaatacaacattgatcaatctatttcatttatcagagtcctcaaatgacactcaaatgacatcttttgagtttcagttcacatgcaaggcttttcttaaattggttcctaacttaaaaataaatatctactctttaccctcactctttatcatcaccatgtaagtccttccctctaatgtgctgcactatatatacttctctctctctctctcgctctctctctttttggagaaagagtctcgctttgtcgagcaggctgagtgcagtggcagtggcgcgatcttggctcactgtaacctccacctcccgggttcaagcgattttcctgactcagcctcccaagtagctaggactacaagcatgcgccaccatgcccagctaactttcgtatttttttggtggagaatgggtttcaccatgttggtcaggctggctttgaagtcctgacctcaggtgatccacccacctcagcctcccgaagtgctagtattactggtgtgagccactacacctgacctacgtctctgaattcgtcatacagtttcatccctcaaaagttttgtttaagatgctttttatgtttaatgctattttacctccatccccttcattaggctaactcctatttgcttttaacaaatcatcaagatttttccaagaaccgtttcatgaaaatgttcattctcattgagatacctgtatgttgcaagttaatggagacaagaatgaactataagaaatttggaatctagatgattttatggaacaaaattatagctgtgtgatttactctagcatttagggagatgaaatatctaatcttagatatttctgtagttcaataaggtatatagtcaatcgttacagtgttattttccagatcttacaaaaaattgctctcttagaataaaaaactttaaatgttaatattaaaagtttagatcttgtgagattcagagtagaattgaaagccttgtggaattgtgcagtcaccagttgttagattaaaatttaagagagaagatcatttttcaattataattgagcactgattcaacatctgcattaactgttttagttatatctaaatttcttctgccttttttgtgatcctattaaggtccaaacacataatccatctacaagtcacattattcaatcagatggaattgaacaagacagtatcacaggctggtttttcattgctcattctctagaggcagctgctttgctgtgcaattcagtggatgctcaggctgagaactaacataaaccaatcactggttggcttcacataagacaaggagttcaatctgaaattcagatccttagcactaacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagactttatatatatatatataaaattatatatatgcaaaccaaagtaaaaaaatgaacaaaaaaagttagcatatgtgcattatttgtttggttttaaaagtatgctattacttatataatttgattttgataaaaaaaatagtgagatccttttgcaatgcatgtgacattcacaagaacatcatctgtgtagacagtttctatttagttttcttacattttatttgctttcactctatacccatactgtctataggcaaacactatagtataaacccagttgacacagctggagatcacaaagtaattgcatcaactgtaccttaatcttggttttgtggaccattaaaggaggaggatgccttgtatgctaaagatgccagttttactcaataactttaccttttttagctgtgaaaatttttatggcactattgaatctaaatatttatagttcattcaatctgtaacaatgagcttgtttacagagtgtcttaaaacatgtcatacgattaacataaaacactgtaaaatgccttctgggaaaaaataggactgtaagttttttattgaatttttccagtttctttctagtatattttatgactattaaacacctgaaataagaatttatattggaaaagttggcaggattccatttagtcaagttaggactgtaaatagaatagtaactacttaaaccagcattatttaaaaatatatattatttaaaagtactataaacatacatgatgcatatatagatatatatttatattatatataatatatatttatatacataagtatcatatatatatatatatatatatatatatacgatagcaacttttttgtttttcagcaatagattcacttgattcattataatttgtatataattaagtatggcattctagaatttctatccctggaaaggaacttagctattatctctcagtgcattcattttacaaatgataaattaagtgatgcacaattccaagtagttaatggcaaagctaggagaaaatttaggaagcagagtttgtaatcaaaaccctcagtgattccattactcagtcatattgtcatgtactcaatagtgcctccttatttgttttaaatattaataattttgtattcaaatttctctttgctttttttcatttataacaattcaggtatggttactcagtgttctgaattgttcagttggaatttgagaaatactatcagtatattttaagaacttgtatttatttgctatgtgtctatttaaaattagtaggtattaggcaatattagagatgctcctacttaaaaataatttacaaaaaaactcagaaactaattttattatcagttatttatattatttcatgacatgtaaaaataaatattttcaagtttagaagtactaataatacttatgatgattttaaatatggttgtctagatgaatattttctacttctgctttatgttatgcttcatcataaattaaagaagatgtttccttatttgggtgttactaggacatactagcatattacatgtatttttaaagcactatttgagagagtgaatgaattaaaaacgattaaataaaatgagtaaaaaacttgcataaatatagcacaatctgagatatcagtggagatatttctgaagtccacaaaatttatcgtgaagatgaataaacataatatttcatttatgtcagcacaatttttattagtggatgtgtgtttttgagtcatttttgtgatgtaatgttgctcatttttgtggtgataatgagacattctagatgaagattaacaggtagttggcaataagaaattaaatgtcaaaatatggatcaaaaggggatcagcttaaaacactaaaaagaagatttaaaatgagatgcccaaaaggagacttgaaaggctcaaacattaatctgatcatctaggatacctgtgtgactgtccaggaaagacctgaggagaaggccctgctatttcaaatatggttgactttgaggatctacctagcaaaaagtgagagctaagacagtgttgtaaactgtaggagtgttgaaagtgtttgccaaggcacacagaaagtctcttgggatactaattggttccattcaattccaagatttaaggaaatctcactctaatcatttactgatcattaacctaaccagagacctcattggccacaggcagcaaagactacttacttagagaattacttcaaggaaatcactaaatgaacaagcaccaacaactacaaagaaaaataacagtaggcctggcggaaggggaggatagtatctgatttcagggttgttatttaatatgttcaactttcaacaaaaatactttcaacatcatgagacaacaaaaaaaaatgaaaattaagtgccatacaaagtaaaaagcaaagcaaaacagttaagaggatctgtccttgaagaagcacagacattggacttccccaacaaagacattaaatgaacaattatggttatgttaaaaaaaacgtaaaaaacatgactaaataactaacagcaagtatgacaatgttgtcttaccaaatagaaagtagcaataaagatatatactactaaaaatactaaattgtagtactgtagttgaaaagtataacatacaatgaaaaattgactagagaagttcaacaaagaatttgagctgacaaaataaagaatcagtgtacttgaagacaaatcagttgatattatctacaatgagaataagggggaaaaatacattaaaaaaagttgacagcctcagtgcgggacaccaccgaacattccaaaataggcataataggagtcccagaaaaagtaagggcagaaaacatatttaacaaagtaatgactgaacacttctcaaagttgatgaaacaccttaatctacatggtcaagactctcaacaacttaatctgataaacttgtaaaatctacatccagatacatcataatcaaacatcaaaaaacaaagactatgagagaatcttcaaaacttcaagagtgaagtgactgataacatataaaggattctcatttagattaatagctgattccctaccatatactgtggagggcatgaagtagtagggtaacatattcatagttctggggggtagggggaaagacttcatctaaaaattttatagccagcaaaactgactctcaaatgcaaaggaaacagccaggtgcagtggcatgcacttatagacccagctaattaggaggctgaagtcggaagatagctggagtccaggatttcaataccagctttgggcaacataataagacaccactcttaaaacaaagaaaaattaagacattcccatatttaaaagaatgttcactaataaagttccctttcaagaaatataaagtctctcagattgaaatggaagattactggacactaactcaaataaagaacactggtacagttatctgggaaaggtaaatataaaagattgttcttgtttataatatttctctttttagattaaaaacaaaattgcataaaacaataattataaaactgtgttgataggctcatagtatgtaaagatgtaatttatacaacaataatagctacaaggtgggaggagggattagagctacataagataacatttttgtgtaggattgacatgaagttagtattaatttgaaaaaggttgtaataaagtaataataattctaagagtaaccactaacgaaacctataaggctatagtaaaaacataagataagtcaaattttaaaatagtaaatatctattcaactcaaaaaaggcagtaatggaagaataacgtaatattaatacaaaggcagaaaacgtagaaaacaaatagcaaaataataaataaaaacaactcaaatttccagaaactgatagataaactgcggcatgtccataaaagggaatgttacttgaaaagaggaatgaagtactaacacatggtacaacgtgcatcaatcttgaagacattatgataaatgaaagaagccaattgaaaaaggccacatgttgtatggttgaatttaggtgaaatgcccaatttttacaaggggccaggaaaagggaaggatagagagtgactgccactggttgcagggtaacttttaggtgtcatgaaatttttctgcaattagtagtgatggttggacaaggctgtggctgtactaagcccactgtattgtaaattttaaaagaatggattttatatgtgaattaattaaatccattataattgattttatatgtgaacggtgtgaacagctcaataactgttatttttaaagaagagaaatgtaagcatagaaatataaatttttgaaccttaaaaataaatcctaattctaagggtgagaatgaacacagttttagacagaagaaagaatgatacaaataaaaataagtgccaaccacaccacaggtagtaaccacagtatttactaagaaattgcctgctaggattaaatatcttaattcttattaaataacttatactcaattctaattaactaattaacttattcctttcttggcacttcttacactatttgattatatcttttcaagttattaattttattccaccttatgctagagtttaaatattcttaaccactaatttgcactctccaaagtgcaaagattatatcaaatatgtgtttctacacccacaggttcaatattttgtgtataatactttctcaataagtatctgttaataaaaaaatgaatattgtggtataaatgtagaatgaattatttccacattctttaatttttaaagatttttgtaatttaatttccatatttttatcaagttctaaataatccctgttgataagatgcaaagaaagctagcatgacttttaagttattaaatatggagtcgggagttttatgaatcagatttatgtgctcaaacttacagggaattgaatgctcaagttaaatggctatcagcccagatattactctaggcctgagtgtaattctgaattaatatggtcatgacacacagatttatattaaattagtttcatgatgaaataaagtccagatggaagtagccacattacatcaagagcagaatatttggatttttctcttgtttgcagtttccaaaagctcttgaaattaaaactctttaggtaattctattattaaatattactaatgttttgattttattgaaatcatacaaatttattgataggtgatgtttaatgtatccttaggaacacttttttttttcttaatataaatgcatcaaactcatgctttttttatttttaatctggatttttctggtgtcttcatttctcattcatctttgtaggtagggatttcttttgatactaatttttctaacagaacataatagttggatctatatatttactctaaaaatttcatataaatttcctaacaataattccttttaagcttattgagctttttacttatttagtattactattacattactgtctttatatatgcacagtttttaaaatgtgttgacttttaaaattagccttttgctcacattttatttgttctttaccatgcagtataaattaccagtggagtaaaattgagttttgaaaaatgaatgaatgtagtatagatttcctgagccagaagataacatagaataacagcctaatatttacagccgatttgtaaaataggtgtttctctttcaatcctataagactcttcttaacattgaaatataagtaggtcatttttcttcttcaaatatttaaaaataaaccacatctcgctttggtatatgtgtactttaatatgctaactgaatctgtgtctgtttgtttttgtttttttttttttcccagggggacattcagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatcgcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataatggtgcttcacttgtatactgtgtatatgcacatattccattttggagggggtgagaagaagataatatgtaatagcgatatttcgaccattagcatttaaataattaacagcctcaagatagaataacatattttctggtgtacatgccatctccctaggcctttggcaatgcatacaaatgagaaagtgacattagaactatcttaaagttttcaggctgtgttgaacaattagagggtttttaaaaaaaattttctcataggaaaatttaaaagcatgtgaaatggaaggaatttaagcctcagttgggagcaaaactatatttttggattttttttttttggattttgaatttttaagacttagagttttaaaaaggaagtagaaatttgaaaatatcaaaactgttctaaaaatgaatcaggtagtatttttcttcccttttaaatgtactattaggtgccaccatttgagttttactgtttacaatgggtcaaaatcttttatcttaattgttagttctgcatgtgaattcaggtcggatttttcactttcaatgctagaagtatgtttttgacactactttactttttaaggtttaataatgaattctgttgcactgatattttccatgacttaatgttagtttttgtttaaaaaacagggtaaaattttaagaacctaacaggaaggcaaatatgagagtgtaaagataaattactgggatattttatttacctgtttcacagttatcatgtacttcattctttttattctctcatgattcaccaaatatgttttctgtgaattctgaagtgatagataaaataattatcaggtttagtgtttttatatctaagaggttatgtgctgacttaatattaaaatttatagcatttactgtatattttcaaggttgatgagatctgttttgctcctttataaagaaagataaggcatattattctttttagcaacagatatggctctgatttttggaagaagggaggtttgcattcttaatatatcactttgaggtgttttgttcccatgttgtaatgctattatgtcaggtaagctgttattttatcaaggtaatttgtatccatcttcttaagttcatttaaaaatgaacttgccatttactattttagttgttgacatgtatatttaacattctgttgagatgtcaaacttggttttactagaagcatttgatgagaaaaacagcacattgttacagtagaaactgcatgacaatcttgttgggtaatgcaataatatatagcatttttacctttttttagattgagtaagtcataatgaaaaagttttttctttaagaaagaattagctttcccttttttctctaactctaaattatgttgatccttcaataataagataagcatctataccagcatcaaaaactacttaattgaattagtaagtagtgcttatattaattttaaactatatctattaatatgtcattatatgataacgcatataaataattcatcttcagaagttctacctatataaattaataatgcaatgttggttgccaatgaataaagaacataaagtgcaatatggagcatcagccatacatgtactttatattacttacttgttcactaataaacttctggcattgcatgtttattattctaatttggattaataaatatgtcaatttattttataagtcaaccgatatgcttttttcagcttataattttgtctacttagtatcctctaagtagcatatcctaatctattcttaagattcacattgttatatgcttgacataactttacaaccatcaccatggagaaagagatctataatgtagacagattttaatttaatcataatatcatcacattttaattttatttgaacctacacagtgccatttaaataggtgacaagctaatattaaaattatgatggagttgggattttcttatcaagtgaaattatcttcctatcttataaaaaattagatgttaaatctatatgattccttttgatattctttcttaaaaaaggatgaaaacagaaaatgaagtgacaatcttttataaaggaatttacaaaacaattagcttttcaaaatatattatcttttcacttaatatgtatcatacattcattagatgcacaggtttttactgatgtcaccagttttcttacaaattatgtaagaacagacattatgacatttctggaagatcctttctcctaacctactctaatttctgttagaataccgacaaagttgaaattattccattactgcctgtctttttgcatatatttgtctgattgattataactagttcttttttctctacttgtctcaagccatccttagaattccataatgaggggagagaattatctccaaaaatatgttatgaggctttacgtagcaatgtatatatattgcgaatatactaagcaatgtcttgagtatattcatgaccaccacacggaggaagctgtgcagataaaggagaaccaggagtgaataagctctaaaagaaagatgtgccggctgggcgcagtgactcacgcctgtaatcccaacaatttgggaggccgaagcgggcggatcacctgaggtcaggagttcaagagcagcctggccaacttggtgaaaccctctctctactaaaaatgtttaaaaaattagccgggcatggtgtcaggcgcctgtaatcctagctactcaggaggctgaagcaagagaatcgcttgaacccgggaggtggaggttgcagtgagccgagatcatgccacttgcactccagcctgggcgacagagcgcgactccatctcaaaaacaaaacaaaacaaaacaaaaaacaaacaaacaaaaaacagaaagatgtgctgtagtgtctagggcagttaacatgttatttcctccattatttcaaaaccagcctggttagtcaacatttggagagtttaaataaaggacagaattatgaaagttagaagataatttgtcctataagagaaaaaatgatataaaattgactactttggtacaggtctgtatatatccttgaatagcagatttcaattaaaatacgtttaagttgtccaggtttaaaattggccctttatgcatttacttattgtttttgtaattcataactcctcttaagctactagagcttattattagaaggcactgtgatcacaattttctaaaacatttgtggtcaacagttcttttgctggaagattaaaagggaatggttaaaatgcaaagagagatccagttgagacataattggaatcgtatcaaatacactacttaaggaattatgtgtagattgcccctggaaaatatatattaagtatacatattatatgtattatcatatatgtttgccctaggcaattatatataaattgccccggcatgcatgcatatatatatatatatatatatatatatatatatatatatatatatattagagttttaacttgttgagtttactgctttttatgctacatatgacttagtgtatttagttatttttattaaaaactgaatttaacttatgtttaataatatctatatcttgattgaaaattaaaatttttataaagatattgagctttggatttgagcacactattttgctcattatttaatatgtacaattgtcttttaactccctctattaagaaacatatctctccttaattaaaatcttttaatacagaagaaattagtataaaatactatttccagtgtgaatttattataagtattttaagaaagctaagtgttatgccttttttaatagagaaaaaggcagtgattttaaatattaaaattatgtattaattataagcacatctaattttgaatcttttaatgtctcacaaggattttgtgctctttttgatcttaggaaagtctaaaggaaattaggaatttcttaatacattttagattttattttcccattggttacagtattttaatacagtatatacttatttcatattctttgtattccctttccctcctcccctctttcccgtctctcaatagatatgaaaatcctttcatacttaggaagactactctctacatttttatttttagatatgtagcttaatttaaaattcccattgaaattactgtagcgctcttatagagaaacattgcatagcaatttttacaaatcaaaattaatgaatatttgacatctatgtccaagtacataattactgtgtttcaattaacattccataattaagagtttgaattattattccaaattttttgttttctcgtgatactaactactattctgctcataggaaatgtgctttgtcactcctatgttattatactctgtataagacagtataatacttctatgtaatacaaaaataactcatcaataacattaatttcttatctcttaacatttacactatgtaaaagttaagatggttctcactttgtgaatagtattttgccactaacacaattgcctgatattttttcctttgcaatgtagtatgcaccagaggatataatcgaatatgactatgagtatggggaagcagagtataaagaggctgaaagtgtaacagagggacccactgtaactgaggagacaatagcacagacggaggtaaaaacaaagcagtgcctgtgtatgtggtgtcctgctgttcgtcatcctgtggttccttatgttgactgttcctcaaacttaccataaacctttcattcatcttatttctctgaaccaataactgtgatttttatttgacagtagccgttttgaagaatgatgtccatttcacttttgcttagccttcctttcatctgtgctctatatttccctcctcgtttatttatgttttccattccatctttcaccacattttacagaaaaagaaatccaatttcaaaaagaagatgaggacagtggctactaaatcaaaggaaaaatccaaaaagtttacaccccccaaatctgaaaaattttcatccaagaagaagaaaagttatcaagcatcagcaaaagccaaactaggggtaaaggtagcgaagaaaaagcaatcaagatctatcctagataagctggaagatctctgatcatgaatcatagtcttaacccaactagataaatactcacttggctaatactataacccaattaaatcatgatttccatacatttgggatcaccttacatgtttactaattctcttctgaatttaccattaggcaaacatcgttgatgattttcaagaatacaactatggaacaatggaaagttaccagacagaagctcctaggcatgtttctgggacaaatgaggtaatacgtatagacagtattaaatcacagtcccactttttaaatatgtaatttattttgatatacttcactctggaagaatctataatttctcaaacatctgatgtttttattcttttactaaagtaagagaaacaatagcaatggttcactattactaaaagcagttcatctgaaatcaatgccaattcaggttttgcgtgactctttgcttcatgcagatgctaaattgatcaaactgaattggccgctattattttcttaattgctcctggaattgagcaagcttttcaacatgttgtgactaagggtattcacaacatgtttcttctgtgagaagaatcctctaaagtgaaaattgtatcatcgaaggatacaattagaattttactccctctgatgaataatcatgcattttatgacagcaagcattttgagaaaatgtagtcttagtggacttaaataactatttacattttcaaacttgttaggaatgtaatattaattcttattaaactaatatatcttaatctttccattattttctatgaaaatatttaagtacatgtaggtaaaaattaatcttcctgaaattcatatttcacatgcattctgatcatgaagaatacaacatacaattcagtttaactttgttaaatatctggtatacattttggtataattttatcaggaaatgaatataagaaatgtaatttagttttaagaaaatttatgtaaaatgtctctcaattaggcaaatagatttatgtgaaaacacaaaattgtgaataataaatgtttagggtgagaatggattttaactttcttttagatgaaattaataattttcaaaaaaaatgagtattttgattcaagatgtccatttacctaaccaaattcatccagcattttagttcagagctatgattatagcaatattctcaccatagatattatgcagtctctgtagacagcatatactccttatctaagaatacaaaaaaaattacggttattggacatttaattttagtgaaaaattactcatcatttatctacatattttcattcacaagattgtgtaatactattatctaatattactctatcatctagatttactatggaatagaaaatgagttacttaaaaatgaaatttacaaattggcaagataagcctaggcaatacaataagatcctgtctttacaaataaatcaatcaatgaataagctgggcatgctggtgcatgcctgtagtcccagctacacaggaggctgaggcaggatgatcatgtaagcccaggagtcccaggctgcagtgaggtatgattgtaccactcaactccagcctgggtgacagattgagaccccatctcaaaaaataaaaagtagcaagataagttatttaatttgagcctcatcatgatcataataaaaccaaatattcacatgataagtcggattcaggtttattctactagtaaggaattatgagaaaaaaaggtatcagtttttgtctatgtctctgaggaagtattattgacataattcttacttgtaagtattaattaatatttattccttactcttcttgagaattgtacagtgatattttatatttcattgtcctaaatgttgctagctatcatttattttatttgctttaaagaactctttggtgtaatactacttccctacatatgagatactctacataatcattgtaatgatacatctctatttatactgatattggcatattattattttatttatgggatgagactcaaacttatatggcttatccttttagcaaatgtatttcataatgatgttctgtaagatttaaaaattaggcaaagctgccagggtgtggaggctcgcacatgtaatcccaacactttgggagaccaaggcgggtggatcacctcaggtcgggagttcgagaccagcctgatcaacatggagaaaacccgtctctaccaaatatacaaaattacccaggcatggtggtgcatgcctgtaatcctagctactcgggaggctgaggcaggagaatcacttgaacccaggaggtggaggttgctgtgaaccaagattgcgcccttgcacaacaagagtgaaactccatccatctcaaaaaaaaaaaagaaagaaaaaaacattaagcaaagctttaactccataccttttttattgttcaaatcttaaactgtgaagtaaatatgaaattgactaacatgttttttccaatggaacaagcaaatacacatgttaattccatgtgaatatttgcagtttattggagaaagtgctttgaaagcaatatctctttgtacatagcaatgtacaaatatatttctttcaatgatactgaaagcctactttccaggtgtttagagttgcttgagtagtaacaaaatcgcatcccatcacacgctatcaaattgtaatttaaatgcttaccttgctttactaacaataaacttcatgttcctcaattccttgcaatttaaattaatagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcgtaagttgatactatgcactgtgtcattgtatgtcttatttatgggatatttttatgtccatgtccatcttaatgtcttttcaggtttaaaatgcaggttgaatttttatgtaaattatgaatgcctattaccactaggacaccttgttagattctttcacatgggaatcttcagcagttgtatctttggccatacttttggagtcattatttgaaagtaaaatcttgaatagaattgcatcagaaattttgtcattgataagattaaaccatagttgtttttattccaagtagcaagtctgattttttatttctgatttttagactattttttaaatttaatttgatgacatttcttaatgcctgggaataataactgacatctatagatgtcattataaaacatgtttataagaggcaatcgttcaatctcattttaagattcagtattaatgcttcttatgcctctcttttaatttttgccatatttaagccttcaataggtcttcatatttaaaaatatattttaataggttgttttaaatgtgtttagtttactaaattatctttttaaaaacaaatggccggccgggtgctttggttcacgcctgtaatcctagcactttgggaggcagaggcgggcggattacctgagctcaggcattctaaaccagcttgggcaacacggcgaaaaccgatctctactaaaaatacaaaaaaaaaaaaaattagctaggtgtggtggcgggcgcctgtagtctcagctactcgggaggctgaggcaggagaatggcgtgaacccggcaggcgagcttgcagtgagcggagatcgagccactgcactctaacctgggcaacagagggagactccgtcttcaaaaaagaaagaaagaaaaaaaaaaagaagaaaagaaagaaagaaagaaatggtcttacagacatttaggctgttttgaatatttcattcaacagataaatggccatggtgcatatggagagaaaggacagaaaggagaaccagcagtggttgagcctgtaagtagtagtgtgaatacactttaaaggttggtaaaattgcttatgagccacgattatgttaaattattatgtatgttcgtgttttaccaatgataatcttgatgtccagatgtttgcaattcaccacaaataagtaagttaataaggtcttgtctagaaaggagaatttcaataaaacaaaacattatagagctgcagaaattcagaatttgaaagtagctgaaatttgtcttgtctaattctctcattttaaaactaaagaaccagagatctaaaggacttaagtaattttcctgaggtatcaaatgtttgatcaatgagatataataggacttttagctttcctactttccaatccaatgatatttttctctaatctctatgacttcacattatttgaaatatataacatatatttgttacatatccaaattgtgtcatatgatattttttacttccttttcatctacagaagaatctctaattcactccaaattaatcttttaaaatttatatcaatattattactaataatattgctaagaaacagattcttacttggaagcggttttgccattgtttcctgctaataaacaattcagaaaaactaatgtattagaactgaaggtagaacaacacgaaaatcatttcagaaattgtaaggacataaaaatttcaaaaaaaaacagagaaagaaaaatgataaagaataaaaagatagttgtagatatgcagcgttatttctgagggctctgttctgttccattgacagaacagagccctcagaaataacgctgcatatctacaactatctgacctttgacaaacctgacaaaaacaagcaatggggaaaggattccctatttaataaatggtgctgggaaaactggctagccatatatagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatctatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactatttcaaccattgtggaagtcagtgtggcaattcctcagggatctaaaactagaaataccatttgacccacccatcccattactgagtatatacccaaaggactataaatcatgctgctataaagatacatgcacatgtatgtttattgcggcattattcacaatagcaaagacttggaaccaacccaaatgtccaacaaggatagactggattaagaaaatgtggcacatatacaccatggaatactatgcagccataaaaaatgatgagttcatgtcctttgtagggacatggatgaaattggaaaccatcattctcggtaaactatcacaagaacaaaaaaccaaacactgcgtattctcactcataggtgggaattgaacaatgagatcacatggacacaggaaggggaacatcacactctggggactgttgtggggtggggggaggggggagggatagcattgggagatatacctaatgctagatgacgagttagtggatgcagcacaccaacatggcacatgtatacatatgtaactaacctgcacattgtgcacatgtaccctaaaacttaaagtataataataaaaaaaaggaataaaaagagacaattttaaggaccttgttggccatctactcattactccaaaatcatgcaacatgctcacaaaaagtgttgaaaatatttttttcagaatgaatcagtccttattataaaaagttttaaccccctttttaaatgacattatagcttttcagcagtccaaagatggagtggaatcataaatgttttagaactgagttcttattctgaatagctctttattcctttgcttataaagagcttatatcatatttattcattttccttttgcctggatttttctgtaatttccctgaattaaagtgcttattttccattctttcatttacacagcaaatatttactaagtttctgttttatgccaggtattattctgtgggctacaaacaaacgaaaaacaaaaaataaaaaaccttggtagattgttttgtctgtactcttcctgggagcacttagcatattctcctttgtaatattattcatctaaatattcatttccactccacttaattcacacattctctgagggcacagtctatatcttctataattttgaatttctttccttccctgtgcaaaaacatttgtaattaatttaagtggtatgaatagataattcactatttaatatgcaatgatatagtgttctcttatattcatgtaattaagaggttgggggttatatttccctggtagagatgttctcttttcctgttatagggtatgcttgtcgaaggaccaccaggaccagcaggacctgcagtatgtaaatgttttaagattatttttgtctatttaaagtaatcatatataagatttctattaattactgaatgagaacattttagactaattagaatattgaattatagagaaaaacatttgttcagaggagctggtgcctttgaactgccttctgatttgtctatccaagtaatactctttaaattttgttttaaatatttttgtggcttagatacctctgcatcttctaaactcattttcgtctttctactgaaatatatgaaagtaaagaaaagtcatccttattttcattgcagaggtataattgtatcttaacaaatggaatctcaacttctaggtagactgcagctgccttatctatacctctgtgtggagtaattatcagattccattgtggtatcctgataaggctgatgttactcagtgtgtttattctcaggtgattgcactgataagaccttgtaataaatcctctgtcttttgtggaattaattaaactcttgtcgtctaaaataatatatgatactgatgcatttaaatatgtttacccataaaaggaaacataattgcctctaacctaaatgatttctacatgttcaacttggctatcaaatttttgagatctaattttatgagtgttccatttcttcagttagaactgggaccaaatatgaccttagagactttacattggcatattcttctttcctgtttttccttgaaatgtttgcctccaccctgagagcagctgaactagctacaaattggtttctatatgttgtcttttcacaggaagataaatagggcaactgtttagaactctagtgtatatttataaaatataaacgaactcttcgataggactagagtgaattcatctaaatattaatgagattaggaatctgattaagatatggtgtgtttctctatagggtattatgggtcctccaggtctacaaggccccactggaccccctggtgaccctggcgatagggtaagtgaatggacatgatatctcattacaaatgcatgtcatacagacttaaataattaaaatgtattctacaagtataacatgttatcttactgcgtgtgggaggggtaaaggcagcatgaattcagtgctgcacaacattttagttaacattttaaatattattttgaagtgaggaaaacaatgtgcatttatctatggcataattagtaagaaaacttttatttcacccaacatccatattgatatgaactcattacattagggattctggtcttcaaatttgaattccagtcatattttccagatatttccatttatatttatttggatgctgacagaataagttaataaatctaaattctactttgaggatcaaaccctgggttacatgctgaaatatctcatttgtgttaagtctctccaaactcttctcataaaataaccttcccttttttccccacatccttgagtagccaataactttgtactttctttcttttgttctttagaggatcagagatgcaaataacttatacttttcatataattacaatttaaataatgtaaaaactttttaatttaaatttaatgaaggaagatttttaactatttcagaaattctggactgagtaacagctatttaaggtcagaggacataagaagtgtattatgcaaacattatgaaactttttatttaaaataaagttcataaagttagttcttacatgctctgcttacttaatttgatatgtccagtttcttggagacatttatgtgtaatagtcattttagttaatatttttaaatcccaccatattttcataagacctttttatattctgtaatttactcaccttaaactctatatcaggtgagaaattcatctctttacactgtgccttataaatagagacatataaatgatctaaaaatgtaggaaatattttagtaataggaaattataccattcaagctagatttgttaggattttaaaaaattatttctttatagaagccattatttgaacttactttaacagttccttgaaacttgtacagaatctattgaaataatattctaaataaaatataattttgccaatctagaatcaatgttaacactttcctaggagttaactttttatgagaaattcacatttgaaaagtgctgctgcatttttttatatattggttgggcgctttgagttatagcattttgtatctagttatttattaatttttgaatttacttgcttccctgacaagtatgacatggctatgtagaaatgtctccttatattgaaagcttatggacatataccttatatctatgagtcacatacttatcaacagatgtatatattacatatttaatattttctatattcatatccatatcttggatttctggacagcatagtcacacctaaacttctaaatgtacatgtatgtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctgttaaagaatactaaaatataccttaaacctagtaatttttaaataaaactttcattatttacttaaatctgtttttatctaactgtaagaaccaggcttgtactacttgtttttctcacattactttcccttaaaatatatgtgaactcttcatcttacacagttttaggctgtgaacaaagtttgagcaaaatttatagcttaattggattatatattaataaccgaacattattaaaatcatctaaaactagtgcaacagaatagaattctgtctaggtatacttactaaaaacagactaaataaggtggaaagggcaaatgcaaattagataaagtagacttacgttataagttattctagttctagtaaatattattttgatatttatttattttggttatttcatttatttttctagggccccccaggacgtcctggcttaccaggggctgatggtctacctggtcctcctggtactatgttgatgttaccggtatgttcttttttatgttatagagatgacttgatatcttgtcatcttttttctgaagtttattgttgaaccatattgaagagcaatcaactaaaaaccattgtacaaggtagaaatacttgaaattaagcagcatttggaaattcagggaaattttacaaaacaaaattatggtatcaatctctgcattaaaactaagaattcattatttgattacactcttagcaacagagtttttgacaatatttccaattgtggtttatcctgagtcacagtattaacatgtttttcatatgttatttaacataacattaatatactatttaccatctattatctatatagtcataaatagtatttatttgtagtgttattattcattgctcaaaaattatttgctttactgtaagattcctttgtaaagtttttgttgccctggtgttttgggaaaaaaatgcatattttatttatcaatttcaatgtaatgaacaaagtttcaagaaataattacttagaatgaaaaattgactcctactgcattttgagttaaaatggagcaaattttatagaggaatattacagaagatctgttttataacataagtacttaagaatgggtgaacaaaataaataaatcacaaggaaaatttcctgtgtattaatggatattccaaaaattttgacaaacaaaatagagattgagctgtaactgtcactgaacttggtatatttggaattttatacaaatgaatcaataaaatgggtaacatttgtgcttaaaaaaaagtcacaatggtttattccagaggtatagaaattatagcatttaaaattgaaacagagtttctagtttcttcttctacaaatggtaacctgtagtgtaaagaacttccagaagaaatggaaagagcaaaaacaatacaaactagatctcatgattcattacggagttactttgtaattttgtaaaatcccaccattttaataagtggtttttatctaatgatcaaagcacgtaattcaacatgtttgacaaagctaattttgaatttcttaatgttatctcttccaagttccgttatggtggtgatggttccaaaggaccaaccatctctgctcaggaagctcaggctcaagctattcttcagcaggctcgggtaagacaggataaacttgcattcccacaagatgactgactctgtatcaagtatatatgtgtgtacatacggaagatgctaccattattaatagaatatttacttccgaatactgtgttaaacttacttggaaaactgctaaaattttatttgtttttctagtagtaatgtttattaattgaaaattatagttaggtagttgaccaatgcaatgttgccattatataattctagcagtttcccaccataacacgcaagatttctatttttttttcccaagagtattgatatatttacacctagtgcaccttatctttcacatccagttttactctgctaacttataagtcaatgattggttataattaagagaataaaatttgaaatacatttgttcttaattttctggattatttaacatatcatggataacacagaaaattaaattttttgggcatcatatataaaaaagaaaccttcaaatttcttaccaaccctaatctttataatctgtagtatttttaaaatttcaatttatgttttttagtttaaagcttccactacttgtagacttataaaatatagaattacatttatgttttttaattagtttcattgaaattagaatatacacaagaaaatcaaaaggatagaccaggaaggaaatggaattcatataacatttttattcatagtattggttttctttttaaggaagaaggaaataaaggatttttgtttggtatggatatggttacccactttctaaccaatataaatcacttctgtgataaaatttttatgcatcatgatgaatttatgcagcatgtgtaaaaatatctgaaaacatgagtaaaaattgtaattcatcctcaatatttgtttatgtctttcctaagtctattaatctgaaaatatatcattatttgattgtatcatgtttaaagataatgaaaaattaaaatatttgtttattagattttggcataatgcaaatctaaaattatttaaaataatttactaaagatttctataacttattttataaaatatattcttttgaacgattttaaggtaattatttgaacttaaatattttatgaggtcattgaattcctcactttattagtcctcttaacctacttgaaaaataggtagcaagcattataattcaatttttcagatatttaatctcaaggattaagaagtatattgtcaaaaatctcatggtgagtcagtagtgattttggagatcctactgttttcatctcgtgcacttttctaatatgattttgcatttatttctgttgtattatttttgatatctttgtgataaatctaagtgttcatctgttgagctctctaatattcaaaagtagcacacaatactaatttaacatctatcaaatttttatcttttgtactgtatgtgtttcagcttttcaagtatgctaatttcacatttctaatattcagtgtaacaatagtgcatgtaatcagtttattatgcgtatgattatacaaaataaaacattcttctctatagcattatatctgagatttgttaaaaggcacatattatcataacacttcctgaccagttttgttttatggtgtctggctttggttatcataatttttcctaaaatattgctaaaagaattttatttaaagcctctcaaattgtgcctacacatttaagagaaaaaggctatgcattattcttgagtaaattcagaatagtaaattatcagatattagttgttctaaaatctagtttaacttttatttttgattaagtcatagcaatatatattacaagattttatatgttaaaaagtttttaaaatgtctgatatttacctcttttgtcattctagaaatttgcagttcttcagtaacctgacactctttctagcatgtagttattaaatctgtgttgatcatgtattacttaagggcagcttgtgcagattcatattgtactttaatgtgctcttccaggagaatattactgaatttgatatattttgttttctagattgctctgagaggcccacctggcccaatgggtctaactggaagaccaggtcctgtggtaggttaccccaacaaagataatatatgttaaaattttcaaattagcagttccctgtgcaacttcttccagggattgtgcatatctatggttggtgacaatagggtatgttttcatgcttgctgttgtttccattaaaaaaatccttctcaattcagttttctgtacattttgatcaaaaggtctcagtaaaaaattttaaattgaataaataaaattaaaaatgtaattgagtcatatccaactattaatttcttaaactataagtatcattcatttgcctaatattcagcttccaaaattatgttttacattaaatccttgagccttaattttatattaaacaaaatgtttgttaaaaaagaaaaatttatttgaggccaatgaaaattatgacacaatcttagggcaagcaagatactttttaaaccgcaggttgcctcagtattccacaaggtgcttcaactattagagagagtattttctcttgtagaaattcttggaaataacaaagtattatttttttctcactagcgtgatagcaagctaagatatttcaaatatttttgtctaaaaaatcttcaaatacactagaatatactaatgttaagtggtgtagcagttcacaggattcaaaccaggattctcattaattttagaatagatggataaataatttatattttaaatatttgttttttgtataaattttttctgctatttacagaacgtattattctgaaagttaaaatcttatctgtattgtacatagtagacacttgcagcaaaactattgtattcaaatttaaatcaagtactttgccttctaattatttagtctgttttactgattatattaggataatagtttttcttcatgtattttatcgaagattttattatgtagatttccttatatttatatttaccataatttagtcataaaattttatatatattttgcaggaatatacattcaatcatataagctcacggggaacacatattctgatactatgtttcatagaatttaaattatataatttaacacattattaaatgtttatcatgtattttatcatgctttgcctttccaaaatacagtaatatggcagattctatatcacttaaccaatgaaatagagttaatttttaattatttgttaatgactcaaatttacataacaggaaagtaagtagtatgttagtgtattatgaaatttggggtcagaagaattaacctaggtattttattaaaaataaaactttctgggactctgaacttaagactgtaatgttgtagattcaggattggaaccagcgactgtaattttaatacgtgcaccaggttgattcctatggccaaagatatttgagaaacagtgccatatttgatttaatttacaaatatcaggctgggcgcggtggctcgcacctgtaatcccagcactttgggaggccaaggcgggcggatcacctaaggttgggagttcgagaccagcctgaccaacatggagaaaccccgtttctactaaaaatagaaaattcgccgggtgtggtggcacatgcctgtaatcccagctactcgggaggctgaggcaggagaatggcttgaacccgggatgtggaggttgctgtgagctgagattgtgccactgcactccagccttggcgacagagctagactccgtctcaaaaaaaaaaaaaaatttacaaatatcagtcctaggatatctaaaactctattattcaaataaatttcatttattatcttgaaaaacacaaggaaatggattcatagaggctaacggcagcaatgagcagaaacaagggaggcacattatattagcagttcttattttcattaaacaaccattaagagccagccaattttccagagactgttggcaaagagaaaatattgacacccataaacacattctcaaagtcataggcaaaattaattaattttatctacttatcactttgatatgaaagttttagcttccttaattattgaaggtaggtattgagagaaaaaaatcatattgtttctttttaccatttcaaaacatgcaaatttgatgtttgcatcaaaacattaaattattagtcttccaaatatctcttaattctatagtctaaaaaagtattcactagattaagatttagaaaagaaagtctacatcgatattttgacatctgtacatttttcctatgaaaattattttaaccaattgtttacatctagttatctttatagacaaatggaggactgtatcataaaacattcaggaagtgtagaaaatctgttttttccctattattttatagtcaatgactgtgtgacattttttagaataaatgttggagcaaaagaattataatctgttgagtaggtagtgcttatatacagagaatgtaatacagtcgattaattaaaaatagtccattctataattgcataattgcattcaattcagtgattaataatctgatttaatgtagaaccccagtttttttcttgcagaagtttatttgcaataattcttcattggaagcttgaaagtcattattctcttaattttaaagattagaaaattcatgttacttgactttttgtattttgtgggcatcgttaatatttcttttactttggagtcaccaggagactataaattgctaccatttttcagatttagcataatttaaatctctgtcatactttatacgatgtagtatttaatggaatgtgtatggatttaaataaattagaatcttttagaacacacagtatttcagcatgaagtaactataatcaccatgtttatttttaatgttctgaaagtttttggggatatgtgttgcctagtgtttaattttaaacctcacaacttgtttataaagcaattttatgttttgtttatttattttagtacacatgccaggttgttgttacaccttttacattttagttatttttatttatttattttttgagatggagttttgctcttggcacctaggctggaatgcagtggtgctatcttggctctctgcaagctctgcctgtccgtttcaagcaattcttctgtctcagcctcctgagtagctgggattacaggcacccgatgccatgcccagccaatttttgtatttttagtagagacggagtttcactatattggccagtctggtctcgaactcctgacctcaggtgatctacctgccttggcctcccaaagtgctgggattacaggcgtgagccaccatgcctggtcaccttcttaattatgtaaatgtatttaagagatgtttgttatacagacttattctcatgggaaaaaacaaaccaacctgggaaaaatgtgttaacactatttcacggcaattataatagtatcaataacaccaggttcttgccattttattatcatacaattcagagtctaaaaaaatctgaatataaaagcagtaacattttgtcaagtccttacagtataaatggattacatgtatatctgatttggtaataatgggttactctactactacatcacagtgtagtcataaataatgctttgtgtgtcatcatatgagttctgatagtgcacacacaaaagacaatttcaatgtgatttcatgaggttagcttctgtgtagtgctacataaaatatagacctttattgctcacaaattggaatgtaatcaacattgagaagagatatatttcaatgcaagtgctggaaaattttactgtgttaattaataagttaatgctaatatgattaaatatattttgaataatgtttaattatttcaggtgcaattggcaggataaaagtagttaggaaattgctaaattaagtgaaatatcttcactttttctctatagggggggcctggttcatctggggccaaaggtgagagtggtgatcc

SEQ ID NO: 192 - DNA, 115172 bp, Homo sapiens
gtcgggaaatggcggccgcggccgggctggggcttcagcgggaggcagcagaggggaagtggtcagcgtggcgaatgacggaaggtggcgagggagaggaagaggggtcgggtgtccgcggagctccaagagggaagacaatcgctttgccaaacacggcagggcatctggaaaggcctgggaacctcacccgccctcccaggcccttcgggctcttttcggtcccattaggaggagggggagggcggcaggtgggaccgggcacaggcctagtcgtgcgacaggagaagggaaggaagggccggccccagctgggtcctccttgcgtctggcctgtgccggacgcccccgactccgagtgatctcgggccggtccccgggggagtccagcttctcgcgccaggggagttctcagccccagggcagtccagggattaggcggaagggggcacgcagccacctggccggggcagggggagctgcgaggagccttttttttttttttttttcctgcgcagagccccttgcgtgacacacagtaggcgctcaatacatgtttattttcagttgagtgttgcttcagcttttatggcttgtgataaatccttatccttctgttctagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaattagtgcttggtggttctcaaattatttcacgcgtggtagttttgatttttgcttttccagtgaggctgtacctttcatccttaggcaaatatgatggctttcaaaagcagctatggggtgggaactgggagtggctgcaaatgggcatggagcgtcttttagagataacgaaaatgtcccaacttagattgtggtgatagttcgcacaactctataaattactaaaaactattgaatttgcacttgaaaagggggagaactttatgaaatataaattataactcaaagaagctcttaaaatgcctatggaataataagtaaagagtagtggggatatgatctattttgtggggagactagcagcaaagtaagacataaagataaagaaacatacactggcctgaggaagtaacaaagtctctttgagcaaactttggacaggctcctctcagctttcttttcaactacaccttgtccttgggccctgtcctcggcctgcctagcccagttttagcaagagtcctgctgagtaactccctcacccttgatacctgatcaccttgtcctgccttgagcgagaatcctgtttagtcagttgagcaagaatccccctacccttgatatctctctccccttaggaattttctttctactgactccctcactctgctgcttgactgtaaatccacacttgtcctagttgtctttggattgagcttagttctatactgaagtctcttttcctctattataatagtactcaaaatatggctttactgcttttgactagtatctggctctgtttcccattggcggaaggcactctcagacagtgcttctagtagtatatattagcatgacctgccagggtacaattctttttaaaaagaccaccaattggctggatgcagtggctcacgcctgtaatcccagcactctgggaggccgaggcgggtggatcaggtcaggagttcgagacgagcctggccaacatggtgaaacccccatctctactagaaatacaaaaattagctgggcatggtggtgtgcgcctgtaatcccagctacttgggaggctgaggcaggagaatcacttgaatgcaggaggcggaggttgcaatgagccaagattgtgccactgcactccagcttgggtgacagagtgggcctccgtctcaaaaaaaaacaaaaacaaaaaaaagaccaccaatttattgccaggcattgtactgggtgctgaggaaatttgaggaaaaacacctattaagttcctgtcctcaaggagctcatagtacagtggggagccaagtagcaagcaaatagccatgcaagtgtataattgcaatgaggacaagtatcatgaaaaggagggtacatggtgcaatgagagcctataaaataggggtattcgactagtcaaggtggtcaggaattgcttcaaagaagcagttattgagctgagagttaaaggaagaatagtggctaattagattggaggtgagagttggaggagctggtttgaggctatgtgttcagagatggcatggtgagtaaaagagactgaatgaaagtggctggagttcaacaggcagttgggacagcagtgtgttgggtcagggcatgcagggccttacaagccatcttaagccattcagtctatatcctaagagccattggaagccctgtgggatggggagaacgaatcagatttgtctttgaaaatattgccctgggggccaggcacagtggctcatgcctgtaatcccagcactttgggaggctgaggcaggtggatcacctgaggtcgggcattcgagaccagcctggccaaccaacatggtgaaaccccgtctctactaaaaatacaaaaagttagccgggcatggtggtgcatgcttgtaatcccagctactcgggagggtgaggcaggagaatcgcttgaacccgggaggcagaggttgtggtgagctgagatcgcgccattgcacaccagcctgggcaacaagagcaaaactctgtctcaaaaaaaaaaaaaaaaaaaaagaaaggaaaagaaaatattgccctggctacagtgtggataaaggattgggaaggagtcagaatgtatggagagttttattagaagccatttcaacaatctagagtagaggtaatagtagcttgtactacaatagccatggtttacatggaggggattggtatattttagggtttcttaggaggtaaaatctgcaggacttggcaatggattggaattgggagggagggagtgtgatattgtgaagtacacatttagtctttagtttgttttgtgctgctataacaatacccgatagtgggtaatttataaacagaaatttattgccttacagttctggaagataggaagtctaaggttaaggtgtgggcaggtttggtgtctggtgaggccattctctttttccaagatggtccctgcacacactgtgtcctccagaggggaggaaggctagatcatgacatggcagaagacagaaagaagggccaagagatagagcaagaggagaccgatcttgcccttttataatggcattaatcccacctgtgagggtagagccctcatggcttaatcacctcttaaaagtctcacctcttaatactattactgcaaccgcccagtgggttcaccttgcctgctgcctagacagagatttatcaagacaggagagttgaaatgaagaaagagtaattcacacacagccggctgtgcaggagaccagagttttgttattacttaaatcagtctcccagagcatttgggggatcagttattattattattattattattattattattattattatttgagacagagtcttgctctgttgcccaggctggagtgcaatgatgtgatttcggctcactgcaacctctgcctcccgggttcaagcgattctcctgcctcagcctcccgagtagctgggattacaggtgcccgccactatgccaggccaatttttgtattttttagtagagatggggtttcaccatgttggccaggctggtctcgaactcctgacttcaggtgatccacccgcctcagcctcccaaagtgctgggattacaggcgtgagccaccgtgcctggctgggatcagagtttttaaagataacttggtgggtaggggcttgggaagtacggagtgctgatcagtcaggttggagatggaatcatagggggtcgaagtgagtctttcttgcagttttgtgttctgggtgggatggcagaactggttgagccagattacaggtctgggtggtgtcagctgctccatcgagttcagggtctgaaaagtatctcaggcactgatcttaggtttcacaatagtgatgttatccccaggagcaatttggggaggttcagactcttggagccagaggctgcatgacccctaaactgtaatttctaatcttgtagctaatttgttagtcctgcacaggcagactagtccccaggaaagaaacgcctatgatcaattttgtttcagaatcaaaccacaaactgaattccttcccaaagttagtttgacctatgcccaggaatgaacaaggacagcttaaaggttagaagcaaggtggagtcggttaggtctgatttctttcactgtcataatttcctcagttataattttgcaaaggtgatttcattacaatggcaattaaatttttcatttttattttatttatatatatatatttttgagacggagtctcactatgttgcccagattggagtgcagtggcgcaatcttggctcagtgcaacctctacctcctgggctcaagcgattctcctgcctcagcctcccgagtagctgggattacaggcgcccaccaccatgcccagctaatctttgtatttttactagagacaatgtttcaccatgttggccaggctggtcttgaactcctgacctcaggcgatccactggcctcggccccccaaagtgctgggattacaggcgtgagccaccatgcccatggggcaattaaattttaacatgagttttggagaagacaaacattcaaaccatggtagtcttcatcctcattttcgcgaattacagcttttaaaacccttagaatctctgaggtgatgagagtatcttttgccctgggtggtggctcacgcttgtaatcccagcactttgggaggccgaggtgggcggatcaccaggggtcaggagtttgagaccagcctgaccaacatcgtgaaaccccatctctactaagaatacacaattagccgggcatggtgacacatgcctgtaatcccagctacttgggacgctgaggcaggagaatcgcttgaacctgggaggcggaggttgcagtgagctgagatcacgccattgcactctagcctgggcaacaagagtgaaactccgtctcaaaaaaataaaaataaaaataaaaataaaaaagtatcttttgcatgctaatgagataactggtggctgaggctcctaggtagatttaggacgggggcgctggtcaaggcaggattagagagttgagactttttcaccacacccccagcctctggggaagggagaggagctgaaggttaaattgactagcagtggccaatgatgtaatcaatcatgcctacatagtaaagcctctattttatttattttttatttttatattttgagatggagtctcactcttgttgcccaggctggagtataatggcgtgatcttgcctcactgcaacctccatctcacgggttcaagcgattctcctgcctcagcctcccaagtagctgggattacaggcatgcaccaccacgcctggcaaattttgtatttttagtagagacagggttttgccatgttggtggggctggtctcgaactcctgaccttatgtgatccacccacctcggcctcccaaagtgctgggattacaggcgtgagccaccgtgcctggctgtaaagtctataaaaacccgaaagaattgggtttggagagcttctggatagcgaacacatggaggtacctagagggtgctgtgcttgtagggggcatggaagcttggtgccccttatcctgtaccttgtcctatgtgattgttccatctggctgtccatctatatgctttgtaatatcctttataataaacctgtaaacatgtttttcagagttctgtgaccctctctagcaaattaatcaaacccaaggggagggtcatgggaaccctgatttacagtgggtcagtcagaagcatagcttacaacctggcatctgaagtggagagcagtcttgtgagcctgagctctcaaactgtgggatctgacactatctccaggtaggtagtaacagaactgaattcaattagaggacatccagctggtgtccactgcaaaactgattgcttgatgtatgggaaaattctcccatacatctggggctacagaagcattctatattaaatagagagtataggaaaatccacattttgtttactcccccctgtatcttacagtgagagtgagcggtcaagggtgacttctcagtttctggcttgtacaactggatgtttggagtaacagcattaagaagcaggacctttaagatcacattgaatactaagttcaggtatgaggactgtgagtttagtcttagacatactgtgtttgacgtgcctttgagaacacccaagagaatataggtagttggatggatggatctagagctcagaaggggcctatatattggatatataaattgtgtgctatatggatatagttgataattcaagccatgtgtggggataaggttgtctaggccaaagagtatcagagtgagaatgcaggagatcaaagaaggaggcttgagaaactccagtatttcatgtggagtacaggagagtcagcctgcaaaggagactgggaaacagcagccagggaggtttaaaagaaagttaggagggacttgtgtcattgaagccaaagaaagaaactgtttcaagatgtagggaatggactgttaacaatgtccattgctgctcagaggtcaaataagatgtggactggtaaatatgtgttgcatttaagaatatggaggcattggtgtcctggatggatctattttcatggaatgacggggcagaaatctagaatggaacagattggagtgtggttagcagagagaggaaggcactttttttttttttttttgagacggagtttcactcttgttgcccaagctggagtgcaatggtgcgatctcggctcactgcaacttccgcctcccgggttcaagcaattttcctgcctcagcctcccgagtagctgggattacaggcgcacaccaccatgcccgactaattttttgtatttttagtagaaacggggtttcaccatgttagccaggctggtcttgaactccttacctcaggtgatccgcctacctcagcctcccaaagtgctgggattacaggtgtgaggtactgcgcccagccggtaggcaagtaatggaaacaaagaatataggcagctatttgaagcactttggctgtgaagggcatggaaaagtcagggtagaagcaggagcgagactacgggtcaagagaggcctttcaaattatttatttatttatttttttgagacagggtctcacgctgttgcccaggctggagtgcagtggcacaatcacagctcactgcagccttgatttcttgggctcaggcgattctcccacttcagtcttctgagtagctgggattagaggtgcgcacaccaccacgctgggctaatttttgcattttttgtagacatggggtcttgccatgttacccagtctggtctcgaattccagggctcaagcaatctgcctgccttagcctcccaaagtgctgggattacagtcttgagctgctgcacccagccaaggactttttttaatggagaaattttgtggatgtgtaaagtttacaattaagggtctgtagggagtgagtggttaaaaatacagcagagagatgggataaatcatagagtacgtttgctaagagagaggagcatctggaatcgaaagcataggtggaggaattagtgttcactaaaaggcaagagcatctctgtcttaattgaggaactaactgctggtaggatgtgtgcaggtatagttggtttatgtttggtgttaggaagatgagagacaacttccttctaaaggctcccccaaccccgttattttttctgtaaatgagggtgtggtcatctgcatgtagagataataaggaggaggagttggaaggctgaagagaatggagaaggttcaatgagttgtaagggtgagagcaggttgtaggttgaccagagaaaaatagaaggactgctgagaaatgttgatggctcacttctggttgttgatggtaaatttactatgagccaagctttatttttttctaagtgcttctctaagtgttctagtgttttatttaatccccaaagcagctctatgaggtaggtattattattatcacccccttgtcacagatggtaaaatggaggtacagcaaagttgtgtcatttgtttaaggacaaagagctagctaggtttggagccaggtagtctgactccaaagcccatgatcttaaccatcactctaaaatatatcctaaaaataggtcctgatcatactttttcattgataaacatagatctgtataatcacatttaaggactacattgttggttttatgcttgatggtctgtccagtgacttttccagaaactctctagctgcattcttgagtcaatgccaaatctcagaaaggagagagcttatttgaaccctatgttacaagagttttgatttcctttccttctagtttgttgtattttccaattttctatagagagtacatataattttcattttgtggggaaaaataaagttaacatctctaaaataaaaaagccaggctaggaagggaatagaggtctaagactcagtgtttttaaaatctactatagctaaacatgtttactttgtgtcttagtttattttgtgttactataacagaatatctgagactgtgtaatttataaagaaaagaggtttatttagaggtttatttagttttgcaggctgggaagttcaagggcatggcctcagcttctggtgagagctttctctctctcattttttttttcaagacagagtcttgctctgtcgcccaggctggagtgcaatggtgcaatcttggctcactgcaacctccacctcccaggttcaagcaattctcctgcctcagcctcccacgtagctgggactacaggtgcacgccactgtgtctggctaattttttttgtagttttagtagagatggggttacaccatgttggccaggctggtctcgaactcctgatcacaggtgatccgcctgccttggcctcctaaagtgctgggattacaggcatgagccactgtgcctggccgagagctttcttgacacatcataacatggcagagaaggtcaaaggggaagtgaacacatgtgaagaggcaaaaccttaggggcatcctggctttataaaatcctactcttgtgggaactaattcattcctaagggaatgaatccagttttgaaagagggagaactcactcactaccatgagaatggcaccaagccaatcatgaggtatctgctctcatgacccaaacaccttccattaggccccacctcccaacatgccacattagggatcaaatttcaacatgagttttggtgaggacaaactatatccaaagtatagcattctataattcaacaactccattcctagaaatttcatttcaagagaaattaaagcttatgtgtatataaagacgtgtacaccggtgttcttaccaattttatttataattgccccaaactggaaacagacaaatgtgcataaacaagtgagtagataaactgtggtatatccatacaagggaatactatttagcaataaaaaggaataaatccttcatatatacaccaacatggacaaatctcaaaataattatgctgggtgaaagatgtcagattaaaaaagagagtatatactgtattattacatttatatagtataggaaatgcaaattaatatacattttcagtactcagatcagtggttacctctgaaggtgaggattaactaggaaggggcatgaaggaatcttatgaggtgatggaggtgttttatatcttggtctagttacaccagtgtatacatatcaatttcattaagctgtgcatttgagatttatgcatgttactctgtgaatgttgtatctcagtaaaaaggttaagacaaagtttagctccttttgtcagtctcctttccctttcctttgaccctttcctatatttctttttctctccatctctctctgttctctactttttgtatccatttgagagagagttgatggcacatcaggcactcatgctgactctacacttaaccctgccaattaaatgttcacatcccttcaaatgtacagtttattcaggaaagtaggattgaagaagtctgtggttaaagaatagctcttaggagtgaacatttcttccttttcccttgcacttgaattagatacgtatctttgggccttcacttctgttttggtatttcttttcctttttttttttttttttttttgagacagagcctttgtcacccaggcgggagtgcagtggtgtgatcacagctcactgcagcctcaacctttcgggctcaggcaatcctcctgtctcagcctcccgagtggcatgtgccaccatgcccggctaattttttaagttatttgtagagatggggtctccctatgttgcccagactggtctcgaactcctgggctcaaggaatcctcctgcctcagcctcccaaattgctggaatcacaggcatgagccgctgtgcccagctctgttgtggtatttctttaacagctggcgttataggaatcagacagacttgcctttgaatccctgctgcaccacttgttagctatttgatcctgatacaatgacttatcttctatgatcctcagttttctcatccagagcatgggtataataatgcctacctcctagattgtcttttttttttttttttttttgaggtggagtttcgctcttgtcgtccaggctggagtgcaatgacgtgatcttggctcactgcaaccttagtctcctgggttcaagtgattctccaacctcagcctcccgagtagctgggactacaggcatgcgccaccatgcctggctaatttttgtatttttagtagagatggggtttcaccatgttggccaggctggtctcaaactcctgacctcaggtgatctgcccacctcggcctcccaaagtgttgggattacaggtgtgagccaccgcgcccagccaggtgtcttaagaattaaatgagataatattggtaaagcactttgcctgccatcgagaggccacttaatttcggatggctttcttatttcccaagactgtgaacttgtgacttttgactcttggatgacatctagccctgctccattagacattaaataactctttttattgttactagtataacaactagggagaggacttatacttgcaatatgacttttaaatctgtccttgggctcacataacatgtttcttaccatataagaatggagaaggcttttttattggcttccacgacattcctgggtggttggtttgagacagctagttgttgctatcctgttacagaggtgaaggcaggagaggcatcttgacttcaccaagatcttatatcttgtatggtgataggtctggcactgacaaatgttctatatctttccttgagcagatgtaataagacattacagacatctgagtaaataaaaatagggttatggtttttcttcctaccccagactctaccagatgactcattcctactacatagaaataacagtgaatgtcaaccataacacagatgcctatttatttctctccttactgactcatttttgagagctttttagctagttgtgctatttagttgatctcaaagttatcttctgcagggaagtttcggtggaaagaacactgatatttgttgaatgattgctctgtgtcaaacatagggctagttgtttttaaggaggtctaatcaactctgaggtaataaacactattggattttggagaatgagaaaacttgattgtggaaaacagaaccagtttctagaccgccactcagctaatatgtgacagaagaaatatcccttatccccatccattgattttatttctttttgcttcagatttaaagagcatgtgacaaatagtctagcctttctctgtcttagccccattgcagtcactgttaaccaactatcttcttgaaaccaaaatgactcagcctaaccacagaagcaaatcaaacactgatggcccataatctccagacaaggctttaaccaaacctctgtctatccatctatccatttgttcattcattcaacagatatttgttgagcattgactctttgctagacattgtgtgaggggttgttgttgatgctagagtagaactatttatcttccacaaatgaggcatgaccctgctagggacctgtgttactagcaagcagctttgaggtcagggtaggaagtgaggatagagtctcagaaggaagaaaataaatatttacagagtgtggattgtatccaattcatgggatcctgggaagttcattaactgccaggaggattcctagttctcagctctaggcagcagcatcttggaaggcttctctgaaggtggactccgaaggatctaaggctcagatgttcccctttcagcttctgccctccattccctgcactcctaggtcttagatggtcatgcttgtctctgtatccaaaacctacttttggcacatttttatttcctcccaagctgtaagaacagcttgttcacttgggaaggtcatacttcaaagtggaactctgccatttcagaggggctttgaagatacacagtatacctgggggagtgaaggagttgggtgtcactccccaggataaggcaaacaaaaacaagaacagacacatatcactatgacttaggtatggattaaagattaactgcaccttgcacagaggtggctctcaatacgttttctgcattccatcttgagcatcattttttggctctattgtattctacacttccttcccagaagtttacagtgtttcctaattcactgataagcagttaaaaaattgccccacatttggtattacaaaagtttatgcaccacgtttcttttttttttgagacagagtctcgctctgttgcccaggctggagtgcagtggcacaatctcggctccctgcaagctctgccttccgggttcatgccattctcctgcctcagcctcccgagtagctgggactacaggcacccgccaccatgcccggctaattttttgtatttttaatagagatggggtttcattgtgttagccaggatggtcttgatctcctgaccttgtgatctgcccgcctcagcctcccaaagtgctgggattataggcgtgagccaccacgcctggcctgcaccatgtttcttaaaggcatatatagtgattgttttcttttctagttttgctaatagtgtatgttttgctgatcatgtagtaacagtgttttctttataaatttatgaaagtacaaaaagatatatatgaaaacaaatgagccagaggaaattactattgatattctggcatattttcctccagcttttcaacaaatcttgaatatataatcttgaattactcttttaaaaattgacattataacatacgcattttcctgttttcatttaaaaattcccataaacatctgtttcaaggtttgcatattctcccttttatggctgtaggcaggttcactgaatgacaacttagccttgaagccctctatgaccactcttgaccctatatgtcttgcctctggaatggactgaagcgaagatgagtcccgtgttctctatcccttaatagtggtttcatgtgagggagttctgctttgctggatagggtgaatcacatcctccaagacaccagccttctaaaacatttaccatatagggctgggcgcggtggctcatgcctgtaatcccagcactttgggaggctgaggcagtaggatcacgaagtcaggagttcaagtctagtctgaccaatatggtgaaaccccgtctctactggaaatacagaaattagccaggtgtggtagtgctcgcctgtagtcctagctactcgggaggctgaggcaggagaatcgcttgaacctgggaggcagaggttgcagtgagccgagatcctgcccctgcactccagcctggcaacagagcgagattctgtctcaaaaaaaaccccatgtatatacatatatacgtatatatacacatatatatgtatacatatatgtatatacacatatatacgtatatatatgtgtatatacacgtatatatgtatacatatatgtatatacacatatacacatgtatgtatacatatatatgtatatacgtgtatatatgtatacatatgtgtatatatacacgtatatatacacatatgtatacgtgtgtatatatacgtgtatatacacacacgtatacatacgtatatatatacgtgtatatatacacacatgtatacatatgtgtatatgtgtatatatacacacatgtatacatatatgtgtatatatacacatatgtatacatacacgtgtatatacacacatatgtatacatacacgtgtatatatacacatatgtatacatatatgtgtatacatacgcacgtatacacatgtatgtatacatatttgtatatatactcacatatacacatatgtatacatacatgtgtatatacacgcacacatacacatatatgtgcatatacgcacatatatacatatatgtacacatatgtatatatacacacatatatacatatatgtacacatgtacgtacacatatacatatatgtacctatatgtacatatatacttacatataaacatatgtacatatatgtacatatatacttacatataaacatatgtacatatatgtacatatatacatacatataaacatatatacctgtatgtgtatatgtatacacacacacacacgtacttaggacagtgttgtgcaataggaaggtcttcataaaaacatttttgggaaaagtacttaatttctctgagtctgagtttcctcatctgtcacatctgtttcctcatctgatccatgtggattgcaggtacaacaagtcactgggttgttgtggtgattaaatgagaaaatgtctataaatgaatcccagtgcttggcacatagaatgtgctccataaatgtcagtcattattactattccctgataaatgacgtagtgtggagaagtatcgattgagtacagaaaacaggacagggcttggaagtggtgattaatgatgatgcaaaaaaaaattattctcctgcaaaacctgcttgctttatgcacatttggactattggggcagagaccatggtgggcctgtgggctttgaaaccacctcagaaaacattttgccttagaacattcttttctatttttatttttaaaaagaagatatcttgggtggttatccacttttttttttttttccgagatggggtctggctctgtcgcccaggctggagtgcaatggcttgatcttggctcactgcaacctctgtcctctgggctcaagcaatcctcccacctcagcctcccaagtagctgggaccacaggcacatgccaccatgcctgcctgttttttgtatttttagtagagacgtgggtctcaccatgttgcccaggctgatcttgaactgctgagctcaagcgatctgcccaccttggcctctcaaattgctgggattacaggtgtgagcaatgtgcctggttagagtattctttttttttttttttttgatatggatcctcatactgtcgcctaggctggagggcagtggcatgatctctgctcattgcaacctccgccgcccaagcgattctcctgcctcagcctcccgagtagctgggattaggggcatgtgccactatgcctggctaattttttgtatttttagtagagacagggtttccccatttggccaggctggtctcgaactcctgacctcgtgatccgcctgcctcagcctcccaaagtgctagaattataggcgtgagccactgcgcccggccatggtcagagtattcttaaaaaacatcaaaatgagtatagggtgggaagggactaacatttttttttattctattcaatttatttatttatttatttattttttattatactttaagttttagggtacatgtgcacaacgtgctggttagttacatatgtatacatgtgccatgttggtgtgctgcacccattaactcatcatttaaccttaggtatatctcctaatgctatccctcccccctcccctaaccccacaacaggccctggtgtgtgatgttccccttcctgtgtccatgtgttctcattgttcaattcccatctgtgagtgagaacatgcggcgtttggttttttgtccttgcgatagtttgctgagaatgatggtttccagcttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacagtaaacatacgtgtgcatgtgtctgtatagcagcatgttttataatcctttgggtatatacccagtaatgggattgctgggtcaaatggtatttctagttctagatccctgaggaatcgccacactgacttccacagtggttgaactagtttacattcccaccaacagtgtaaaagtattcctatttcttcacatcctctccagcacctgttgtttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatgaggttgtttgatttttttcttgtaaacttgtttgagttcattgtagattctggatgttagccctttgtcagatgagtagattgcaaaaattttctcccattctgtaggttgcctgttcactctgatggtagttttttttttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcctttccccatttcttgtttttgtcaggtttgtcaaagatcagatagttgtagatatgtggcgttatttctgagggttctgttctgttctattggtctatatctctgttttggtaccagtaccatgctgttttggttactgtagccttgtagcatcgcttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcaggatattgattcttcctacccatgagcatggaatgttcttccatttgtttgtatcctcttttatttccttgagcagtggtttgtagttctcctttacgaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctgtcagcttaaggagattttgggctgagatgatggggttttctagatatacaatcatgtcgtccgcaaacagggacaatttgacttcctcttttcctaattgaataccctttatttccttctcctgcctaattgccttggccagaacttccaacactatgttgaataggagtggtgagagagggcatccctgtcttgtgccagttttcaaagggaatgcttccagtttttgcctattcagtatgatattgactgtgggtttgccatagatagctcttattattttgagatacgtcccatcaatacctaatttattgagagtttttagcatgaagggttgttgaattttgtcaaaggccttttctgcatctattaagataatcatgtggtttttgtccttggttctgtttatatgctcgattacgtttattgatttgcgtatgttgaaccagccttgcatcccagggatgaagcccacttgatcatggtggataagctttttgatgtgctgctggattcagtttcccagtattttattgagaatttttgcatggatgttcatcagggatattggtctaaaattctctttttttgttgtgtctctgtcaggctttggtatcaagatgatgctggcctcataaaatgagttagggaggattccctctttttctactgattggaatagtttcagaaggaatggtaccagctcctccttgtacctctggcagaatttggctgtgaatccatctggtcctggaccttttttggttggtaagctattaattattgcctcaatttcagatcctgttattggtctattcagagattcaactccttcctggtttagtcttgggagggtgtatgtgtcgaggagtttatccatttcttctagattttctagtttatttgcgtagaggtgtttatagtattctatgctggtaatttgtatttctgtgggatcggtggtgatatcccctttatcattttttattgcatctatttgattcttctctctttttttctttattagtcttgctagcagtctatcaattttgttgatcttttcaaaaaatcagctcctggattcattgatttttttgaagggtttttgtgtctctatttccttcagttctgctctgatcttagttatttcttgccttctgctagcttttgaatgtgtttgctcttgcttctctagttcttttaattgtgatgttagggtgtcaattttagatatttcctgctttctcttgtgggaatttcgtgctataaatttccctctacacactgctttaaatgtgtcccagagatgctgatatgttctgtctttgttctcattggtttcaaagaacatctttatttctgccttcatttcgttatgtacccagtagtcattcaggagcaggttgtttagtttccaagtagttgagcggttttgagtgagtttcttaatcctgagttctagtttgattgcactgtggtctgagagacagaccacattataacaaacttgttataatttctgttcttttacatttcctgaggagtgctttacttccaagtatgtggtcaattttggaataggtgtggtgtggtgctgaaaagaatgtatgttctgttgatttggggtggagggttctgtagatgtctattaggtcttcttggtgcacagctgagttcaattcctgtatatccttgttaactttctgtctcgttgatctgtctaatgttgacagtggggtgttaaagtctcccattatcaggctgggtgcggtggctcacgcctgtaatcccagcactttgggaggctgaagtgggcggatcacgaggtcaggagatagagaccatcctggctaacagggtgaaacccaatctctactaaaaaataaaaataattagccaggtatggtggtgggcacctgtagtcccagctacttgggaggctgaggcaggagaatggcgtgaacccgggaggcagagcttgcagtgagccaagatcgcgccactgcactccagtctgggtgacagagcgagattctgttccccccccaaaaaaagtctcccattatattgtgtgggagtctaagtctctttataggtctctgaggacttgctttatgaatctgggtgctcctgtattgggtgcatatatatttacgatagttagctcttcttgttgaattgatacctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactaatgggtcttgactctttatccaatttgccagtctgtatcttttaattggagcatttagcccatttacatttaaagttaatatggttatgtgtgaatttaatcctgtcattatgatgttagctggttattttgctcgttagttgatgcagtttcttcctagccttgatagtctttacaatttggcatgtttttgcagtggctggtaccggttgttcctttccatgtttagtgcttccttcaggagttcttttagggcaggcctagtggtgacagaatctctcagcatttgcttgtctgtaaagtattttatttctccttcagttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgccctttctctctggctgcccttaacattttttccttcatttcaactttggtgaatctgacaattacaattatgtgtcttggagttgctcttcttgaggagtatctttgtggcgttctctgtatttcctgaatttgaatgttggcctgccttgctagattggggaaattctcctggataatatcctgcagaatgttttccaacttggttccattctccccgtcactttcaggtacaccaatcagatgtagatttggtcttttcacatagtcccatatttcttagaggctttgttcgtttctttgtattcttttttctctaaacttctcttctcgcttcatttcattcatttgaccttccatcactgataccctttcttccagttgatcgaattggctactgaggcttgtgcattcgtcatgtagttctcatgccttggttttcagctccatcaggtcctttaaggacttctctgcattggttattctagttagccattcgtctaattttttttcaaggtttttaacttctttgccatgggttcaaacttcctcctttagctcggagtagtttgatcatctgaagccttctcctctcaactcgtcaaagtcattctccatccagctttgttccattgctggtgaggagctgtgttcctttggaggaggagaggcgctctgatttttagagtttccagtttttctgctctgttttttccccatctttgtggttttatctacctttggtctttgatgatggtgacgtacagatggcgttttggtgtgtatgtcctttctgtttgttagttttccttctaacagacaggaccctcagcttcaggtctgttggagtttgctggaggtccactccagaccctgtttgcctgggtatcagcagcagaggctgcagaacagcggatattggtgaacagcaaatgctgctgcctgatcgttcctctggaagttttatctcagaggagtacccggccgtgtgaggtgtcagtctgcccctgctgggggggtgcctcccagttaggctactcggggaccagggacccacttgaggaggcagtctgtcagttctcagatctccagctgcgtgctgggagaaccactactgtctttaaagctgccagggacatttaagtctgcagaggttttggctgccttttgtttggctatgtcctgcccccagaggtggaatctacagaggcaggcaggcctccttgaactttggtgggctccacctagttggagcttcctggccgctttgtttacctactcaagcctcagcaatggcaggcgcccctcccccagcctcactgccaccttgcagtttgatctcagactgatgtgctagcaattagcgaggctccgtgggtgtaggaccctccgagccaggtgcgggatataatctcctggtgtgccatttgctaagaccgttggaaaagcgtagtattatggtgggagtgacccgattttccaggtgccgtctgtcacccctttctttgactaggaaagggaattccctgaccccttgtacttcccgggtgaggcgatgccttgccctgctttggctcatgctcggtgtgctgcacccactgtcctgcacccactttctgacactcctcagtgagatgaacccggtacctcagttggaaatgcagaaatcacctgtcttctgcgtccctcacgctgggagctgtagactggagctgttcctattcggccatcttggctccaccccccgggactaacattttttgaatgcctgctatgtgcctgatgctgtaaagtgcttcctccatggtttctaatttaatgctctcaacaatattgtgaggtagagacataatcccagctttactgataatgatgctgagcctcagacaggccctgaaagtcttagaagttcacataactgctaagaggcagaatttccatgcaaatcccaggagtgcctggctccaaacccacgatcctcttacttcaccatgatggtccgcttgctgaatggctcagcaaagcagccaacttaccatctccttcaccttgaaaaagccctgattccatgaaaggcaaagaggagagagcctggagaaggtcagtggtcagcactagaggtgtgccaaaggacagcagtacctgtcaggagagcagtacagatgtgtgcatgcatgtacacacacatgcacacacatgttaatatacatacatacacacacacacacacaccaccagtgctctaactctcaaatctaacactactacccaggagtgtttgttgggaggtagagtaggcaggccacccacaaccgccccaaacactgagtcattttcaattatgtgcgtgaactagttggcaagatcagtcagaaagtctgcagtcacaataatcgtggcctaagagggtctctactgatggcctgtgctagtggttctcagcgtattgttcctggaccaggaacatcagtagtacttggaccttgttagaggtgcaaattctttgctcttctccctactccctgcatcccagactaaataagaaactctgggggtaaagcccaataagttgtgttttaacaagtgctcagggtggttctgctgcagggaattactgactgatggatgcatggattccgttatccacccattcatttattcctgcattttttcatccaaccctaaaagaggtaaccaaaacagaaacaatcctatgtgtaagcatggtatatcttctctgcttcacccagcaaagtgatatgaaaatgcattgcaaatgtgtttacaaataaagctcctttcccatcagggaggattcctagcgctgtcagcaaaaaaatgaagaatgctccaagataggcctcgagagctattgtgaaacagctgctgatggaatgaaatctgcttgctgtgcctgataccaggctgggagtgtcataagatccttttcacaacttgctcccacactcagtcttgtcagtgcaaaacaggcatgtccaaggggtcaccagattagtacagcacaagactccactgggaaagaccttggtggattcagcaaatgaatgactccctgggagtcagactctcagccacacccaagacatgtcctcctcttttcttatacaccttctttatccatgagcacacccaaacccaacatccttggtcctgaccatgggggactttagctgctgtgtaaagctcctgaaactcaagggtagaagagatatgttttaagaatacacagggtttgcctcaaccttgaccaaaagcaggtctgcctgttgggagggcccatcagagacagcaacccatccttgcccccagttttccacccctgtaaaggcttcccagacctctctctacctctatcatcctgtctccaggccactgtcccctggcaaagacactgctatggtttggatgatggtgacccctccaaaatttgtgttgaaatataatccccaattggccgggtgtggtggctcatgcctgtaatcccagcactttgggaggctgaggcgggcggatcacgaggtcaggagatcgagaccatcctggctaactcggtgaaactctgtctctattaaaatacaaaaaatcagaagggcgtggtggcaggcacctatagttccagctactttggaggctgaggcaggagaatggcatgaacccaggaggcagagcttgcagtgagccgagatcgtgccactgcacttcagcctgggtgacagagtgagactccgtctcaaaaaaaaaaaaaaaaaaaagaaatataatccccaattaaacagtattaaaaggtgtagccttttggaggccacatcttttaagtcatgagggctctgccctcataaatggaattagcacccttataacaaggctcaaggttgaagggagcactctcttgcccttctgtcccttccatcatgtgaagacacagtgctcctcctctctggacaatgcagcaacaaggtgccatcttggaagcagagggcggccctcatcagacgccaatcctaccagcaccatgatttcggacttcacagcctccagaactatgagaaataagtttttattctttataaattatgcagtctaagtatttttgttatttagtttttatttcataatcataaacttaactgcaatacagctagacatggaaggaataaggaaaatatggaacccaaaaaactgcagtgggagtacccagattagaggatactgtgagcaaatgagttggagtgctcttctgagctacagaaggaatgatctggtggttaaaacacaagtcacatttattagagttatctacagtccgcaatagttcttgtcggtcttgccattcctgctcccaaagtgctccatggcttccacgatattcatgccctgtttccccttgccaaagatcacatggttgccatccaaccactcaatcttggcagtgcagatgaaaaactaggaaccatttgcgttgggtccagcattttccatgaacaagatgccaggacctgtatgcttcaggatgaagttctcatcatcaaatttctccccatagttggaattgccatcaactattaaggcatgtgaagtcaccaccctgacacataaactctgggataattctgtgaaagcaggaacccttataactaaattatttctctccagtgctcagagcatgaaaattttctgctgtctttggaactttgtctacaaacagttagaagatgcagcccaagggctcaccatgggtggcgatgttgaagaacatggtgagtttgactgtggctggtggcagaggtctctgtgtgtcagcggcatctgcaaagcagcccaatcttaagtattttgttataacagcacatacagactaagacaacttccttgaccaaactttaattgggctcatctgagcattctgcttaaccagggcatgaccttggtctgccattaggcaagaatcctgctaagttattttagagagaatctccgcaccttttatatctaattacctttgatatctgatcaagtttcttattccccacccttgatgtctaagtccttggcttccctctaccaagaatcctattagacaattttagcaagaatccccctacccttgatatctccttttgttaattctctatccactgaccttttcattcttctcattggcaatacatctatagctatctttgctgaatttggagtaagtgcaatctctctcccctcttgtaatagtcttgaataaagtcttccttaccatttcaataagtgccagaataatttctctgttatctgcagctttattaaggtataagtgacaaataaatattgtgtatattgaaggtatacgctgtgatgatttgatatatgtatacagtgtgaaatatttaccagaatcaagttaattacaacctcatcacctcacatagttgccattttgtgtgtgtgtgtgtggtaaaggcacttaagatctactctcttagcaaatttcaaatatacaataattattattgactataatcactatgactaccaacagaaggacatactgcttgccctggctgtctccttccccttcctccaagctcttggaataacattgctgtcaaaaagttgtgggtaaaatgcagatgtgtatatgtacacagctttatttgagattaaatttaggagttaaaattttagaaagtaagacatgatgtattttaaccataataagtaagatcttgaaataagaggaaggacacaaaagataacatttctacatcattatcatttgaaatattactattcttggcattctcatgccaaagtatctccaaccccagccaatggtatatttgctatcctggattttctgacattatttgtagagtactgggctggcagtcaaagctccccccactatggataaagaccacattttcagtcctgttttccaggaactctgtgctcttggcaaatggcacaattttctgctccctcaaaagactccttcatttttccacaatgctttagcatgctagggttgaattttcacagggcttggccttggcacacacatgatgtcaccacatcctcagatcaaacccatgaaagagcattggtacccagttttagaggagaagaaaacaagtcttgaggagagtgtcttgccagccttgtctttgttaaagaaacagattgctggagattagagaagggtggaggaataaagttgttttggtgttaaattacaaaatgaatataaatcttgaatacatgttcaagttacataaatggtgtttattattatgaagtctcgttagcagcactggcataaatttgcccctccagctctatttccagattcctttcccctacccctatctattttgtggagggaggatgtgaggagggaaaagaggagagggtgggtatgtggcgcctaccctggggaggagagttctgtacttgggtggtagctacaaagttggatgtagttaaagtgagccacctttccccatgcagattcccttgcttggcacgtagtaggcacaaacacatgtttatttccaattgacagttgtctttattgattgtgattacattttttccttctgttgcagaagaccttactgctgatagcaccatcttcaaatttgtggaagcttatgtgagttggataggaaaatttcctacatataatgttggctcttccatttgtttctaatttagtatttctcaattgatattttttttgttgattagaaaaacaattttacttcctgcagaatatactgaaaatgtttttacttcctctttgaaaccactttttatttcttcagccaccctgatttcttgtctcttggttttttttgagcagatttttagtccctttttaatggtctcataagcaagtgtgttcattttgctcattcaattttacctgtaagctatgctagggccttcatagaagctgactgagtaatacatgaagaaggatagacatgtggtatgtactgtgggcagaataaaacaagggggcataaaatggcaacttcctacattgcttccactagtatctgtagtggtatatatctgccctttgaagggagcaatttgtttgaaagtcccttatgagttatctgctgttgcataacaacttacccccgaacttagctgcttaaaataataattttttattatctcacatatttctgagtgtcaggaatctaggagtggttaagttgggtgttttgggcttcaggtctctcatgaggttgcaattaagaggttggctgaggccagttgtggcagctcacacctgtaatcccagcactttgggatgctgaggcgggtggatcatgaggtcagaagttcaagaccagcctggccaagatggtgaaaccccatctctactaaaactacaaaaattagccgggcgtggtggcaggcacctataatcccagctacttgtgaggctgaggtagaagaatcgcttgaacccgggcagcagaggttgcagtgagccaagattgcgccactgcactccagcctaggcgacagagtgagactccgtctcaaaaaaaaaaaaaagtcagctgaaactgaagtcatttgaaggtttcgggttaaaggatccacttccaagacagttcacagagctgtttgcaagatgcttcagttcctcatcatgtgggtctctttacagggctgcttgagtgtactcatgatatggctgctggcttcctccagagggaatgatctgaaagagagagagataaaggagaaagctgtgatgtcttttatgatctagtcacacactgttgtttttgccagattctattagttggaagcatgtcactaagtccaacccatacttaaggggaaggaaattagcatacacttttagagggaataatatcaaataattgtggacatctttttaaatcaccacagtccccttaattttacctacctattacctattcattcaacaaatattttctgaacatgcctacttagtgctgggtcctatgctaaatccaaaggatccagtggtgagaaaataacagtaagaacatcgactaaaccctgacaaggtttctcttgatgtctacagacagagtgggaggtgaagaggtggtcagacaacaatctgataatgaaacaaacaaatgtgaagagaagacgcttagatgatgttggccctgaattggaaaaggctgtctgggagctcggctgcccacccagcattcagtgtctgctacctcctgtctgttatgcttgtgtctggttttttcaagttttaattttttttttaattcttagtttttgtgggtacatagtaggtgtatatatttatgggttacatgagatgttttgatacaggcatgcaatatgtaataatcacctcatggagaatggggtacccatcacatcaagcatttatcctttgtgttacaaacggtccagttagactcttttagttattattaaaatgtacaattaaattatttttgactatagtcaccctgttgtgctagcaaatactaggtcttattcattctttttaactattttattgtacctcttaaccattcccacttcctccccaccacacactatccttcccagcctctggtaaccatccttctactctatctccatgagcttaattgttttaatttttagctcccacaaataagtgagaacatgcgatatttgtttttctgtgcgtggcttatttcatttaacataatcacctccaggtccatccatgttgttgcaaaagacaggatctcattctttttatggctgaagagtactccattgcgtataagtaccacattttctttatccactcatctgttgatggacacttaggttgcttccaaatcttagctattgtaaatagcactgcaataaacatgggagtacagatatatgttcaatatactgattttctttcttttgattatgtgcccagaagtgggattgctagatcgcatagtagctctgtttttacttttgtgagggaatctccaaactattctccatagtggttgtactaatttacattcccaccaacagtgtacaagggttcccttttctccacatccttgccagcatttgttattgcctgtcttttggttaaaagccagtttaactggggtataactggggtaagatggtatctcattgtaggttttttgttttgttttgttttttgttcttttgagatgaagccccactctgttgcccaagctggagtgcagtggagtgatcttggcttgctgcaacctccacctcccgggttcaagcgattctcctgcctcagcctcccaagtagctgggactacaggcacatgccaccatgcccggctaatttttgtatttttaggagagacggggtttcactttgttggccaggttggtcttgaactcctgacctcgtgatctgcccaccttggcctcccaccaaagtgctgggattacaggcgagagccaccgcgcctggccgtttttttcttttctttccttttttttttttttttttttacagagtcttgctctgtcacccaggctggagtgcagtggtgcaatcttggctcgctgcaacctctgcctcccaggttcaagcaattcttgtgcctcacccacgcagctgggattacaggtgttcaccatcacactagctaatttctgtatttttagtagagacgggttttgccatgttggccaggctggtctggaactcctgacctcaagcgatctgcccgcctcagcctcccaaagtgctgggattacaggcgtgagccacctcgcctgggtcaaatcaccattataactttcttgtactttgatattggtaccttctctaggtttcagaagttctctgttattatccctttgaataaactttctaccccatctctttttctacctcctcgttaaggtcaataacagatttgctcttttgagactattttctagatcctgtagttgtgcttcatttatttaaattcttttttcttttgtctcctctgactgtattttcaaataccctgtcttcaagctcactaatcctttcttcttcatcatccattctgctattaagggactctgatgtattcttcagtatgccaattgcatttttcagctccagaatttctgcttgattcttttaaattatttccatttctttgttacatttatctggtagaattctgcattccttctctgtgttatcttgaatttctttgaatttcctcaatacagctattttgaattctctgtctaaaagatagcatgtctctttttctccagaattggtgcctggtgccttatttattttgtacggtgaggtcgtgtttccctagatggtcttgatgcttgtggatgttcatctgtgtctgggcattgaagagctaggtatttattgtattatttacagtctgggcttatttgtacctatctttcttgggaaggctttccaggtattcaaagggacttggacgttgtgatctaagctgtatgcattaggaggcaccccaagcccagtaacactacggttcttgcagacccatagaggtactaccttggtggtcttggataagatctggaagagttctctggattacccggaagagactctttttctcttccctttctttctctgagacaaacagagtctctttctttctctctgtttttgtgctgagcctcctggagctggaggttaagcgagaaaagtacacctgtggccagcaccactgataattttctgggtcagacctgaagccagcacagcactgggtcttgcccaaggccctctgtaaccactacctggctaccacctatgtttgctcaaagccctagggctctacaatcaataggtggcaaagccagttaggcttgtgtctttcttccctccccttcccacaggcagataagcctcactccatggtcactgccaccacaggcccatggggaagtacttccagattaccatcaatgttcacttaaggcccaagagctgtgcagtcagcttgtagtgagtgcttccatgcctgaggctcgtccttcagggcagtgaactcccctctggcccagggcaggtctagaaatgctgtccatgaggcaaggcctggaatcagggaccccaagaacccactttgtgctctacttccaaggaccaagctcatacctaaggtgcaagagaaagttctctttacttttccctccgcttttctcaaacagaagcagtttttcaccatagccaccagagttggcaatgtgctgggtctctcctgaaaccagcacatctcagaacccaaggcccatagtgtactttctggatattgctgctggttattcagggatccagggctcttcagtcagcaggtgatgggtcctgccaggacagagtctttccctttaagggagtggggtcccttttggcccacagtgtgtatagaaatgtcatttgggagctaaggcctggaataggggcctcacaactctgcccagcaccctatcctactgtgtctgagctggtatccaagatgtaagacagtcttctttactcttccctctcctctacagaaatggaaggaagagtctcttttaaagctgtgagctgtctgcctggggttggaggtggggtggcataagcgttcacttagcctccctggcttgtgtctcaataggtcatgtgaccctcagtcttctggctctgggcccagttcagcactaggacatgcctaggaattgcagtccttttggcctagactgtctttcaagtttatttagggccccagaacactttagcctgtggtgataaggcttgtcagaactcaagttctgaccactgggatgggtaatttccctctggctagggatggtctaaatgctccctctgtgggcaggcatcaactgagttcagcctggttttgctttctgctataacggggcatcactgagttcaatgctaagtctcatgatcactgcattctccttctcccaagcacatgaattttttctccatgtcatgtggctgctgccaggagatgggggaagggtgccatcagcaattcatgatggtctttcctaccctcttcagtgcctctttcagggatatgaagttaaaaccaggtactgtgagtactcacctgatttttagttcttttgaaggtgcttttttgtgtagttgataaatttggtgttcctgttggggagatgatcagtggagccttctatccagccatcttgccctgtccttctccatgtatgtattttgataggtgaagacacaagaccaaaatgtgcttcccagagagcatgaatgaatacaatacttactctggacactgatctagaaagtccaaagaatgaaaggaaatcctaccaattcatttaaaaagaatgtaatgttttttctctcaactctatgtcaacgtaaaataaccaaaaagatcacaatctagtttgggagtttattcaagtgaaaaggttgaggacagcctgcccagtaagcacagatttcaaagaattcaagtcagtgttccaaagagtagaagttcaagatcgtttatatagataaggttcagggaagtttaacagaatttcattgtctttctatggaagccttaatgtataattacaatgatacaattggtcaaggtggtctttttcttttaggaaaggtatatttaacattccacaccgaatatataactgtcatggggtacctatttgggggtgttatccgatctgagttagatgcaggacaataaaggaggcagttggtctataacaaagatcagtgattggaagggggaagtctagtctctgatctttcctagttatttacagagcaagaacaatgaggaagagagttaatctgtgatctaagaagcagaagttataaatacgtgctacatgactcagatcacagttacatctctcttaagtctttaaatgtcttgaggcttccaactgcttttatattttattttcacaactagtcccttcagaacaactcattatatcatgcagaaatagtattaagttatcacacaatgtacaaaatattatttattttcctttttgctgttaaatttccataggttctccatgacatggttgggctggtttttttggtttgtttgtttttgtttttgtttttgtttttgttttttgagacagggtttcactctgtcgcctaggctggagtgcagtggtgcagtctcagctcaccgcaatctctgtctcccaagttcaagtgattctccttcctcagcctcctgagtagctgggattataggcgcacaccaccacacccggctaatttttgtatttttagtagagatggggtttcgctatgttggccaggctggtctcaaactcctgaccttaagggatctacccacctcggcctcccaaagtgctggaattatagatatgagccaccacgcccagctgggctgtttgttttattattattattattattattttcagaaaggaggtagtagggagggagaaaacttatattgaatgagcaattacaacacaccggttactttatataggttttcttatttaattctcattaccaccctgaaaataaagtactattatcaccattttacagataaggagatgaacagttagaacggttagatagttttttttaggatcactcaactagtgagtggaacaggaaggactcaaatacagactttgtttaactgtggtgtttattatggtgcttcattttgagatggtgtgctttcaagatttagggttacattgatttgagcttgctaagtcatagagttcttttttgattaaatgccaaaatgaatataaatctttaccatattttcatgacacaaaaatagtatttgttattatgaagggccactaacattaatactctgagctccatggctctaagcccctaattgctcagtttcagtaaatttgatgttctatagacccatgcttctcaaactgaaatgtgtaaacatatcacctggggtatgtggttaaaatgcaggctcttatccaataggtcccgagtggggcctaagctgcatgtctaacaggctttcacgtggtgctgatactgcttgtcttcatatcatagtttgagtagcaagactgtggagtagcaagacttaaatactcttgaaattcccggggtacttccagcagtctaagaatttgtagacacggacaaggatggctagctgtgctagaactctgaggcttctggtcacagctgttttacaggggttctcctctacaccagaactctgcttgtggtaccacttctatctcctgtatatgagtggatttgctatgccaaatccacatagcagagtggaaatctgctatgccaggtattactggatctgcatgctattgcagtcccttgatgttaattataagaggatgatgagcaatggcagcctagaagagggtgaatcagagaggcaagtacgataggtatctggtgcttgatagggaggagagagagggagcctggaccatgaagagttttagaaagtttaaacttccctatatacctctgtaagccagatgttgagtaaggttttagagatatagcgtcgttaccctcaagaaaatttcagcctggaggggaagactgatgagtaacctacagaacatagtgatgggtgtaagtttagggcattatcagagcctagagcagagccatttaactcacacttgggatggggtggggaaggagcagggcagtggtgtgttggaaaatgtttaacaatcagttctctgaaaaaaataaaagctctgatctgtagtgtttgttgacttccatggtgtaaatacttccatcatggccaatttctttttttttttttatttttttttgagatggagtctcgctctgtcgcccaggctggagtgcagtggtgtgatcttggctcactgcaagctccgcctcctgggttcacaccattctcctgcctcagcctcccgagtagctgggactataggtgcctgccaccacgcccagctatttgtttttgtatttttttttttttcagtagagatggggtttcaccatgttagccaggatggtctcgatctcctgacctcgtgatccgcccacctcggcctcccaaagtgctgggattacaggcatgagccactgcgcctggctcatcatggccaatttcaaggtactatcttgatgtcactgaacaaagaattgggaagagatgttcataattggctcttgtaagtcaggccaagctgactctaagcacaccattgaggtagtgaatccttcccaaagtaaatgtctttgtcaattcgggctgtcataacaaagtactatagactggatggcttgtaaacaacaagagtttattcctcacgtttctggagtctaagatcagggtgccagcatggttgggctctggtgagggccctcttcccagggttgcagacttctaacttttcactgtactctcacatggtagaaagagggcaaactagctttctggcctcttcttataaaggcattaattccattcatgagggctccatgcttattacctaattacctctcaaagtccccacctcctaatattatcacactgggcattgggatttcaacatatggattttttgagggaaggagggacccatttagaccattgcagtgggaaagaagagatttgaaggataagcagaagttagcccatcaaatgtagaggacaaatgagaggattccaggtagaaggatggcaggtgcaaatgacccaaggtaataggaaacatggtgctttggcagtaagttatgaattagagtggaagtggacagtcctaagtctccaagtaggcaaacatataattacagaacacatttaattttactctcttttctgatcccattattgcatttgacaaatcatttccatcaaactagaccaatgctgcatttatgtctgtgatgagcttaaatcttagtaaggacattaattgaatctatttgtattttttttcaaggtattaagcaaatcatcttattagatactccacaaagagcatatttgtagtaagtaatgacacaattttagattattaccactaaactcttttaaagataatttataatctacttaagaattacacagctatcacaatgtgcatcttaacaaaggcacaaaaagataatgctcctccatggtttattatgattttgtgtataaaaagaagatatatgaatactttttttctcaactttcattttagtttcgggggtacatgtgcagatttgtcacatgggtaattgtatgttgctgaggtttggtgtataaatcatctcaccacccagattgtgagcacagtacttgataggtagtttttcaaccctcgcccccctccagcctcccgtctagtattccccagtgtctgttgttttcatctttatgtccatgtgcacccaatgtttagctcccacttataagtcagaatacgagacatacggttttctgtttctgcattagtttgcttaggattatggcctccagctgcattggtgttgctgcaaagaacatgatctcattctttttttaatggctgtgtagtattccattgtgaatatgtaccacattttctttatccagtccaccgttggtgggcgggtacccgggttgattccatgtctgctattgtgaatagtgctgcaatgaacatatgggtgtgtgtgtctttttggtagaacaatttattttcctttggatatatactcagtaatggggtgctgagttaaatggtcgttcaactctagttctttgagaaatctttaaagtgttctccatagtggctgaactaatttacattcccaccaacagtatataagtgttcccttttctctgcagcctcatcaacacctgtttttcttttttttgctttttaacaaaagccattttgactggtatgagatggtattttattgtggttttcatttgcatttccctgatgattagtgatgatgagcacttcttcatctatttgctggcctcataggtgtcttcttttgagaagtatcgttcatgtcctttgcccatttttaatggtgttgttttttgattgttgaattttaaagtactatagatatgtacttctttttattgtgggctttttcaaacctacataaaaatagagtggtaatgaattgccatattctcaccaaccaacttcaacaattataaactcataactaatctcatttaatccttctaaagagtttggacttaaaaatccataacttcagtgttattattattcatcaaacaattaacaatattccttaacattattaaatcttcatttagtgttctaattttcttaattgtctaatttttcctttataatttgtttaaaacaggattcaaagtccatatattgtattttattgactttttaaaagtttctcttaatttgttggttctctgtgtatttttattttaaataaaatatttattttaaataaaattttattttaaaattattttattttactttgaggtggggatttgctatgttgtccaggctggtcttgaacttctgggttcaagtgatccttctgcctcagcctcccaagtagctgggattacaggcatatgctactacacccagctttattttaaaattatttcaacttctttgttgaagaaaacaggttaatttagcctgtaaaattttccacattctggaatttactgactgcatccctgtggtattgattaacatattattttgcttcctagtttcctgtaaactggtagatctagaggcttgttctgattcaggtttgattttctggaaggaatatttcataaatgttatttgtatttctttcaagaggtacatactatctgactgaaggtctcttttttgtgatgttagtggccatcaatggtcatagcctagattcattatttccttagggatttgtaagatggtgatattcaatttctgtaattccttcttcatttattggttaaaaaaaatggccttggtgcagtggctcacgcctgtatccccaacagaggcagaggtgggcagatcacctgaggccaggagtttgagaccagcctggccaacatggagaaaccccatctctactaaaaatacaaagttagctgggtgtggtggtgcatgcctgtaatcccagctactcgggaggctgaggcagagaatcacttgaacctgggaggtggaggctgcagtgagccgagatcgcgccattgcactccagcctgggcaacaaagcgagactgcatctcaaaaacaaacaaacaaaaccccccaaacccccctttttttagacggagtctcactctgttgcccaggctgaagtgcagtggcaccatcttggctcactgaaacctctgccttctgggttcaagtgattctgctgcctcagcctcctgagtagctgggactacaggtgtgcaccaccatgcccggctattttttgtattttagtagagacggggtttcaccacgttggccaggctggtatcgaactcctgacctcaggtgatccaccagcttcggcctcccaaagtgttgggattacaggcatgagccactgtgcctggcctaaaaaaccttctgtaaatggaaaatttctctcaataactggtcactgtgaggggcaatttggattcccttagcatcatccttcaaaggtggccaataaagattttttttttgatattattatgaattcttagagttttaacatattcgatgtgtttcgactcatcagttcattgcagttgttatttttaatgatgctcaaatttgctgttgcaatcattttcaagttggctcctgaatgcttttgacacaaccccactagcccttgatagctttcttgcttggtaactagtaaaataacataaataagtaatttgaaatatttatgacatgttaactgcaaaattgtgattctaaattaccatttcgttatgcttcatataaaaggaaataaaaactacccttgcatccaacctatggaatgttaagttgacacataagacagtcaaagcttcctttaattcaatatccccccccttttttttttttgagacggagtgcaatggcatgatctcgactcactgcaacctctgcctcccgggttcaagcaattctcgtgtctcagcctcccgagtagctgtgattacaggtgcccgcccccacgctcggctaatttttgtgtttttagtagagatgggattttatcatgttggccaggctggtctcgaactcctgaactcaggtgatctgcctgccttggcctcccaaagtgctgggattacaggcgtaagccactgtgcccggctcaatatcctactaatttctagctttactaggcagctagtgcatgatttcctcttctaaacaaagcattgatacttatctaaataaaataaaataaaattaaattaaaattaaaatggaatggggtagaatctcttccttcttaaaaatgtgttcctggagctactaaaaaacttggattttcaaagtccttgataaaaaccattcccctatattgtagaagggaagtattgggacccctgataatactgggtataagtatgctattcagacttggcttctttccatcctgctgcatcagaggctagattcaccttttatgttttccctttcttgccgtctttagtgtcttgtttagccactccagtgagtttcccttttgcccttcctttcccttatgtttgtactttttactgaaggtttatccttttactttgccttttgtttatgatttaattttaacttctgcaggagcgggtttgaacgactaccttcagatcttctcttgggctctttatttagcacctctttagctgaattgactttcttcttataaatcttggcaatggctgcagtggggagggcaggtgcctgggtgcctgggtgcctgtgggccttcatgaagctggcctacctgtatatttcatttcttgcttatatttccagatgctatctataatagctatgtagctataatagctataatagctctatgcagtttatatcaaagtcttctctttatgtgagaaagaaagcagggtaggccaggactaacatttggtgaagtccttttatgtgtcagacattctttgttgattttctcattatgttctctcttagagtcacgtaaaaggtaaaataaggagggcaagaaaacacaattttttaaaaaaggaaatggcatagggattttctatttttttctcagccccagaaggtaattactcttacaatgcagaagtatcaccagatactatctgcacaggttttcccattttttcctcacaccactgtggtaaagcagggggatctgtcacctccactgaggagactgaggctcacaagaggtgataacatataaaactctatcagtcatttatggagtggagcagaggctctcaaagttcagcatgcatcatctgtaggtgtataaacactaattgctgggccctgcccctagagtttctgattcagaccatctggttgagacccaaagatatgcatttctaagaagttcccaggtaatgctgatgctactgctctagggaccacagtctgagaaccactggtctggctaatagacaaacaaacaaataaacaaaacagcatttattctttacaaggtacatagagaattgcactgagctgagaggattggtggaagtacatggcctggagtcaaagcaaaggggtcagagtttgcagtgtacctaggcccatgacctgggccattcactcaggcagggggtgacactatatcattctcctaaaatgtaagggaaccagtcactggtccttagaacagctcatgtgggcattggtgatttcatcacatctcttaccctggggagcctggtgggtgagggattaagctccaggctcctgggatctcccttgatcttagctattcaaattacttattattaaatccgtaattcagatcagggtataggaagttaggagatgttaagtaaatcagggaaactgtcttataaatgcttacttagtagtgaaacctggaattactgtaaagctttccccatggtgtctggaatccaccagggctctaagtactccaatctgtctgggtaactgatgctgggcggggtatggcttagttttttaaaatagtgaaatatattacttttaaattatattattactgaaaaatttaaaacacagtatatggcaaaaaatcagtaaagcttgtctaaaatgatgacagcaaatatttgcaaactattaatatatgtagctaattcttatgatataggaaaccttcccagtagccaatataaagagatggacaaatgaggtaagcagcctctaagacggtgatctcaatgagccatgcctcctagtgttcatgcacttgcataatccctatccttgagtgtgggctggtagttaggagaggcttaaataatgaaaactgaaattactctaaagcttttctgtttgaagcctccagggctctgaatgctctgatttccctgggtgctggcacttgatgctctccatggtattgctcaatttctgttataatgaactgttttatttatttatttgtacaatataacataatatttaccattttaatcattttaaagtgtacagctcagtggcattaagtactctcacattgttgtgcaaccatcaccactgtccatctccagaactcttcattttgaataaaactctatacccattaaatgataacttcctattctctttttccttagactctggcaaccaccatccttttctctgtataaatttgactactctgggtagttcatacaagtggaatcataccacttttgtccttttgtgtctggcttctttcacttagcataatgttttcagagtcagcatgtaacagactttccttcctttttaaggctgaataatattccattgtatggatatactgtcttttgtttatccattcatccattcgtggacatttggtggtttctaccttttggctattgtgagtaatgctgctgtgagcatgggtgtgcaaatatatgttcaagtctctgtttcatttcttttggctatatacccagaagtggaatttctggatcatatggtaattctatgcctaatattttgaggaactgccatactattttccacagtggctgcaccattttatattcctacaagcaatacacaagggttccaatttctccacatcctcaccaacacttaactattttctccctctctttttttttaaataatagccatcctaatgggtgtgatttattatttatttttaaaactaaactttattttgtaataattttaaatttacaaagctgtataattttaattaacattattgaaaaatttaaaacactgtgtattgcagaaaaaaaggtaaaagttatgtgaaaagtagagagaatatttgcaaactaatggggcttatatttgtgatatgttaggcagacttactgaccaacagtgggtcaatgatgtcaaaagaaaattcactgaaagagcaatatttatgtcagtaaacattgctaatgaaatatcaatgaaagtcagagatatattaagtgaaataggaaaattgcagaagaatatgttatgactacagttttgaagaatatgtgtattttgtatattttatgtaaatatttttctttatatgtagctatacagtagtaaattacgtgtacataaacacatctggagaacatgcacctattttcagtgaaaatctttgggtcagggagtgagagtcaggcagatgaaaggataaatttaatttacacatacacctttttggcttgtttgaaattttgtaatcaggaacatttattaagataaaaatttgtaggccggcgcagtggctcacgcctgtaattccagtactttgggaggctgaagcaggcagatcacaaggtcaggagatcgagaccatcctggccaacatggtgaaactctgtctcaactaaaaatacaaaaattagctgggcgtggtgatgcgtgcctgtaatcccagctactccggaggctgaggcaggagaatcatttgaaccagggagttggaggttgcagtgagccgagattgcaccactgcactccagcctggcgacagagtgagactctgtctcaaaaaaaaaaaaaaaaagataaaaatttgtaaagagcaaaaatatataacccccccaaaaattagatacacatatattatgttttggaaatatgtgtacagtatactggtttcttgggaaaagagcagattaaagcaactgatttggtgatgtatctacttatgtgtgtgttgctatgtctcaaacttcttcaccccaaataatcacacactcacacatgcagctttcccttcagctcaggctggaagtggatgtctagttttagggcttagagaccacagaaagtcctatattcagaggattgctgccagtgggtggtcattccagaaagatctggccggtgccaataagtccaagcctttccctcctttcctccttcccttgcaaagccctctgtcctgactttcataattgcaactctgattctaatcaccaggtggctccattctgtctctctttctccatcaaggttggctgatgtccacactgcagagcactctctggagagaggaggtggttcaagtcctcaaataccatacacctataatgacttcccgaatcaggccactttacatacagctgctcagaacggtttccctgaagttagctctaatattgtcacacaaacaccctcagaggcaatccactacccacccaagagaactatgcactctttcccagctggcatgcaaggctcctcatcccatggatccagactacatttccagcactctcttgcaagtgctcttggcaaactgtaccactgctcctctttcaagggactcttgtcttttttgtgtgcctctccattaggttaggggtcaatttgcatagactttggcccctgcccacacatgataacattaaatatttagatcaatcctttgaggagggattgttatcctcattttaaagaagtggaaactgaacctcagggaaagtgagaaccagtcttgtcttcgggaaagacactggggttatagaagtaagagacccagtggtagcttggtagtgataatgaacagtattattttgctctataacaaagaggaatggataaagtgcttgctacaattaagtgcctactatgtgtagtattaattttattatttatttatttatttattgagaggcggtctcactgtgtcacctaggctgaagtgcagagtggcgtgatcttgcttcactgcaacctccgtctcccaggctcaagtgatggatcctcccacctcagccacccaagtagctgggaacacaggtgtgcaccaccatgcccggctaattttttttggtatttttggtagagataaggtttcgccatgttgccccggctggtctccaactcctgagctcgagtgatccacctgcctcggccttccaaagtgctgggattataggcgtgagccaccgcgcccagcctattttttctaagatttaaataatatgtgttcaggctgggtgcggtggctcatgcctgtaatcccagcagtttgagaggcagaggcgggtggatcacctgaggtcaggagttcgagaccagctttgccaacatggtgaagccccgtctcgatgaaaaatacaaaaaaaattagccaggcgtggtggcgggtgcctgtaatcccagctacttgggagcctggggcaggagaatcacttgaacctgggaggtggaagttgcagtgagctgagatagcgccattgcattccagcttgggcaaaaagagtgaaactccgtctcaaataagtaaataaataaataaaatgtgttcattgtagaacatttagaaaatatattaaaacagagagagaatgggaatgaacacccacaataccacaactagaacagcccatccctttctaggatttgctaacatcaagtggtaggttcaagaatgtcaagttatacctataaaataagtgaagataggtcaagagagggtgaaaacgtttccaggttccatcttactctgactccaatatgcacaactccaattttactgcattgcttccccttttagatgatggatttctagatttctagagctcaggatatggctgtgttacatttgtttggaatggtgcacatatattatgaaatgatgcgtatatatgggtaccagtttatgtatctctcttgatggagataaaatccctttctttgtgctaaagggccaaggtgtatgaccaacatcacttggtctccaaggcagtaatatatatagaaaatctcacaggctttggaatcacagatggagtgcggaatgcaggcaagggatctaatacttatttaggagtgtgctatagtcagacaatgtaaaatttatactaggcttgagtaatgtctaggatgtattttttattctctaaggtaaccactacatgaatagtaatagaatctataattaacaagataatggggaaaatggaattataaaaaaccattatgcatttcaaaagagggcaagagaaaagagaaaaagcaatataaaacaggaagaacaaatacaaagcaaaaagtaagatggtagatttaagccccaaaataccaaatataccatctatataatatatattataggtaagcagcctaaacattccagttaaaacacaaaatcagaatgtattaaaaaataactacatgttgtctataagagatccacttttaatatgaagccacagaaggctaaaagtaaaaagatggaaaaagatatgccatgcaaatattaacaaaaaagctgatgtagttgtattaatatcagataaagtagactttaaagcaagaagtggtagtaaagacaaaaagggacatttcgtaatgataaaagagtcaattcagcaggaagatcaaataattctaaatttgcatgcatctaataatacagcttttaataatataacaacattatgtttgtgagattcatccatttggttacatgcggcagtagtttgttcattattattgccgcatggtgtttcattgtataaacttttctcagtattggtaaaataagacaaaaataagtaagactaacaaatatttgaattgcacaagtaatcttaacataactgacaaatgtagaaccctgcactctaaaactgcagaatacagtttatttttaggtacaaggagcatctacaaaatttcactacatgaaaggcataaatttagtctcaacaaacagcaaagggtgaaataacacagtgtatatcctttagctattgcaaaattaagctacaactttaaaattattaaaattataaaatgtctagaagaaaatataatagaaaatatttgtgatcttgtgtttggcaaactttttttggtaggacacaaataggacaaaccataaacggtgaataaataaactggatgtacccaaataaagactactgccctttctaagatgctgttaaggaaatgaaagctgaactatagacagggatgaaatatttgtaacttaacaaagctaataaaggactttatccagaatatataaagaactctcacaattcgatattaagaaaacaacaactgaattttaaaaatacaggtaaaagattagaatatctgcatctgttagagtggctttaaaaatgacaaaaccaagtgcatgtcagaattggagcaactggaactctcatatgattctagtgggaatgtaaaatggtacagccactttggaaaagagttttgtatagagttaaacatacacttcccatgtgactcaacaatcccactcctcagtatttacccaagagaaataaaaacataggtccacacaaagacttgcatgcaaatatttatagcagctttcttggtaattggcctaacctagaaacaacccaagtgtccatcatctggtgaataaataaattgtactatacaatggcatactacttagcaataagaaggaccaagcaattaatacaagcaacaacatgaatgaagctcaaaagcactatgttaaatgaatctcagacataaaaagtcttgtttcatttatatgacattccgagaaaagcaaaagttataggacagaaatcagatcagtggttttttgggggtgctgaggctgaagagagagggttgactatatggtacaagggcacttggtggggtgatgaaaatattctgtatcttgatcgtggtggtagttacatgactacatacacttgccagaactcatagaactttacaccctagaagaacaaactttactgtgtgtaaattatacaccaataaacctgattaaagtgatcccttttgctaatttgtaattaatctcttttgctaatttgcacaaagccatgtgccaactgggtggcatcttcctagaggaatctcttttgtctcatttatgcaaaggcaacaaatgagatagtagtggccttatcttattccatattgaatcctttttatttttgtatttttaaaaattttggtaaaattatatatagagaaatacacaaatattaagaacataattaaaaaatacacttgatttttaaaagcctatgatttttcttttgagacagggtctcgctctgttgtccaggctggagtgctatggtgtgatctgggctcactgcaaccttcacttctcaggttcacgtgattctcgtgcctcagccacctgagtagctgggattacaggcatgcgccaccatgcccggctaattttttgtattttaagtagagatggggtttcaccatgttggccaggatggtctcaaactcctggcttcaagtgatctgcctgccttggcctcccaaaatgctgggattacaggcatgatccaccacacctggccaaaacctatgaatttaaaaaaggctggaaagaaaccatcaaagcatctatctcaaggagctaggaaaaaaatcccaaccaaacagatcaaactgggttaagctggtgatgatgatataattcctcttttgtaaagttatgtttttccctcatggctatagcacctgatgatacaagcatccatccatgatccttttctgaatcaattatttcatggtgggggggggacggtgtcataaaataatctttgaattctatcatttttctatgtgtattagttaacattctcctaatctagaaggaagcactttccctcattaactgggctttttggttacccaaaacatggtttctgctggaaaggcaagtaactgcctaattcttctcctctaatgaaaccattgctccacttagtcattgttttgttgagtccaacagatttagaaaatataagaacttatgttccagttcaaactgttgctttgggtgttagttaagatgaattggtttgattggatagtgctaaatttataattaatttgaggaagaacataatatggaatagtatgtacaatatgatccttgtgtttaacctatatattctcatatagatacaggcatatatgggtaaagtatatggcatttagttaagtatatggtaaatgttgcatttcaagttctaataggggaaaggatctcttcaacagatgctcctgggaatctgggtatccatatgaaaaaaaaaaatcagagtcctatcttatgccacttattaagttccaaatagatttttagaacttagaatagtactatatcagtataggggagtatttttcttttcttttttttctttttttttgagacagggtctcattctgtcgcccaggctggagtgcagtggtgtgatcatggctcactgcagcctcggccttcctgggtccaggtgatcctcctgcctcagcctctcaagtagctgggactataggcacgcgccaccatgcctgactaatttttgtatttttttgtggagaggaggtttcaccatgttgcccaggctagtctctaactagtctcaaacgacccacccgccttggcctcccaaagtgctgggattacaggtgtgaggcaccacgcctgtccttaggagagtatttttcttttcttttcttttcttttttttttgagatggagtctcgctctgtcacctaggctggagtgcagtggcacgatctcggctcactgcaagctccacctccagggttcacgccattctcctgcctcagcctctcaagtagctgggactacaggtgtctgccaccatgcctggctaattttttgtatttttagtagagacggggtttcactgtgttagccaagatgttctccatctaggagagtatttttcataggcttcagttggggaagaaaaaagccataaataaaaagactgatgcatttaactacatcaaaatggaaaaacttcagtatatagaaagacaacacagacaagattaaaacaagctacagactaggagaaaatatttacaacatataaaacagagaaacaagtactatctatactaaatacagcccttctgcaaaatcagtaagataaaggtaatatcttttgtgccaggaaaacaggcaaagcatgtgaacaggcaatttacagagctacaagtaaccaataaacatgtgaacagaggcacaacctcactacttaacagagaaatgtaatctgcaacattgttataccacttatcagttatccaattgtcaaaatttgcaaagataatttttgcagcattgttttttattgcttaaaattaaagaaaacctaaatgtccatcagtagaggaatggctaaataaaccatactatagccacactatggaatacaatacaacagttaaaaggatcaacatttattgacaagaaaagagccccaagacatattgtagaatgaaaatatcaagttgtgaaacatatgtaccatttgataccctctaacaatatttctataggtacatatatatgcatgaaactcatagaaaaaggtctggcatgatacacaccaaactaataaagtggctttctctggagagggaattaaggtatattgaagtataatttatatacaatatatcacacacatcttaaatgttcaatttgaagagttctaacaatcatataatcccatgttaccaccacacaaaacaagatgtagaatgttttcatcatcccgaaaggtcctttgtgcctgtttctagtcaatttgaggtagaaggtgggactctactccaggggtggagctcagacaccagaccaaattgaggactagctaaaatagggactgggctgaagcaggtttccataagacatgcccacccaccagtgcaccatgtcaatttaccatggccatggcaacacctggaagttaccaccccttttctagaaatttctgaataacctgtcccttaatttgcgtataattaaaagtgggtataggtatggctgcagaactgccccagagctgctactctgggcacactgcctatgggttagccctgttccgcaagtgttctgctgctgctgtacactgccacatcaataaaagttgctgtctaatgtcacctgctggcccttgaattcttttctgggagaagccaagaactctcctgggctaagcctcaattttggggcttgcctgcccagtgtcagattcccctctattcccctgaacaccactttctgatttttatcaccacggattagtttcgtttgtttttacgtttcacgtaatggaatcctgcaatactcttttgtgtctggctctgttcactcagcatactggcttttttttttttaacttctcctttttgagacagagtctcaccctgtcatccaggctggagtgcagtggcacaatctgggctcactgcaaccttcaccccctgggttcaagtgattcttatgcctcagcctcccaattagctgggattacaggtgtgcgccaccacacccagctaatttttgtaattttattaatagtagagatggggtatcaccacattggccaggctggtctcaaactcctgagctcaagcaatctacctgcctcagcctcccaaagtgctgggattataggtgtgagctgccgtgctgggccagcgtactgtttttgagatttattcatgttgttgcatatatcagtactttaatactttttattgctgaatagtattctactgtatataggtacaacaatttatttatccattctcttattgtttctgagtttcagctattatgaataaagctgatataaacattcatgtacaagtctttgtgtgggcatgttttcatttttcttggttaaataatactcagaagtgaacttgttgggttgtatggtaagcgaatgttaaactttataagaacctgagaaagatttctccaaagtggctgtaccattttacacccctgatgataatatattagtattctggtttctccatgttctcaccaacatttggtgctgttagtcttttgatttcagccattctagtggaagtgtggtggaatgtcattgtgttttctatttgcatttctctgattactgaagatgttgaggactagatatctaccattgcaaagcatccattcaagtttgtgcccccttttacaatggatttttctttttattgttgatttgtaggagttctttatatattctggatgtaagtcctttgtcagctacatgtactatatgtatatttttccaagcctgtacattacctatccattttgttaataatgtctatggatgaacaaaacataaattttgataaagcccaactttctcttttattatttcaactttcaattttctcttttattattaatgctttttatgctctaaggcatctttgccttcctctaggacatgaagctattccccaattttttatgctagaaaccttatggctttggcttctacttctagtatgctaggaacacggaagaggtatttgtccctctgaaacaggttttatggaacaggctatcagatttagagagaatggataatagaaattaaatgtccatgtctgatagctttgaagagagcagtggttctcccagcacgcagctggagatttgagaacgggcagactgcctcttcaagtgggtccctgacccctgaccctggagcagcctaactaggaggcaccccccagcaggggcacactgacacctcacacagcagggtactccaacagacctgcagctgagggtcctgtctgttagaaggaaaactaacaaacagaaaggacatccacaccaaaaacccatctgtacatcaccatcatcaaagaccaaaagtagataaaaccacaaaggtggggaaaaaatagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcgctaaacatggaaaggaacagccggtaccagccgctgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagattcaagacccgtcagtgtgctgtattcaggaaacccatctcacgtgcagagacacacataggctcaaaataaagggatggaggaagatctaccaagcaaatggaaaacaaaaagaggcaggggttgcgatcctagtctctgataaaacagactttaaaccaacaaagatcaaaagagacaaagaaggccattacttaatggtaaagggatcaattcaacaagaagagctaactatcctaaatatatatgcacccaatacaggagcacccagatacataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatttttcagaccacagtgcaatcaaactagaactcaggattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggacgcattcaaagcagtgtgtaaagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctctcagaggtacaaggaggaactggtaccattccttctgaaactatttcaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcattcctgggatgcaaggctggttcaatatacgcaaatcaataaatgtaatccagcatataaacagagccaaaaacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcagaagacagggatgccctctctcaccactcctattcaacatagtgttggaagttctggccagggcaattaggcaggagaaggaagaaaaaaaaaaaaaaaaagaaaaagaaattaggactgcttggtaggtccaggcacggtggctcatgcctttaatcccagaactttgggtggcccaggcaggaggatatcttgagctcaggagttcaagaccagcctgtgcagcatagtgaaacctcatctctatgaaaaataataataaaaaaataagctgcgtgtggtggtgcatgcctgtagtcccagctactcaggaggctgaggtgggaggatccttgagccctgggagatcaaggctgcagtgaactgtgattgcaccattgcactccagcctaggcaacaagcaagatcctttctaaataaataaataaaaggacttctttgtaggtatctgcaaaagaaaaaagctatgagggctgacaaaagttgggggggtgtaatacaaatagaatgcataacctccaaaccactataggtaaaataaattgatctaacacaaagctggcagtgggcggcggggaggggtgtgcggggaaggaacaaaaaagcatggtaagcagaaaatgcaaaaacaaatggcataaataaatccaaatatattgtaatgacaatgtgaattggttgtattcacttaaaaagagacagtgactctcagattgtgttaaaaataaaaatatacctctgtactgtattaaataagatggaaaaagataaaccaggcaaaaactaataaaaagaaagcagaagctgcattatcaatataagacagagtagaatttcagactgaaaggactaaaggacacagaaggacgcttattattaagtctggttatattacctagaaaatgtaacacaatcgtttatgtagttaactatagcttcaaaatatgcaatgcaaaatagtatatatatatatatggaaacattgttacatctacaatcatagttgggaggcttagcacacctttttcaataatccacagattagcaaaaagatagaggatttaaatttcacaattgatgtgctttaactaatctctctaatataaacaactttgtacacaacagaaaataacattcttttcaaatgcacttggttttaaaaagtgcccaggtattagaacatgcttattcaagagttaaatcccatcaatttcttttttaaaaaagtggaaagagtactcataggggtcatatttattattcataatttatttatttagcaaatatttattgagtgcttactatgttccaggccctgtttcaggtactggaaatgtagcaaataagaagcaatgtctcagttcccaaggagcttacatcctagatagaagaatcaaataatacataagtaaatgaataagtgataagtcctgtaatgatttcacattgcatacctgtatcaaaacatttcatgtaccccataaatatatacatttactatgtacccacaaaattaaaaataaaaaaatttaaaaaaggaaagaaagtcaaactcaatgatgccatagaagctgcagggatatttttaattgcacaattaagaaataccttgaagagaaggtgacacaatataatgaaataaaattagacattaatgcagtccccacaccgaatccaaaatttaagaaaaaaaagcatcttctaaatgactctgggttaaagaagaaataaaaatcatgacttcaaattatgtagatgagaatggaaataaacccaccagatgtaaaacctgggatgaggttagagttattaaagagggtcatttatacactcacttacatattcaaaaataaggaagacttaagataaatgaactagacatttaactcaagaatgtagaaaaagaacagtaaattgaatcttaaggaaatagaaggaaggaaaaataaagataagaaaaaaagaaagcaagaagaaaaaaatcacaatacaattgattgatacaagttatttgagaaaatttttttggcaattctgatcaaagaaaaaagaagagacaataaacaacattgggaattataattaaagatataaaaggcaataggaaaaatataagaaaatacaagtcagaattttataacactcaaattgaaatttcagacaaaatggatcatatattaataaaatacaactaatcaaaactggctcaagaagtagaaaacttgaatagaacaataaagagataaaaattttacttcaggccgggcatggtggctcacgcctgtaaccccagcactttgggaggccgaggtgggtggatcacttgaagtcaagagtttgaggccagcctggccaacatggtgaaacctcatctctactaaaaatacaaaaattagcccgacatggtggcacgcacctgtagtcccagctactcaggtagccgaggcatgaaaatcacgtgaacggaggttgcagtgagccaaaatcgtgccactgtactccagcctgggtgacagagcgagactctgtctcaaaaaaaaaaaaaaaaaaaaaaaaaaaaaaaaaaatcttactgcttaaaaacaaacaacaaaaggaaagaaagacaattactgtgctcagactattatttttagaaaagttcttccccaagcctttaaggaatggaaaaattctcttgttatataaactaattccagaacacagaaaacttcctaacgcatttcataaggctagtataattatattatgcatttcataaggctagtataattataataccaaaaactgaaaaaggatggtacacagaaaaagaaaactataaacggatctcatctacaaaaatgtaaaaccagatattagcaaattgaaatccagcagtttattaaaaaaaattgtcactaccgtgtgaggtttattgcaagaattcaaaggtggtccaatatttaaacatttttattgtaatctactatattaaaatcattaaaatatgataatctcaataggaaccataaaattttttgttcaaattaaacatccattcctgataacaactcctggcattctaggaatagaagtttccttaacttggcaaaggatttgtgtaggagatgcatagaaatattgtacttaatgatgaaacgtgaaaagcattcctgttatattcaggagctagactctgactataaggatgtctgttatcacctttactattcaacattactctggacttcttgttacatataataagatgaaaagataacatgaatagtataaagtatcagaaaggaaaaatattaaactgtcatttacagacaatataaatgtcttttgagaaaatcagagaaaatcaactgacaaacttttataactaataatacaaattcattagggtggcctgatacaaggtcaacattcagaaattgtagctttgctttgcaccagcaatacacaaatggaaaatggataagaagcttctatgttagaatagagggaagataccatttcaccagatctctcctaatattcaacaaaatgcagaaaaaacaaaacagcagaagaatggagatgatcatcagcaaccaaagaaaggggcacattccaatgacgtaaacttcaaaatatctcagccaagtaaagaaacaggagattccagaactgggcattgtggtgcagggtaaccaggctcttccattcctcagaagccatataagatacaggaagcacaagacaaagaatctaaacaagaaaaaagcgtaccacaaagaacagaaggaaatttccaagtactttaagctatagaacaacttaataagaatatgaacttaataaaacaagaatgcaaagatgagatgtgaaaacagcagaattaggtaaaaaggaagattgcaaactaaagaacccattaggacaaaacaacattatagaataaattataaatagagtgaaatagaaacatgtggctaaaaattgaattatggacagaggaagggcttcagataattacattgacgggaaatgaaaaagaagaaattaaatgaaataactatatgtacatatatatgtatatacatacacacacacatatatatattcttaagaaagaataaaatgtttagatctaaatagcataacatgtcctgggaagtttgattgtcatttgaaagttcgttatttcacagtgctagaatctgagatgatattttatcttattctgtgtactttattgcattgcattgcttctttataatgagcatgcatcatttttataaaaatagtgaaatcatttttctaaaaaatgtagagagaatataatgtacaaaaagccacattcacaatattaacaaaaactatgaaatattggggaatacagctaataagaaatgtataaaatctataaagaaaaccacacacacacacacacacacacacacacacacacacacacacacacacacgaaaaatgacaattttcctgaagagcacaaaagaggatgtgaataaattttaaaaatactacatgaccctgggtgaaaatactttattactaagattttaattattccttaagttgatctataaattccttttttttttttttgagacagagtcttactctgttgcccaggctggagtgcagtggcacagtctgggctcactgcaacttccacctccagggttcaagcgattttcatgcctcagcctcccgagtagcttggactacaggtgtgcgccaccacccctggctaatttttgtatttttagtaaagacgaggtttcacgatgttggtcaggctggtcttgaactcctgacctcaagtgatccacctgccgtgacctcctaaagtgctgggattacaggcatgacccaccacacccagcttaatctataaattggatgcaatcctaatgaaaagtccaacaagattttttaaaaatgaaacttggaacttcacttgaaatgcccaaggatatccaaaaatagttggaaaaagcagggcaatgaaggatttgtcttccccgacaccaaaacttgctacaaaacgacaccatgtaaaagtgtgatattgaggcagtttataactatatatattatcagtgaaacagaaaagtcaatcgatgaaacagatctgagtataaatgagaatttaacatatggttaagttagctctttaaatttattggggaataatggactattatatgaatggtgctaggatttggagacacacacacacacacacacacacacacacacacacacacacacacacacacatatatatgcaatgacccagaagccatacaagaaaaggttaatgttttgaccacatcataatgtaaaaattctggagttaggtgccatggctccagaatccaaagtgctgggattatagccctggctcatgcctgtaatcccagcactttgggaggtctgggtgggaggatcttttgagaccaggagtttgagaccagcctggggaatatagtgagaccctgtctctacaaaacataaaaattagctgggcgtggtgccatgcatttgtagtcctagctactcaggagactgaggcaggaagatcgcttaagcccaggggttcaaggcagcagtgagctatgatcacgccactgcagtccagcctgggcgacacagcgaaaccctgtctaaaaaagtaaaaattctgaatatcaaaaataccataaaattaagatgttagtgatagattgagaaaatatatgtacaacctatataacagaaaaataactaatatacagaaatgtgtaaagaactacaaaccatttaaaaaatacagctgaataggaaaatactcaaaggatattaactaatactcagagaagaaatgcaaatggatgttaagcatgtgaaattatgctcaagataatagatatttaggaaaatgtgaattaaaaggacaatcttgccaggtgcagtagctcacacctgtgtgatcccagcattttgggaggccgaggtgggtggattgcttgagctcaggagttcgaaaccaacctgggcaacatggcaaaaacccgtctataccaaaagtacaaaaattagctgggcgtggtggcatgcgcctgtagtcccagctactggggaagctgagatgggaggatcacctgagctcaggaaggtcgaggctgcagtgagctgtgattacatcactgcactccagcctgggcaacagagtgagaacctatctcaaaacaaaacaaaaaaaaggacaatcttttgttgactcttatattggcaataattactaatacagacggtccccaatttatgacaattcaacctatgatttttttactttaattggtggtgcaaaagcaatacacattcagtaaaatctgtacttcaagtactcatacaaccatcctgtttttctttcaatgtagtattcaataaattatgtgagatattcaacactttattataaaataggctttgcattagatgattttgccgaactgtcagctaatgtgagtgttccgagcatttttaaggtaggctaggctatgatgtttggtaggttggatgtattaaatgcattttagatttatggtattttcaacctataagtttatttgaacatgaccccattataagttgagaaacatttgtacacagtgtgcatgagagtgtggggaaatagatcctgtcttatgtttgatgggggtataaattgccaagcctttttggaggacagtttggtggtatatccattaactatataaaatctcacatccttcttttggcaatatcaaatgtataaaatctcatacatttaagcaaataattatatttatagtagaatatcctaaagaaattcttctacctgttggcaaagctttatgtgccagactgttcattgtaaccttgctttattagctccggatccagaactcataatatgcagcagttaaaaagaatgaagcagctttaaatgtactggtatgtagagctctttgagacataattttaaatgaaaaaaaagcaagttgcaaaacagtatgttaattatgatcctggccaggcgtggtggctcacacctgtaatcccagcactttgagaggcccaggtggttggatcacttgaggccaggagtttgagaccagcctagccaacatggtgaaacccagtctctactaaaaatacaaacattagctgggcatggtggtgcgcacctgtaatcccagctactagggaggctgaggcatgagaatcgcttgaacccgagaggtggaggttgcggtgagccaagatcgcaccactgcactccagcctgagtgaaagagcaagactccatataaaaaaaaatctcatttatatattttaataagacatgtatgtgtatatcatgtatacaaaaggttaatacaccaaacttaaaatggagaggtaactgtgatttgggtgaggataggggagtgaaagtggtactagtgctttttctgggtttgactattcttttcttttcttttcttttcagagacagggtttcacgccattgccggtctggagagcagtggtgcaatcatagttcactgtaaccttgaattcctaagctcaaacaatcttcttgccaagtagcctcccaagtagctaggaccacaggcatgcaccactaagcccagctattttttttttttaatagacaggtttccctatgtcgggaaacctatgtagggtggtctcaaactcttggcctcaagtaatgctcttgcctcagactcccaaagtattgggattataggcgtgagccatcacacttggccttgggtttgaattttatactagaattgtactcttgtgggatttgtatgtaaagtaaacagcaaatattaaaacaccccaattatctttccactgggatacacagagctaactccatcagccacattgtataaatataacatgagttatttaatctctcccctatcaatagccattttatgttgcgtcaggctttttttttttttttttttttttttgacagagtctcactctgtcagccagactggagtgcagtggcgtgatctaggctcactgcaacctccatcccttgggttcaagccattctcctgactcagccttgcaagtagctggggttataagcgcctgccactgcgcccggctaatttttgtatttttaatagaaacggggtttcaccacgttggccaggctggtcttgaactcctgacctcgtgatccacctgcttcggcctcccaaagtgctgggattacaggtgtgagccaccgtgcccggctgcgtcagttttttcaaaccttacaagcattgcgaaaaaaaaaaattctagtaaatatatctttgtgaaactgtgtaggcatataggttggctaaattccaaggaatagaattattgggtcaaagaatttgtgaaatattatagttatcatttaatagagtttgccaaattgccctatataaaaagcttgcatcaatatctgcctccaacagagtagaggagtgcccatttcttgacaaaccagtcaacaatattatcaagtttctaaactttgagaaaatcatacttgaaacatggtaaggcatagttgctttgatttgcatttctttgtttgagcatcttttcatatgtttattagtaatctatttcttttctgtgaacaaatctgttcatgtcttttggcacatttttctattgggttgtttatcattttactaatgatctgtaagagcttttagattattacaagttagccttttgacagtcaatgtttatggttttttttttttactttaccaaagtttaaaatttgtatgcaattaatttatcaatattttcctttggtggagaaagtaagttcgtcactttcaattgagttctgaaaagccattagtaagattgtaaggcactaggacttcctttcttggctcctgaaagggcctcctccacacaggggcccctcacagtggagcccctccctctggggtgtcctatttcaatgttctaagaaagaggctgcctggagggtctatatttggagtatgactcctcagcggggacaggtggatgcgtggggactaacttctgcatatttggtccctgagttttgggattattctgaggggcttgtatgggaggtgcagtgaagttgtaacacaaggcaggacatgaaaaaacttctttttcttggcaattgcttgggatcctgtacattgcccttccacttgtgagggaaaaaaataatgacacggacatcaggtgtgttgcagtgattcacagtcatccacagaccctcaccaccatctccactggaaaatattgaacactcgccactgctagggtagtatgtagtacatgaatggcagacaccggcgagatctcaagtgttacgacggatgaaaattccacctgttaagtctcctttccatccaagctctagcagttggttgttccatgggtgtggtgaggctgatctgattacatgcttatgtaaaatccaaataaagccccttgaatggaaaacaggttaatttgggaagtcactagtaaagcaggttaatttggtaagtcactagtaaagcactaggctcatcaggagttgggtcttaaatatatcctctagaagtcttctctgaagaaggtcttagacacctgaaaaaagatgctgagttcagccagaacttcaaaagttacaaatcacctgtgtaaaattgtcaatattagaaaacgaaatgtctttccaaagattaacttatagatcatattgaatacgtgctggttttgtttaggacaattttgtatttaaaatgtcaagaattactagtcaattttgaaagctgtaaaatagtttgcagtaacagaagacattttaaaatgtggcacaaaataatgtaaacaaaagaatgagtcttttgttatttttacaccctgaatattttttgtgtcaaatgaaaatggctatactgtattttctgattacaatattagaaaagaatgtcatattaaaagaaaaaaaaggaacacgaaaaagaaaattaaagctctacttgcaccttctgctttccttcctgatacccccttccacagcccatttggtgcaggcattgtacttagagagggcaggtcgtgtagggggcgggtggggagtgctggtcttatagtctaagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcagattggagaggacggagatgagtgacaacgcgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctaccataccttgttcgtgcttttagcaggggtgattacatgggccgcattcaggaagtgggctgggtgactgcaggactggtgatctgggctggcacctgctactacatttacaaatttaccaagggaagagcccagagtgtgaggactcttgccagaaatggatccacagttaagatggagactgtggttggggtacagagccagaccttggccataaatgaagcagagattaagactaaaccccaagtcgagattggagcagaaactggagcaagaagtgggcctagggctgaagtagagaccaaggccactgctatagccatacacagagccaactctcaggccaaggcaatggttggggcagagccagagactcaatctgagtccaaagtggtggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagcttgtggccagtgttcaggctgataccttgtctgatggcaaaattaaggtcaggggcaatgtcaataccatgcctaaggaaggagctggggtggatatgaaggctcaaggtatggcccagagccagggtgaagccttacctaatactagaggtaaggctaggggcaaagccaaagccaagtgtaagacagggcctgggatggacatgaaaacctgtacacaacctcaggctggggtcaagaccccagctgaggccttgcttgattccagggttgatggtaggggcaatcctaatgccacttctaaagccgggactaaggcagaccagagggtctgtggtcagcccctggttgtggccaatccccagggtgaggccttgcctggtgccaagaataaagtcaagggcaatccccatactgtgcttaaggtgggggctggagaaggtacaacagactctgcccagcctgaggcagtggtcagtttccagggtgaggccttgcttggcaccaagaataaagttaagggtaatcccaatgttgtgcttaaggcagaagttggggaaggtgcaatgggcactgcccagcttcagattatggccagttccaagggtgaggccttgcttgattctaagaataaggtcaagggtaattccaatgctgtgtctaaggcaggggctgggacagatacaacaggctctgtccagccccagattgtggccaattcccagggtgaggtcttgcctggtgccaagaataagatcagaggcaatcccactactgtgcctaattcaggggttgggccatatacaacagactctgcccggctccaggctgtggccaattctcagggtgaggtcttgcctggtgccaaaaataaggtcaaggccaatcttaatgctgtgtctaaggcagaagctgggatgggtgcaacaggctctgtccagccccaggctgtggctaattcccattgtgagaccttgcctggtgccaagaataaggtcaggggaaattggaatgctgtgtctaaggcaggggctgggatggatacaaggggctctgcccagccccaggctgtggccaattcccagggtgaagtcttgcctggtgccaagaataaggtcaagggcaatcccaatgtcgtgtctaaggcaggggccagagaagatacagtgggctctacccagcctcaggttttggccagctcccagcgtgagaccttgcctggtgccaggaataaggtcaagggcaattccaatgttgtgtctaaggcaggggccagagaagatacaatgggctctgcccagcctcaggttgtggccaactcccagcgtgagaccttgcctggtgccaggaataaggtcaagggcaattccaatgctatttctaaggcagaggctggggcaggcataatgggctctgtccaggtccaggttgtggccagttttcagggtgaggtcttgcctggggccaaaaataaggtcaggggcaattccaatgctgtgcctaaggcagaggctggggcagatacagtgggctctgcccagccccaagctgtcgctaattcccagagtgagaccttgcttggtgccaggaataaggtcaagggcaataccattgctgtgcctaaagcagggactggggcaggcacaaggcactctgcccagcctcagattgtggccggttcccagggtgagaccttgcctggggcaagggacaagtctatgtccacttctgaggcagaagccacagcagaagatgaggcctatgcaaagcctgaggctgaggccatgcccacttctgagagtgagggtgggtcaggcactcaagcctgcagaaagactcagcctaacatccatgactactactggaatgggattggtgttgaagactggattgctgctgagcggtggatcaaatttaggtttcagaccatggatggagactgggaaaatagcgtgtcctgggctgatgatgagaatgaagccagtattgggtcctggagtggggctagtgataaggctgggattattcggtcttgggctgtggcttgtgatgagaccagtgttaagtcctgggctggggccagggctgagaatgtggttggtattgggacttgggctagagctggggagcaggccagtggagggctctgggctgggggtcagactagtgaggggacctgggctggggacaaggccagtggaggagcctggactggggctgagaaccaggccagtggggggtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctggggctgaggctggggctggggctgaggctggggctggggctggggctgaggctggggctgaggctggggctggggctggggctgggcctgggactgagtctggggctgggatttggtcctgggatggagatgcaaccactgtagagtctaggcttggggctggggaagaggctggtgtagagtcctggaccttggctaggaatgtgggagaggatgagctaagtagagagtccagccctgatattgaggagatcagtttaaggtctttgttttgggctgagagtgagaacagtaatacgttcagatctaagagtgggaaagatgccagttttgagtctggagctggggataacaccagcatcaaggataagtttgaggctgctggtggagttgatatagggtcttggttctgtgctggtaatgaaaacacaagtgaggacaaatctgcacctaaggctaaagccaaaaagtcatctgagtcaagaggcatatatccgtacatggtccctggggcaggaatggggtcatgggatggagccatgatctggtcggaaactaagtttgcacaccaaagtgaggccagcttcccagttgaagatgagtccagaaaacaaaccaggactggggaaaaaactcggccctggtcttgccgctgtaaacacgaagctaatatggatccacgagatcttgaaaaactcatttgcatgattgagatgactgaagatccttctgttcatgaaatagccaataatgctttatataacagtgctgattattcttattctcatgaagttgttcgtaatgtaggtggaatttcagttattgaaagcttgctcaataatccctaccccagtgttaggcagaaggctttaaatgcactgaataatatctcagtggctgctgaaaaccataggaaggttaaaacttacttaaaccaagtatgtgaagacactgtcacctatcccttgaattcaaatgtgcagttggctggactaaggttgataaggcatctgactattaccagtgaatatcagcatatggttacaaattatatttcagaatttcttcgtttgttaacggtgggaagtggagaaactaaagaccatgttttgggaatgcttttgaatttctctaaaaatccatctatgacaaaagacttgctcattgccaatgcaccaacatcactgattaacatttttagcaagaaagagacaaaggagaatattcttaatgctctttcactatttgaaaatataaattaccattttaaaagaagagcaaaagcatttacccaggacaaattcagtaaaaattccctttatttcctattccaacgacctaaagcatgtgccaagaaacttcgagccttagcagcagaatgcaatgaccctgaggtgaaagagagagttgagctattaataagtaaactctgattggctgtatgttcccaaacaaatttgagtaatattttggttttgcactctggaagtaatgcacattgtaaattgcattataactttgaaactgatgttacctatgatggtctatagctggaccattttatgaacaccaaatgaattcaagcttgtactaaaaatacatgtgttgatttttatcttgtctggattgagatatttttagtatgcttcatgagcagaaactgaatggattcttcataagtaaggtaatctttggtcctttgtgtggacttatgtttatacatttaagactatttttatgtcatcaataaagttgtgtgttttaagcagcagaaaaaagtcattgtccttgtccttgagtttatgatctgtttggaaaggcaagatatatggaaacaaaaagatagcaataaaactgggagcttccaatcatggccagatgcctcctatcagtgtttagaggcggcagaaactgctgcaggcaacagtgctcaaggaaagttttacaaaggagggggacccttaggtaagctgggcttcaaggatacaaaaggatcagaagggcactcaagatggaaggagtgatgggaaaaaaggcatggagatgggaatccttctccagagagaaatgctggcctgcttgaagtgcaaagtgtagggagggtagtgacgagagagagagagagtcaggcagtagaggtgagtcctgttcgtggagcacccctaactgctaaactggggtgtctgaatattactacatccacccctgggagacatcaaggccttttgtgaccggaggaatgacaagacgaaaggaaaatgatatggtagatttatgtgcagcaggagtccaagctggggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaattttaaataaatattatttgtaaagcaataagtgttttaaaatttaaatcatattaggtatttaaaaaataaaaccattctcaatactagcattcgatggccaccaacttactctactgtaaaaaaataatgtcacacttgtagtggattctaccatctgctgccctgattccccttcaggaatgaaaagcttattattttaattgccaggagtgcggcaagtagacagtcctcagctgtcagccctcttcaggaatttcctcagctgaagaaagccacctcccccaaggttacaccccctacctgggggtatttcacatccaattactgatggatatggccttcttgccccaaattgggacagcttaactcctccctctgtccaatcctgcttccttcttttcccttccacaggtgttgatcccaagagcattccctagtaaaaacgcttcatgctgaactctatctctgggcctgcttcctgggaagccaacctgcaacagttggtacaagaagtggttcgagaaagcaaacactgtgatgaaattttggagatgaatcacctgctacccagctgtcaatgaagactccatcattggtggtaggtggagtagataggcctctggaataaggtagcagaggaattgttaaaattttcaatggtggttaactgggttggcatactggtaaaatgggacacattaactggtgccatgtatcagacctttgagaaatatgggatatattaaatataaggaaggccagaaaattgggcggctgttgctaagcagattgagctctggaaaagaataacaaaaagctgaattaaattaatcaacaattgaaagctatgtttgaaagtcagatggctttattcataacatataaagaggctctcatcttttccaggtagaaggtggagaaatctgaggagtagactcaggatttgttaaaagcaagcttcaaagaaagttaaaattctaaccaagacaagtcttctatgccgagttatgtgccatggttaagaaggaatgggactctgacacttggaatgggggacatctggattgatgtccctaaaaatcttatatccccagattcccctgagccccttgagaagtgtcctactcctccctattaagggctggcactccatcttgcttcaatatatggaatcctttcccctgtaagataacctgggttttcctcagaatctgcccgcacctcctatcctggccactgggcctataactagggttaagccacgcataatctagctggtgatgtgctgggtgtaataaggaaagaaagagaatacaccaacaaagagtttcgggacataacctagccagcatatactagaaggtgctgagggagtaagtatggcatcaaattctaaggagcttgatcaggagggctggaatataaactggaatatgggagaattaatcaatttgaaagtgctttcccagaatacaggatttaataccctggagaaaaccacaggaaatgacacgaactcattactgcgatggctcctcgaagtatggaaaaagccatggcgtacataaagtgaggtgtaaatgccagagttgccatagaagatggcgggaaaagggatcaaagactcagagaggtgagaattatataataaacctattatgtaaggccagaaaaccctccagaagattatattctacaggaggatccaaaggacaaaccatttaccaaagctataagaaatattctggtgagagggacatcagcatcactgagaagttcagtagtggatctcttttgcatgccagggctcagagtaggagaggatcttatggaacaaggatcactgatagaaatgatgatgcctctgaaacaatagaggcaagatagttgcacttaactgtcagaagttaggcggatgtaaataccacaatgcactgcagggtcagagtggcaggtggggaggcctgacctgcagagagctatggagatggttaacagaacacagtacccctagtgggtagatggttaagagacagttaataggacatggacagtcaatacaacataatgtcctggggggaaataggcagccaacaatctgcactctatacaatcaaaagaaatgaaaggtgttcacaggtttgagggaggttgcctcaataaaaagtcataattacttatccagcttctagtctcaagtcagcttttgatccacaatacatggtttgaaagaaaggccgagtgcccaggaagaaggaccctacaacgcatgtgtagtaatgatttctctggtccttccatttactcaggtaactgtgtaccaaggaaagagaaatactcgaacattttgagaacagatggacactggttctgagttgatattgacacccagagacctaaagtgtcttaattgtcccccttattagaatgggggcacatgggagccaagtattaagggggatcctggcctaggtagggttcacagtgggcccactgagttcacagacccactcagtggttatgtttttgatctctgaatgtataattggaatagacatagttggttagttggtacaagccctatagtagttctttggcctgtggagtcagagctatttgtagatgagaaggccaagtggaagcttctgaaactgccctcaccttccctggccaagatagtaaatgaaaacatatggcatctgtggagtggaggatggcagaaattattgccgcctttgaagacctagagaatgaagaggtgtggtctccatcatatcttcgtttaattcaccagtttaatcccctgcaaaatgtggacagagcctagatgacactagactactgaaaactcagccaagtagtaagacaattgcaatggcataccagacatgatatctttgctacagcagaaagcatggccttaagtacctagtttttagctattgatttagaaaatgtgtttttttccctatctgtatcataatggaaagttcatattcacacagaatggataacagtatgcatacacagtttttcctcagtgctctactaactatcatgtcctctgtcataatatagtctgaagaggtctggaccactcgaacatccttcagaatatagtactagtccacaatgtctgtgacatcatgctaattggaccaaaataagtaggaaggggccagcacattggaggccttagtaaggcacatgcactatggagaatgggagatgaaccctacaaagatccaggcggttggccacattaagtataatttttaggggttgaatggcctggggaatgctagaatatcctctcaaagggaaggacaaattaaggtattttttaccttcttcacagagaattttctggaagtgcactgcctggtaggcctctttgggttctggaaatatcacatttcacacctggaattactgtttcaccccatatactgggtgacacaaaaagtgccagctttgaggagaactatagcagaacaaggccctatagcaggtccaggatgcatttttaggcagtcctgccacttgatgcatacaagagacagtccttatggtactgattcaggtgaactccaaaagtggggcttagcccgggagggttcttggcttcactcaggaaagaattcaagagcaagctgacggtaaaagaaggcaagtttattagagcaatagtgtatagcaaaatggctgctccatggacagaccagggctgtctcataggcaaaggagccctgagtagcagtgtgcagcaaagttgctgctccacaggcaaagcagcctggagcagcagtagcagcagcagcagcagcaatatatagcaacagtagcattctggagcagcagagggagcagtagcagcagttctgctggctagctatatttatacccactcataattatatgctaatgaaggaatgggtttttggaattttctagaaaaggagtggaaagttcctagaaccatataaggcaacttctaggtcattgccatggcacattgccatggcatttgtaaactgtcatggcactggttggagtgtctttaataatgagcagtgaggacaaccagaggttgcttttttcatcatctcctggtgtctttactgcatcctgtttttgatgagcagggccattaccagtgcttggaaaacaagtcctgctgatgtcctatctcagtaatagaggtatctgtgttggaaaaagatgccatgtggagtttttggaagtccctatgggaaaggccctatgggaagcccctatggggaaatcgcaacttagctagggttgtggagcaaagccatgtcatatgaatggaaaattatataccttttaagaacagctcctgacatgctactacatcctggtagagatgaaatgcctgactatagaacatctagtggccatgcagccagaactgcttcatgagctgagttctgtcagatccaccaaggtataaggttgagtagccccggcaatgagatggaagtttcttttttgtttctctttttgagacagggtcttgctctgtcacccaggctggagtgcagtggcacgatcatggctcactgcagccttgacctcctggctcaagtatcctcccacctcagcctcctgagtagtaggaatatagtcacacaccatcatacctcgctaatcttttaatttttttgtagagcttaggctccactatgttgctcaggctggtctcaaactcctgggcttgagggcctttcctgccttggtctcccaaagtgctgggattagaggcatgagccactgtgtccagccaagatggaagttttatatatgggatcaagcacaagcaggactggagggcataagcagttgcacaatcaggtagagcagatcctctatgatagccaccactgttgcactagtacctttccttatctatagctatgaccttacaccagatcctatgtgacacaggcattcaagtgttctttattttttttttatttttatttttttcttcttctttaggacaatttgcttaatttattgccttggaattttttttctctttttttaattatacttttagggtacatgtgcacaatgtgcaggttagttacatatgtatacatgtgccatgctggtgtgctgcacccattaactcgtcatttaacattaggtataactcctaatgctatccctcccccctccccccaccccacaacaggccctggtgtgtgatgttccccttcctgtgtccatgtgttctcattgttcaattcccacctatgagtgagaacatgcagtgtttggttttttgtccttgtgatagtatgctgagaatgatggtttccagcttcatccatgtccctataaaggacatgaattcatccttttttatggctgcatagtattccatggtgtatatgtgccacattttcttaatccagtctatcattgttggacttttgggttggttccaagtctttgctattgtgaatagtgttgcaataaacatacatgtgcatgtgtctttatagcagcatgatttataatcctttgggtatatacgcagtaatgggattgctgggtcaaatggtatttctagttctagatccctgaggaatcgccacactgacttccacaatggttgaactagtttacagtcccaccaacagtgtaaaagtgttcctatttctctacatcctctccagcacctgttgtttccttactttttaatgatcaccattctaactggtgtgagatggtatctcattgtggttttgatttgcatttctctgatggccagtggtgatgagcattttttcatgtgtcttttgcctgcataaatgtcttcttttgagaagtgtctgttcatatccttcgcccactttttgatggggctgtttgtttttttcttgtaaatttatttgagttcattgtagattctggatattagccctttgtcagatgagtagattgcaaaaattttctcccattctgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaatatttaagtctttaatccatcttgaattaatttttgtataaggtgtaaggaagggatccagtttcagctttctacatatggctagccagttttcccagcaccatttattaaatagggaatcctttccccatttcttgtttttgtcatgtttgtcaaagatcagatggttgtagatatgtggcattatttctgagggctctgttctattccattggtctatatctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagtttttcccaattctgtgaagaaagtcattggtagcttgatggggatggcattgaatctataaattaccttgggcagtatggccattttcacgatattgattcttcctacccaagtgttctttaataagtttgtgtgtgtgtgtgtgtgtgagagagagaaggagggagagattctagaccccagacccttcaaaacatgggacttaggggggccttctggctcagtcctaagagccctcctgcctagttatgaggctagggtagcagtggacaacatttctaaatgttttggagagatagctggtcttatagtcagttctgggtctgactctggccccgggtccccagattcttactctagtgttgttgtagtagtagacttagggcttagaggctggtttaagattttgagtacagtgggtttgctgggtcatgcacatataagaaatcatataacaccacttttcaaaggtgaaaatgcaatccttcttcttgggcaaaaaggtccatttctgaaaatcatatgaactgattggtccttgaggcagtttagtgtaggggaaagaatataatctggagtgaggaatgaatggggagggatattaacatttctcttccccttttatttttcagacataaaggagaagatttgggagagggagaggattaatcctgatttgaactcttcgaatttgaagtgcttatgtactatgatttgaatatggtttatccccatccaaagtcatgttgaggatgggttcccaatgtgacagtgttgggaggtggtacccttaagaggcatttgtgtcatggggaatctctcctgatgagggtatgaatgcagtctctttggagtgggagagttcttgtgctcatgggactggattagttactgtgaggaggttggttgttataaagtgagtctgcctcttgtgcttggtgtcttttgcgtgtacctgtttccccttttgtttctttgccatgttttgatgccctcaaaagaagttgtcggatgtgactgcccagtcttgaacttcccagccctcaaaactgtgagttaaataaaacgtttctttataaatgtctaagtcttaggcattctcttatagcaacacacaacaaactaagacactgtgggacttccaagtggagaagctcagtattgatttgagaggtatgggtctagagctcagaataaatgtctgggctgaatatacatattacagatgataacagaagagtaagtcaggtagcctcagtgaagagtacagatggaaaaactgaggacagaacactgaggaagcctagtacatgtggggctttggcagagaatagcgcagaattgaaaccgagggtacagccttccagcagtattatcatgcatgtccttgtacatccttcttttttctttaaaaaattgtgataaaatatacataacatttaccatcttcaccatttttaggtgtacagttcagtgacattaaatacattcacattgttgtgcaaccattaccaccattcatctccagaactgtttccttttcttttattttttgagatggattttcgctcttattgcccaggctgaagtgcaatggcacaatcatggctcactgcaacccccacctcctgggttcaagcgattctactgcctcagcctcccaagtagctgggattacaggcacctgtcatcactcccggctaattttttgtatttttcatagagacggggtttcaccatattggccaggctggtctcgaactcctgacctcaggtgatccacccaccttggcctcccaaagtgctgggattacaggtgagagccaccacgccccgcccagaactgttttcatctcccaaactgaaatgtttacccattaaacagtaactcctcccactgctccctcagcccctgcaaagtgctattctactttctatttctatgaatttaactactcaaggtgcctcattttagtggaaccatatatgatttgtccttttgtgacttagcataatattcttctattagtctacttgggccgctacaacaaaataccacagactgggtggctcacaaacagcagaaacttatttgctggaggctaaggagtccaagatcaaaatgccaaaagtttctggtaagggcttttttcatggcttgtcaatggctgctttctcactgtgtcctcatgtggcctttccttggtgcgttgagagagagagagaaagagagagagagacactttctgatgtctcttcttataaggatactaatcctacaaaatcagaaccccacccttatgatttcatttaacctcaattacttccttagaggtcctatttccaaatacagccacattgaaagttagggctttaacatgtgaattttgcggggacacaaccattcagtccataatggttctcaagcttccagttctttacacagaattggagtactctatgttcaatttcagaacctggtttttaaaatgtaattttcatagttatagggtaccataacaattacagaaatcctacagaaccttccttcatccttccccaccccagatttctgcttccaaattaatttcaatttccttttaaaattacttttaattccagattacttacaattctcttaactatttcttctgatattgcctttatattttttattaactattttatttcttgatttttaaattttatgtatcagctgggacttcctacagtggaaggattcagttgtcttatacctcccatcctatacacaaccatacttctcccatattctcccaatatattgttgttgttgtatcactatattatgttcaatcaatattcagtgtttacattatgtctatgtaaggatttttcacaattgagacattagaaggagaggcaggtaagtgcatggactctgccactagacagcctggcttcaaatcctgaatttgtcatgtaatagctacatgatcttgaacaaatctcttccactctctgtctcactttccccatatttaaaatgggaaatggcatatctcataagatttctatgaggattaaaagattaagcactcagagtcatacttggtacatagtaattggcatctattatatattattgttgtccattatataaattttttccctagagttcatggatccttctgtattcctgctccattttggaagattacccttcaggcctaatgtacagctattgtcctagaaactcccttgtcatcatagtggaattttcttagtctctttttcatgttggatcttgctttccctacatcctatggcttaatctttcttgatttatgacctcattttgacaaagtaaatctaggtttatgagaaagagtgtatagtatataaataccttgagattttgcctgtctgaaaatgcctgtattctacccttacacttgactggtaattattggatataaaattctaggtttaggtcatttccctcagaattttaaaaatttacttttcaaatcaaagctgtatatgcatatagtttaaaaatccaatacagtcatgcactgcataacaacatcaatgatggacagcatatacaatggtggtcccataagattataatgaagctgaaaaattcctatcagctagtgatgtcgtagccattgtaatgtcgcagcacaacacattaccttttctatgtttaaatgtttagatatgtaaataccattgtgtaacaattgctaacagtattcagtacagtaacacgctgttcaggtctatagcctagaagcaatagtttataccatatagcccaggtaggtagtaggctatatcatctaggtttgtgtaaatatactctgtaatgttcacacaatgactgtatcaccgaacaatgcatttctcagaacgtatcttcattgttaagcaatgcatgagtataatcatacaaggctaatgtattagtcctcttgagcttccataacaaaattccacaggttgggtggattaaacaacaaaaatttattttctcatagttatgcaggctagaattccaagatcaagacgcagtcagcattagtttctggtgtagcctctcttcctggctcgtatatggccaccttcttgttgtgtcgtcacatggccttttctctgtgtgggcgtggagatagagagagatctttgttgtctcttcttataaggacaccaatcctatcagattagggctctattcttagtacccaatttaaccataattacctccttaaaggctctatctctgagtacagtcacattaagggtttagggcttcaatatataaattttgggggacatgattcagtatataacagcttactatgaaaaacagcaatatccttgtatcgcaacactattttctacacccagaagcaataaatttcaactcttttaatgtattattttggtattatctacctatgtcaaaataacatacttatattgtttcttgatttttgagttttaagtcactgacttcccactatgggagatgagtttagctcttcttttatactcacccctgcttattgtaatcatacatttctacatttcttataccctgccctctcaattgctttagtcttattttagttatattgacagtattatgttgactatgtacttgttattgacagttgagttacatagtatattaggattattttttcctgtcctgcacaactttttattttctctagatttaatttcttcccccctctctttttctatgtatttatcaccaatttatttccaaaatatactcccaattatgtaaatattcttccattatgtttaaataaattaggtattccaacaatttcattttctggacaaagtttctcttgggaatctttggacctgctttaaactagactggttgcactctaggcatgcaacacaacttttattttgggatttcttttcacaataatcttggtgactttccttgctcactattgtgttagattcactgtttcctggatctcacatctccctctttcttggtttatgctctcttttggcagaacagaacatatcttccagtagcttcctgagaaagtgtatatgcaaagcacacttctgagatctttcaggtttgaaagtcatttttctttttttttaatcaaaaaattttatgtaagcaaacagcatacagtattaaaggaaaaatatttaatatattcaagaatcacatcatgacaaatgatacaaatttgtgaaatatcatttcttcctctttttgtatttttttgtagatggttttgccacattgcccaggatggccttgaactcctgggctcaagtgatccacttgccttggccccccaaagtgctgggattacaggtatgagacactgagcacttttctattttaactaaacttgccatcttttcccctgtgcttttctgttactgtcccctcctgttttcctactacattgacaggttatcttgaaaatgtcatttttctactccaatacttgattgatagcttggctggagatggaattttgaactggaaattctctaagaattttgaggacattgtttcattgtattttagcttccagtgttgctgttgagaagtcagatgttactccagttcttttttatatatttactttttcactaggtaatacattcacatggttcaaattaataataaaaaatgcagtgaaaaaccttcctccaaccaacattcttcttccactcagttccccttttccgaaaacagataactattgttattagtttctttttcatacttccaggatttcatcttgcatatgtaaggaaacataaatgtaaatattcttattttaccccttttataaatgatgaaatatagaatatatatacgcatatattcacacacttgctgtcctgcactttgctttttttaggttgtttatttgcttgttttacttaacaatatatcacggaagtctttccacatgagtacataatttactcacattttacagctgcataatctccctttgtgtgaatgtaccaattttatttagaaagctctcttccaatgaatattttgattatttccagtcactccaatgacaaacattgcttcagtaaataatctccagtcttctgccagggtcggggagtgatagtcactgaggtacttggagtggaagggtgagggtctgtttttgaaacatttaaccaagcctcctatttttggtcttattttcacccttgcttattacagaatactattctctgaggttgggggttatgtgatgtaagttatattacttctcacctttctctactttagggataggatgcagctatctcaaatctaataagttgattgcaatgtgcccatctgtactccagcttctaaaattgtgttactgttgtctcctatccttttctttttttattgtacctttaaatatctttactgtaattttaatgggatttttaggaagaaataaagtctaatgctaagttcatccccaaatattttattgggagttcatgccttagaattttgaaattatccttctgaaatcgtttagttgtgtgtggtttgagaagcctaatgctcttctatttcttgtccattatacatgacatttttttcctctctgaaaatgtttaggttcttcttttcatccttaatattttgaaacttatcaataatatgattttttaattttgtaggttgctatgaaaagaaaaatcatgatattaagtaagtctatttttattcattttgataggaacttaatgggctgtttcaatctagtgacacatattttgcattagttctttaatgattttttgatttcttgtattagcactttgattgtttcttcttaccatttttctgttctttcgttatggaacttgtactatttctgttttacctcccatatgataattttattatctttttcctattttaaaaaatctctttcttattgtgttctacatttggggattttttcccctactcttttgatcttctattgatacatggagcttttcctgacctctgattgtttcttttaaaatagaattctgcacgtgtctcatggatattatatattcttatctatttatggatattatagatttttatggctttcttctgtttcatgtattgtctattttactctcagcttcctttttatggccttttgtcttggtctcaccaaaacaatgttagtcctctaacaaacatatatttatctttaagaatgagcccctccatagggttaggagggatccagttatatcattgtggcacacacaaatgccagttttcatagatactttttttttttctgagcattctgttgcccacactggagtgtagtggcgtgatcatagtttgctgtaactttgaaatcttgggctcaagtgaccctcccacctcaacctctgtaggtactttttattaggctaattagtttacatggagaggaatcctccaatctccttccttgggcttataagcacagttgacagtgctcaggaggctgagcgagggaaaggaccttgagtggggagaatgtctcacctttcaatatgcaaactctcacttaattattcctttttttttttagtacaacttattatacccaccttagctgcactcataagttcagaccttttctggtttaacttctccagaaagtaaaccatctgttttctgagagaactcacctagtataggggctggaggagaagatcttggggtctaactgccccttattaaaaatttcaactaatgggctgggtgcggccgctcacgcctgtaatcccagcacttcgggaggctgaggtggatggatcacttgaggtcaggagtttgagaccagcctggccagcatggcgaaacctcatctctactaaaaatacaaaaattagcctggtgtggtggcaggcgcctgtaatctcaggctgaggcaggagaatggcttgaacccgggaggcagaggttgcagtgagctgtgattgcgccactgcactccagcctgggtgacagagcaagactctatctcaagaaaaaaagaaaacaaaaatttcaactaatccttttgttcttagtccaatgaggacccttcagcagttaactggtgcctcaaattcctgagcttctgtactgctctgtggagtgaatcacatactcctaactcatcatcatcattcatgggagattggagtttccgcttttcctgtttttctaggtcattcaatgtttatccactgatcttccaatattttgttaatatattccatgaactattatttcttctccatttctgtttgtatttctgattattttaatgagatttcaagatggacttgagataaatgcatatgttgtattctgtattaggactctctagagaaatagaaccaataggggaatatatgtgtgtatacatacatatatatacacacatatatatatacacatatatatacatatatacacatatatacacatatatatacacatatatatatgtgtatatatgtgtatatatgtatatatatgtagagagagagagagagagaagagagagagagagattcatttttaaggagttggctcacataatgggaactgacaagcctgaaatttttagggcatgctggcaggctgaaaagttaggtaagagttgatgttgtgatcttgattctgaaatccgtagggcatgttgcaggctagaaagtcaagtaggatttctatgtcttgaggcagaagtccttcttctccaggaagcctcaagttttgctcttaaggtcttcagctgatttggtgagacctatccagacaatgaaaaacaatccattgtgtcaatagattataaatgtgaatcacatctacaaaatgccttcacagaaacatctagactagtttttaaacaaacaactggacatcacaacctagccaactttacacatagtattaaccatcacagtctaccttggcacccatacacatctccttaaaccatacgtaatctctaaatatagacaataacaaagcaatacctccacttatcatgatacagatatcctgtgttcaactgaaaatgcaccaaccttttccccagaagaggacgcaaagtccttgggcaatgtttacacttctccttgatatcctgtaacttaaatgctatgatgtaaagctaatacatattttgttatatgacaagggaataagatatttgctatatacacacacaaagatgtttgctatatacacacaaacaaacataatgaaatgaggaaaaaatacacatgacaattacagtcctcatttctacaattggttatgtggtcatagctggtttttataactattttctttcactatccattccatattccctctgctctcagcaagtactccagctggtcatggttctttgctaggtcaggtgacctacaccttcattcctgaagagtttgggtctttattagtcctgcttgaattgagtgattgtagctttccattgactttaatcacagggcatggaaacactaaggggtattagtaccagtactaatactagtggatattagtactagtattagtactaagggatactagtgcatggtagcactaagccctaagggatatcctatattccagacaagctgttccttacttccattgtggaatagactcacatttcccccttgttaatcaagaccaataaccccagctagtacagcaaatctgttcattgcctgtttattcataggcatgagaagcccaaagtggcctggtggcagtcttaacttcaatggaatcattgttgagtttcctactggaagcatttctccctttgaaactaagatcttcagaccagcagagcataagatcatggaggcaggaagcaaaaattttggtagtgaaacactaggggtgatagagagtgatgccactcccatttccaccccttgattcctgggcccatgaaacctggctatgaaaaaaatagcaccatatattggattgctgatgtagatcacataaaacttcctggagaacattactcctatagagagttgcctgtaagaaattgttacctacctcatgctgtaactgagtcttcaaaaggccattctgttaagtcagctgcttcaggataatagggaacatggtttaataccagtaattccatgaccatgcacctattgttgcacttcacttgctgtgaagtaagtttcttacgagaagcaacgctgtgtggaataccatatagtgaataaagtattctgtacatccatggatgacagttttggcagaagcattgcaaccagggaaggcaaatccatatccagagtgtctgttccaataagaaaaaaatgatgccccttccatgatggtagtggtccaacataatcaacctgcctccaggtagctagttaatttccctggggaatgtttccataatggaggactcagttttggtctttaatgctagcagggttaatctccttagacagggatggaagggctgtctttactggcaaagaagaatcagttgaatttaggggtttaaattccttaacgaaggtccccagcttcatcaggttctacccatatgttctcatttaaactttcagaatccaattccctcctaatcaatgctctcactttaacatcagacaccctgagagttgggaattcaatttacattgtaattcagccacttgcagacatagaaacttccaggtcatttatacagtacttgtgttgggaatttgaagccctgagctcatccctttcttctgcaactttatccagcacgattaacagcaaccaactaatctcatcttacttgttagtttgacaaaaaatgtcctcaggtataaaatacatgtttggtcactcagaaccttgactcttccaagtatgtgattaggagtatccagtgatgatattttgtgtatttttttcttttctgttttcttttctcctcccttccttcctccctttctttctttcctttccttttctttctttctttctttctttctttctttctttctttttctttctttccctccctccctccctccctctcttccttccttccttccttccttccttccttccttccttccttccttccttcctccctccctccctccctccctccctctctctctttctttctctctctctttccctctttctctctttatctctttctctctttatttctttgacaaagtctcactctgttgcccagggtggagtgtagtggtgcaatcttggctcactgctacctccgcctcctaggttcaagagattctcgtgcctcagcttcctgagcagctgggattacagccagctgccaccacacccagctaatttttttggtatttttagtagagatggggttttgctatgttggtcaatctggtcttgaactcctggcctcaagtgattctcccaccttagcctcccagagtcttgggattacaggcgtgagccactgtgcatggccatgttttgtgtatttctactgcctcatcatgccattgactatccgtgttctctttaccactggaaacagagttattagtatctttaaatctaatcagattagagaactaattctaaaaccacagaattcacagttaagattctttatagaaataatataaaaataaaaagtacagagaattagaacagtgcagtaaggatgatttaagtttaaaattttaaattaatgctgtttgttgagataacagttatattttaaattagaagtatgggccagatgatgggacatagcttctcggaaaaaaatatatccacattcttatttgcaaaatcagaaagctcatttatctttctgaatcacttgtcaaggataaattggcaagtcaatacttgaaaaaaaatttggttgtcatcagagcagaaaatgaagagtcattccatgtctaattaataactttataaacagcggatttctaaaaagtgggcccctcttttctccccactaacattataaaattataagtgtatcttaattggaagaaacattcttcaataaacaaagtaaggcattgttatcaataaaataataaaaattggggcctgatccacaaaatgtctttttctcttattaccccctagctaaagaacgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagcttaggaaaatgtagaaatttacctaattctttctctaaggctaacataatgcttatgtccaaacaaagaagaatagaagtaaaaaagtaaacatgagaggtcagtctaacttagaactatagatgtaaatatccaaaatagaatagtagtaaattcaagctagtactgtggcaaaataatagaatagtgcaaatagtcatatttttatgtctatgttatctttgctagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtattttagacacacatttaccttctttgctgacaatgattctgtcatcaccatctccatggacttccagaatgccttaatcatcatcagagtatcctacacaaagttgtctctgaccaaggaactcatttaatggtaagtgaagtgcacatccaaagattcactagtctttactacttactttaccatgcagaagcagcttgccttacacaaaaataaataacttactggaagcttagttatgggatcagctgttcctgggagtactgtacgacaagattgcaatagatgctttaacagagccacccatatatggtgctttttttccccatagtgaggttacacaggactaggaataaagaagtcatgaaagcagtggcccttttcactattgcaccagttaacctactgaagaagtatgtgattctttttttctgtctccacaaccttgggctcttaggtatatcagggatgaatgctttcaccagggaataaagccatggttccattatattaaaagctgagactacattctggccatttttgtcctctcgtgccactgaactgacaggcagggaaaggggctgctatagtggctagagggattgagcccaattactaaggggaaataaggttgctgatatacaaacagggagagcaatgctcagagcccagggatactcactggggcacctcctagtactgctttgcctaatagtcctgggaagtgggaaagtgcagaaattcaataaatacaggattgaagattagggtcactacatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatc
